United States Patent 9,486,487 (METHODS AND COMPOSITIONS RELATING TO MICROBIAL TREATMENT AND DIAGNOSIS OF DISORDERS) - sequence listing, part 8

SEQ ID NO: 8 - DNA, 3806602 bp, Clostridium butyricum WBS-01 (residues 1,903,302-3,806,602 of 3,806,602)
agtatttttgataatataaaatacggaaatttcgatgcaactaaagaagatgttataaatgccgcaaaagctgcccattgtgatgaatttataaaagcgcttcctaatggatataacttaatattaaacgaggaagcaaataatatatcacaaggacaaaagcaacttttaaccatagcacgtacgattctttcagatcctaaaatacttatacttgatgaagccacaagttctgttgatacacgaactgaagtattaattcaaaaagctatggatcatcttatgaatggaaggacaagctttataatagctcatagattatcaacaataaaagatgctgatattatccttgtaatgaaagatggcgatattatagaacaaggaagtcatgatgaattattaaaaactgatggattttacgctcatttatataacagtcaatttgatgaatgtgaacaataatctttttaatggaggaaaaataatatgaaaataccaaaaaaaattatatatcccgtattaatagttcttgttattgtaagctgtagtatcgggtattatttctacagcactaatgtcttatatttcaaaacagataatgctaaaatcacttccaaaatgtacacaataactcctgtgactaatggtaaggttattgaatggaatgttgatgttggtgatgttgtaaaaaaagatcaagttcttggacgacaacaagtccttccttatataacttctccaatcaatggaacaatagtaaaaaatgatgttgtgaaaaatgaaactgtaagtgctgctactccccttgcaattgtagctgatacagataatatgtatgtaggtgtaaacattgaagaaacagatatacgtaaaattttagttggacaagatgtaaaaataacattagacgcatatccagataaaacatttaaaggcaaagttacagaaatagataatactacacaaacttatttttcaggaacttcaagcctttctacaagcggaacttatacaaaagtcacacaacttgtacctgtaaaagtttcaatagaaaataatgataatctccctcttactttaggtatgaatgcaatcgtaaaaataaaattaaaataatgactctatgaaaggagtgaaatataatgaaaaataaaatcttatcaatcttacttatactatctttaagcacattttttacaagttgttctccattcactaaagaagatatagcgaatgttacattgactaaagttaaaagttctgattcaataagcgatacagtttatacatctaatattgaaagtcaagatgatatttctatatttccaagtagtcctggaaaagttcaaagtatcaattttgaacttggacaagaagtaaaaaaagatgacgttctctttgtccttgataatacagagttaacatataaactaaatgctgcaaaggcaaactatgattctgcatctgcatcttacgataaagttgcaagtggaagtgcaaaacaagcacaaatagatgcagaaaaagcactagaagcagcacaaaatgaactaaaagatgctcaaaaagcttatgatattgcaaaagatcaatattctaataatacaaacataacttcagcacaaacagcttatgattcagccaagttaaattatgatcgtacaaatacactctacactgctggaggcgcatcagaagttgatttagaagcagcacaagataaattaacaactgcaaaagctgctttagatcttgcaaaagacaatacatccatggcactttctacagctgaaacaagacttagcaatgcaaatgcaagttataatagcgcaagtgcaaatgctactattacaagttcaattacaaatcctgataatataacagcagcaaaagcatccatggatagtgctaaagcttctttagatttagctcagtattctttcgataatgcagtaattaaagcacctgttgatggaaaaataagtgcaaaaaacataagtgttggagaatatacatctacacaaaccccttcatgtataattactaatgaaaatactttaaaaactacgataaaagttactgaaacaaatatacaaaatattaaagaagggcttgatgcaaatatctacattccttcatctggagcttcatatagtggaactgtatatgcaatctctccctctgcagacacatctacaggaatgtttgatgtaaaaataaatataactaatcctgatgaaaacttaaaggtaggaatggttgcaaatgtaacatttaatgccaataatgaaaatgaatctgtacttgttccaagtcagtgtgttttcaataaagatagtgattcaccatatgtttatataataaatggtgatagattatctaaaaaatctgttactgtttctgaaaaccaaaatgattatctcgtaataactgatggattaactacagatgatgaagttgttcttcaaggaagctcaaacctatcagataatgttaaatataatatagtaaaaactaattaataagtttattttcagctttttaaaaataaagtatacaatattaaaagagacagtttgtttatgtttataataagctgtctcttttaaaatataataacttttagtatcacattatttcaaactgtgtttaatctattctccatgattctactgcacttttaagctgtccaccgcatcttgaaagttctcccataacctgctgtattccatattcactcttaaaccaattttctttattaattccatcaacatcaactggacaaactataaattttgtattttgataagcccaactgtaaaacataagacacctttttgcatgaaatgatttgcagcatattattgcttttttcacattaagtccaagtttgtctgtaactctttttgagttaaaagcattttgttttgtccatgttgcacaatcttcctttaatacaacttcttctggtactccatttataattgccacatcttttaaaaattcaaattcagttttataatcttttttgtatttgtccttcttactttcaggctttgtaaaaccattaaatttcatactaaattttcctgatggaagtatatatggtgcatatccatgtaaatatagatcacaagctttctccatgggttctggatataatccacctggaacaaatattatgtctgacttctcaatcttatcttcaacaaaaatgtatgatgtaatttcttcaataaattctcttcctttattcataaccatttctctcccaaaaacttcaataattttttaaataccttagtctatactaacacttaaacttttctataatgtaaataaaaacatatattcatatttttacatgtttgaaagttttttataataattttattgtatcacaattttatattctaatattattattcttaatcaaaacaggagtacttacttaacttcagcactcctgtttcttatctatgatttatatattgcttttattatcaattctctattctatgctaaatacttgttttttaccttagttgaaaaagtctctaaaagtatcgcacaaattactattgcaattgttataaatcctacttccccaacattaaaataaaaattactagccataaaaagttcaaagcctataccaccagcccctgctgctgctcccatagcaactccatttgtaaagttaatttcaaatctcataaatgtccatactaaaatataacttatagatgatggtatcacagcctgaaatactatctgccaccaacttgctccacttgctttaagcgcttctatagtaccttcattaatctcttcaaaagcttctgaataagctttaataagatatccaattgtatgaaatgtcatacctattacagctgcttcacttccaagtcctgcagttactgcaaaaatcaaaacccataatactgtaggaacagctcttataaatgcaacaagactttttattacattagataaggtaggtgttgataagtttttagcagcaaaaagccctaaaaatagtgctattatagctccaatgactgttgtaagaaatgataatgcaaatgttattgctagctgattaagtgcatctcttaatgtaaaatgtgaaagtcctgcacctaaaaacatgttttttatatttactaaggtttcagcaattgcttttccaatttctatccccttataatcaaatgtaacaaatcccaaaatcgttattgcaatgagcgaaactaatgtaagttttatatatttttgtgatggatcatttgattttatctttatttttcctgatgcactcttattaatatgaaaatctagagactgtacacttgtttccattaaagaatcaccctcctcacataattagatataaattctattataaaaactgctattactatagatattacaacaagacttgcaacaccataattcatgcttttatagtaaagatcaaatataaaacctatacctgtacctgttaatatacctataagcgtgctacttcttatatttgtttctaccatatacaatatccaacttatcatctgcgtcatactggatggtataacagcctgaaacactatttgtggataagatgctccacttgcttcaagagcttcaattgaatttatactagattcatctattgtttcaataaatgctcttgtaagtactccaaatgatacaaaaaataatgcaaaatatcctgttaaaacattctgaccaaaagataaaagaaatatcattgcccacactgcatcaggaacatttcttgaaactgatgctataaatctacttacagtactaatgattccatttacctttgtaaccttagaacccataactccaaaaaatagtgcaaatcctgcagcaacagttgttgctgcaacagataacaatattgtttctataagcttattcaatatatttggaagtttcgaaaatgagttagcttcaggaataaagtttgttatcatccataaaaaggcatcaggtatagatagcaatccctttaatgaattaaagtctgttatttttgaagatattatacaaaatactattattaacaatagtactaaggttattgttctctttcttttttctaaaacttcaattttcatttctacacccctagtctgttataagacttccatcttccgatccatatatttcatgaattttttcttcagtaagatcttctggcgttccacagaaaacttcttttccactatttattcctattatcctatctgaatacttcattgcaacatctacctgatgaagatttaaaatacatgttattcccatttccttatttattatctttaagtgatccattattatctttgatgcattaggatcaagagaagctataggttcatcgcataatacaagttttggattctgaataagtgcccttgcaattccaactctctgcttctgccctccactaagcatatcacatcttttatatgcttggtcttcaaggcctagcttttgaagtattttaaatgcctgctttttttcttcttctgtatatcttcctagaattcctgctacagaagatttataaccaagtcttccatgcaatacattttcaataacacttaacctttcaaccaagttataatgttgaaatatcattcctatttttgttctaagctcccttagcccctttttatttagttcttctacttttacattatcaaaaataatacttccttcacttgtatcaatcattctatttatacatcgtaacaatgttgattttccagctcctgaaggtcctattattgatatgaactcccccttatcaactgaaaaattcacatttgataaagctctagttccacctttgtattctttacttatatcatcaacctttaataactccatagtctattaaactcctcgctatcttatttagataaatcccttataggatcaaaccatgagtcttcaacatttataaatctttcatttccttctttagtgaaaaaacccttagtgttactatctttttcaacaaaaacttttttatcactggcaacttcatcagatgtaaatttttctactaactttttctgatcctcttcacttataacttcagtattcataacaaatggagcatttaacactggtatacttgcaattgcagtaaattctttgcccgttaatgtattaaatggttctgctgcatcagacttaaccttgtatgtagtaccaacttcattaaaagttccctctactgcatcaacataatttattaaagtagtatcgcaaaatgctccaacgtctgctttttcagtcaatacattaactgcacttccctgatgtgatcctccatacaatacctcactgaaaaatttatcttttccaccttccattaaatcttcagtttttaaatctttccatttatcagtctgtgaaaaatatgaaactattgaagttgtaggaatcttaaaccctgaagtggaactgtttgatacaaatgacattttctttccctcaatattatcaagggtgtacttgccatcctttttataatcttctgctttatcttttggtacaccaatccagctataataaactgcatcatctatagtgccagattttccacttggaactgctaatggaagaatcttttcattctttttatgtgcttcaacataaccttgagctcccataaatgctattcctccagtaccatttgcaattgactctatggccaccgaataatctgtagtaagtttatgttctacttttttaccggtagcttcagtaattatatttcctatttcattacgtgcttcttcaagatcaccacctgattcattaggataccaaactaccgttatagcatcactgccttttcctcctatagattttgaagaacatcctgttattcctgcaaaaagtgatatgcctacaacacaactcataactaaagttaatatttttttcattatattaatccccctcattactaatagcttctatactatttaaatttgcttataatatattaatatcttaaaactccattgttaattttttgtaattcatatgaagttttaactaaattttaaaagagacttaaaaattctttcggactctctatatttcccattatcatagaagtctcaccatattccccatgaaagtcagttccgcctgtcataattaagttgtgcatctcacaaattctcataatcttcttcatatcttcaacgctatgactatgatgatttacttctattccatccaatccattttccaaaagcactggaattatatcataagaattcaactggcccggatgagcgagtattgctattcctccatcagcttttattgcttttactgattctatcacatccatgtattcaatatcctggtcacatattccaccatttttaaataagtctctgtataaatctgaatatatgttatcagtgtatcctgcttttatcattgcagacattatatgttgcttgtacaaaacttcactttcactacatttctcttctatgtatgaagtatcaattttatagccattttcaattaatattttcatttgtgtcctactgttttcatctcttcttttcaaaattggatcacatattcttcttatattttttccttcaaaatcaaaattatatcctaatatatgaacctttcttttattgataaaatcataagatgatatctcgattcctggaatgacttttattccaactctctttcctaattcaactgcagcttttaggccacttatggtatcatgatttacaattcctatatgagttatgccttgttgtcttgccatatccaaagtttcacttgtagtatatgaaccatctgaaatgcttgtatgaacatgtaaatcggctttcatgtaaactctctcctcttgaatttatttttcatatttaactattaaataattttttatacaaatgttcctgcctgcatattataagttttatcacaaagtccctccataaattcaatatcatgaaatattcctatcattgttgtaccttctgacttcagttgttcaataagttcccttacctttatttttgacgaattatcaaggctggctgttggttcatctagaagaagaagtcttggacgcttaaccattgctcttgctatatttaatcttaatttttctccacctgaaaaattatttgggtaagtatcccaaagctccttatcaatctcaaaatgaagaagcattttttgcgcttcagattttgcatattctaaatcatgtcccatctcaagaactgcttgctcaattaattcccgtgctgtagttcttggcattacattaagaaattgagatacatatcctatttcatattttctaagatatataatctgcctctcactagcttttgataagtttatatctccaaacatatccgatttataccatatttctccttcttcaggaaaatatgttctataaagacattttaatattgttgattttccacttccactttttccggttattccaataaattcaccttcatttagttctatgttaatatctttggatgccataatatgcttgtttaaattatgaagcgtaaaagactttgataatccatgaatttttaataattccttcattaaacactaaccttccctctatttttctaaaatacattcctttaatacttctgtagctataaccaataattcacttttattaatacgtaaagttttatttatatacagtaattttgataaaatatttccataaaattctcctcttgattacattctataatttatttttgacataagcttaccgtcaacaaatacacttgttatcactggtaattcttctaatttttcaataattaatatatcagcttttttgccttcttttatcgatcctagtatgttatctatttttactgctttagctgggtttatagttatgagcttaaacatttcacataaatccatattatatttttcattaagaataaatacagaatgaagcatagcagctggataataatcactgcataaaatatcaatacagttatcctttattgcttctgatgctgaaagattaccagaatgagattttccaagaagaacattaggtgctcctgcaatagtgaacatacctttttctctcgcatattttgctacatccattgttataggaaattcgcttattgttgcacctattccctttataaaatcaatcttatcaaaactatcatcatcatgagatgctattgaaatatttctatcctttgccatatgtgcaatttcttctatagtttcactagttatagtgtctttaaactggcgttcttctatcatttcatcaatttcactatctgttacatccttatatccctttaaggtctttctatatgtttcaatgttcctatactgtccttgtcctggtgtatgatccataaatgaaagtaaatttattttcccatctcttatatatttctttaatcgttcaacacctttcacattatctatttcaaatcttgcatgaaatctgtgacgaattaagtgtctcttattctgagtattttctatagtatcaataagctttataacattttcatcacttcttatgggcttgttttcaaaaatgtcctttccatataatgaaagagaatgatacattgttgttatacctgtatttataagaactttttcagtttcccttaaactaaggttaaaatccataatacttgtaggccttggagatgacatattttctatataatctgcatgaatatctataaaacctggtgaaataaaacctccatatgcattaataacttctatttcatcactatctacctcaccgttcttgcatattttctttataatgtcattttctattaaaatatcatatccttctattattccttcttctgttattatttttccattagttaataaatacatttaaacatttcccccttaaagtaatgactgaacaagctgttgtgtatatgcatgctgaggatcttctaaaatttggtcagtaagtccactttcaacaattttcccattaagcattactatagttctatctgcaagcattcttataactccaagatcatgtgataccacaagcatacttataccaagttctctctgaagcttttttataagatcaagtacatttgcttggacagataaatcaagccctgttgtaacttcatctaaaagaagtataggaggattattagataatgcctttgctatttgaaccctctgctgcattcctcctgaaaaattccttggtgcttctttcattctgaatattggaatatttacgtgttctagaagttcttctgctctttctgtcatgaaagaaacattcctattacctgctgcaataagtttttcagcaatatttccaatacaagaaaagtccattttaagtccaagcattggattctgatatacctttccaagaagattattccttatatatcttttctgttgtgaagattcaccaaaaacattttttaatccatcacaatagttggatagatatgtttcaccacttgtaacttctttatcaaagtaaaggcactgcatcattgtagactttccgcttccactttcacctacaacacctaatatttcaccctgataaacttcaaatgatatatcctgacaagcatatacagttccacatttaggacagtaattctttttaagactactttcctctggatttctgcaatgatcacatcctggtccaaactgctttcttaaattttccacctttagaataggtttttcattactcattattttttcacctaaccttttttatttaatgtacttaaacaattactcgtatcattgcactgataataagtttgaccgctacattcatccataagctcatccatgtatacatccatctttccacacagcctgcatacttttccttcaatgctttcctttttaaatttgtaatcctcaaaagctaaagaaacaactttagtatatggaggaaccgcataaaccttcttttctcttcctgctcctaataaaattagtgcttcactaccattcattttaggattatcaaatttaggtattggacttggtgccattacatatctatcattaaccataacaggatgatctgctccagtagacatctctccaaattttattatctgctcaaaaagcattaaccaagctccactatattccttttccccatgaagcttctttgttactgcttcacttggctcaacccctcttaatggttcaggtgtaggcacttgaagtacaagaatctgatttttatttaaaggcacttcaggtattctgtgtcttgactgtattatagttgcttcatcagtctcttgagtcactttaactcctgtagtcttatttacaagtttctttatattaactgcattaacagattcatctgatccctgatctataacctttagtacatcttcttttcctatcaatgataaagtaagctgaagccctcctgtaccccatcctcttccaataggcatctctcttgaagcaaatggaacctgatatccaggaattgcaactgctttaagagttgctcttcttatttctcttttagagccttcatcaaaaaaagcaaaattatatttaaccttcattgtttaattctcctttacgtgttttacgtacactatctagttctgactgaaatgttacatagtgtggtagtttaagatgtgaaataaatcctgaagattctactgaatcaatacttaaaagtacgaattcctcatctccagtaggatattttttattttttctcacaagacattggtcaagaatgctcattgctatagctttagtctcattttgcccataacatataccataacctatttcaaattcctttacattttctccatgattattctgaactgtattaggtataaagcattctacctctgtaacatttatttctccaatataataatcattttcatcacactcttcacccataggatcttcaatatatagtggaagatttccaactcttagttcaccaacattaggatgatcatccattcctgaagttctaagtgctgaatatgctagtgaatttactcctcctgtctgtcctcttgtaagaatctgaagtctttcacttctttttgttggaaattcaagagtttcctttgttatgtcagctggctcagtattgtcatcttcataatcctttataagaccttcacttcttaaataatctaaaacctttgggagttttcttaaatctgtaccatccttaaaattattattttcatatttatcaaattcttcaagccacttttctacttcttctttgttttcatttattaaatcaaagtcaataagtctatgtgtatagtcataagcagctcccaaaatctgtcctcctacaatgtctttaaaagaagcagatattcttctctctacccacatatctcttgaatctattatttttgtgtaatgctttcttggaagagttgatctaaaagctctaagcagaaaaactgcttcctcagagtttccttctgactgctttattgcaattgcagcaagctctcttgaataaagactagcttcagacataacaatatcaatcatgcctctcatacctgaaagaatattatttacatcaattatttcttttccttttaatctttcatattttaatctttctatggactcctctatggccttagttccaccctttactgccacatatcccattttatttcctcctccttatataaaaataaatttctaatatcctaaatattaatatttgttgttctcggaatacataaaacattgttatttctatctaaaaagatacagtctattccaagtggatattcacaatttatctttcttcttccattaatccattgtctgtttcctgatatacaaacactattgctctcctctattcctggcccagtgagttctatatctcctatttctgatatctcattgaattctgctattatagttgaacttttattaggatttgataaatcgcctatttttacccttcttagtacttcatgaagcttttcattgcatgcatcctcagtaataaatacataatcagcttcttcaattgtatctattcttgcataagtcatctcacttacaatacttgaaatcttttctgaatcttttgatataacattaaatgttacttccctgtcaagtagcatcagcatcataaaaaccgtacttttatatgcttcaatctcagaatctatatttgatgcctcctcatttaagttttcaaccactccgggtctcgccatagaattcaaaacttttctatatccattctgaacatcatgaacataatcaaatttaaccatcttatacctccatctcttctagacatccatagttctaaaatctacttttgtttttaatatttttgatgcttctttaaattcttttttatttatttcaattgcttctttagtaagtaatgtattccagcataatgtttcttcaaaattgcatttgtaggcacaatctataatcgcaagattcaatgccaattcttcattatcgccaacaactattcccatacctaaagtcccatttattgatacttttgcttctgtaacaagaacctcacctaaataaaatagttccctttttgctgtttctctcatttttatcattacaagtccattttctggttcctcaacaacattgatcttatacttacttttaatttgctctgctaattctatatgtaaatttttatttcctcgtattaaaatttcagttattttttttctgtccatttttcatctcccccttacatttttgattatatcttggtgccaagttaaaggggtttaaatgcatgttaatatatgttaaataaatgcatagatttttaacaaaaaaaatcgttaaaattacattttaacgatcttttacttaatatatagaatttttatttatagcacttttaatattaatatattttatatttaaatctatcactacggtacattatttctgtatactctaatatcttctgtgagttcttatcagtacagtttgtttctaattttaaaataggaacaagatcttcacatttaagataaattctttcttgtactgaagcatatgctatctctaaaatgcttttttctgtcatataattcttaaaaccatttttctcataataatcaaacattgatgtaatcttttctccttctctatctatattaggaaaaattttcttagatacatatgatatatgaattgctattggttcgtcatcaacaattctaagtcttgctatcttgtaaatttcatcgtcttcatctgctctaagttcattatatatgtgtttattgtattctattttttcacagcatatatttattgtttcaagtttaaatccattttcttttaattttttagagaaactttcatttcctgatagcacaagttcaatagtttttgttcttctttttagaaaccttccccttccttgaagagaatatagatagcccatcttttcaagcttcttataaatatttcttactttaatacgtgaaatttcatacttgctagctaaatcattttctgaaggcatcttttcattttcattataaacaccgttgtttatatcatatagcaatttatctattatctcattttcaatacccatatataaatcattcaataatacatttcctccataaatacttatatttatatatccaataaaaaatatataatattatctatattttaatagtagtatatatcttacttatttagttaattattatttttctttcttctattgttgagttatattcttgattcatcaaaaatagacagtcaaatatgattatatcagactgtctatgctacaacctattctttatcaaaatctcttgcaacatcccttgatgtatgtgagtcagatccataaacttttcttatttcatatctatctactaaagctttgaatacattacttacataaacttcaccacaataaggctttctaagaccagcagtatttacatctacctcataatccctgctctttattgcttctgctaattcttcaagcaactcataatttttatactcaataggataaagcttattaaagattcttattaaattaggatgtcctatccgttttggcttatattgacccaaatcatatttaacggcttttaataaagtttcataatacttatcatataccttttcaacatttccataataagttaatgccttttcaaagccttctctccaatcaatagcagtatattcatctcctattttaataaaatgtacagataatattccatcctccatacttggaccatattcattaagaagacctatggtcttttcttcaagtccatcaataaagtctacttccatgcctaaatttatctttatcttatcttcatatttttctttaatcttactcactgcataaaaataatcattcatacggtcttttggtgttgcacattcatcctgaaactttctgtcctctataaaataacatggaaaaggcatatgttcagtaaaactaatttcaacgagattatgttttaatgcttcttcaacatacgattcaagtgaatctgaagttccatgggacaaaaaggtgaatgaatatgtccatctcttaatctcatatttttttctgtcataaattacgctccaatctattaataattaaaataaacatatttaatcatataaaccctttaattaaaggagcaaaagtatgtttttaatgcttcacactttgctcctataaatatactctattatattattatactcctaaagtagcatagataattgctttaattgaatgcattctattttctgcctcatcaaaaactactgattgttttccttcaaatacttcatcagttacttcaatagaatccattttgtacttttctcctacatccttaccaactttagtttttaaatcatgataagctggaaggcaatgcataaatatagcttctttattagcatttttcattacttcactattaacttgatatggtcttaataatttcaatctgctatcccatacttcttctggttctcccattgaaacccatacatctgtgtaaattacatctgcattctttgtaccttctttgacatcttctgttaaagttattgtacatccattttcctctgcaatcttcttgcatgtttcaacaagttcttcagctggaaataattcttttggtgcacatgctgtaaaattaagccccatttttgcacaagccaccattaaagaattccccatattgtttcttgcgtctcccatatatacgaaatttacccctttaagtcttccaagtttttcttctattgtaagaagatccgctatcatctgggttggatgaaattcatcagtaagtccattccatactggaacgcctgaatattttgcaagttcttcaactgtttcctgactaaatcctctgtattcaataccatcatacattcttccaagaacccttgctgtatctgcaatgctttctttcttacccatttgtgaaccagctgcatcaagatatgtaactccaagtcctaaatccattccagcaacttcaaatgaacatcttgttcttgttgatgttttttcaaataataaaactatgtttttccccttaagattattatgaagtactcctgccctttttaaattttttaaatccttagataaatctattaagtatcttatttctgcttgtgtaaaatctaatagttttaaaaaacttcttcctcttaaatttactgccattcttactgcccccatttttctagtattttaatttttcttttcacttattataacatatttcccaaaataaaaatattacatacataaattacttactgtctagttttattaattcaatagacttataaaacttgtatattcttttatgtgatataataaatttgtttttcaaattaaattaaagaaaggtttattaaaaatgaaatatttaagtgattatcatatgcattcaaagtattcttttgatgcagtccaaactattgaacaagcaataaaaaaagcaatttctatgaatattagtgaaatatgtttaacagaacatattagttttgatccagatgacaaaagctacaatttcttcaatttctctgattatgaaagggaaataaatgagctttctcataaataccaagattccatcaaagtaaaaattggtcttgaagctggtgaaattcatctttataataatgaattcaataaattttttagagaaaataacttagattttattataggatctatacataatataaacagactagggcttaatacaaacttaagagaattcggttcatctactacttataaaaactatttcaatgaagttctaacccttgcgtcaaattcagatttcgatgttttaggtcatcttgatcttgtgcaaaggtatgcttttaaaacttacggtgtatatgagtttaatacatataaagatataattcatgaaattttaaagactcttatcactaatggcaaaggtattgaagtaaatacttcaggactaaaagaaaatcttctttttccaaaattagaaattcttcaaatgtataaggaccttaaaggagaaataataactgtaggttcagattcccacaattataatagagttggtgagaatattgaaaatacttataatcttttaaaagatattggtttcaaatatgtatttacatttgaaaaaagacaacctaaaggaataagtctataatatatattaaaggcagtttcataaatttgaaactgccttttctatcctgccatctgcttaaccccttctctatttttaaattgcataaagataacttcacatacatcactactcatttcaatacagttttgaatatcccatctaaagcaatgttttccttttctatattttaaaatctgactcttaattctacttttcaactctttaattgtttttttatttgtttttcttttaggagtttttaagtttttaatgttgttaagaaggtatttctgtatctttctttcataagccatatgctcattaacatttccgatactatcagttatatgtgaataacagcaaaaatcacataaatagtgtattataattccaagctgaagagaattataccaattaaattcctttgtttctaataaatcatccaatttctcttctacatacttatcagattttttataaaaatgaggatttgtatatgcaagccaacagcagtctgcaagtattgtaccaaaataaaacatatttattgaaaaatttttaggataaaacggctttaaatttcttaatgataattttgctaaatgaaaatgtgttctgactttcataattaaaccactcccttaagttaataatatattcatatccacttcctaatactatatatattagaactcttaacttaatgatagctgtacaatgttatttatactataactttttattaattatttgtaaaaatatttattttaacagattatttacacaaaatgcttctataagctaaattaaaaaaatccgttctaaattatattttatgatttaattcatctataaatcaacatattcgttatattttatgagaataagcggcataggttattaaaaacttatgccgcttatatgatttttttattaaattactaatacaacctaacaatattcattaatcaaatcatattctttaatttatttttaatttgaaacattttttcttctaattcatcaatttctttgtctaatctattttcctcctctttattttttgtgttggatttcatctctaatttttcatcaatatctgctaaaacagaaataaactctcttgtataatcataggctgttttcattctatcactctcctattaattaatttaatagatttgattaataattttaaaataaaaatagatataatccaatatatgactattggattatatcttattactaaatatattcatttaattttttattattataaaataattttatatactactcatatctataaaccaaatctttaacattatgacttccaaaagcaaccgcttcctgcacatgctgatatatcttatctgtgacattccatctatctggacaatttaatactactattattatatctttattattgttattcacagatgatacaaggcactttccagcctgaccagtataccctgttttaactccattagctccaggtattttccataagattttatttatattattgtagtccctagtaaagttgtatttatcttttgaaatagacttactccctacaacttcacggaacaagtcataatccatgcctttgcaagttaaaagtgctaaatcatatgctgaagaataatgttgactactatctagtccatggggagattcaaaatgtgaatctaaaattcctattcccctagcataatgattcattatctctgcaaaaccttccacacttccaccaatatgttcagcaattgcaatagctgcatcattacctgatttgaacataagtccaaaaattagttcttttaaagtaataacttcattttctttataaccaacttttgatcctcttatactggatgcctttttacttattgttacaggtgcatttaaatcatcttgttctattgctataagagaagttaatatttttgttgtacttgccattggaacaatttcataagcattttgttcataaagaacttgatgactttctttatctaatgctattgcacatcgtgcattaaccctaagatttttattttcacttttttcattatatgagtatgaaatattcccataatttatatatccatatgcatctacagataaaatttgaacaaataacgaacataataataagattgaacttattttaatgcctttcttcataatttaccacccctaaatttcttttgtatctcttctaattttgatataaatcaataaaattactacttaattctattatctcaagaaatttattttttaatcctaataattactcaaataatatgtttattttttatatttttggtaatacttattagatgtattagatttggaggatatttatgaaacttttacttactctttttattatatttatgttttttcctattccgcttaaattttatatatactattataataataattactatattaaattatacgactttatactctttgataatgcagtgttaaaaaagaaaaaagagaaaacagaccaaaaaaaaataatcctccaatgaaatctaaaaaaaatctaaactatcagaaataataacatattccaatattatggaaatcataaataaatttattaatttaaaatttaagcctattttaaactttaattcaaagcttgaatatagccttaatgatgctgctaaaacagctttgtcctatggaattctatcaactcttccttctttaatatatttttttataaaaattttatttaaaccaaaaaaatataattttgacatattaccaaaattcgataatgcaatactactaaaatttgaaattaaaagtataattttcatatcatttgcaaacattatttatatgatgtttgttttattaaaatattgtatatatattttgcacaaaaataaaaaaaacaaatttgagaatataaataaggagtgattattattatgtcaaatgaacagccagtggaaaatttaatgcgtagtacaatggaaaatttacgtgatatgattgatgcaaacacagtaattggtgaaccaattgaaacaaaagatggtacatgtataattcctgtttcaagattatcatttggttttgtatccggcggaagtgaatttatgtcaccacgaaataatcctgaagaaaattcttacccatttggtgggggtgctggctctggagtttcagtaaaaccaataacctttcttgtaataaaagatgatatggttagaatgatgcctatcgaacatgataatacttatgatagaattgctgataatatccctcaggttttagatatgatcaaaaatctgattaaagatatctcttctaacaaaaataaaaaatctgattgttatgattcaataaaaaaagatgatttatctgatacatgttctaataatgattaatacattataaataatcatagatatattattactgctctttattatattattatatatctaccttttattaacagtatgttagttactttttatctttttatataaaaatccataagaaaaaatgatgaaaatagcatttaaataatatttccatcatttttttgtataaaattttattattctaaattattaattgtcttttcttcatctacatcataatatttttcattattctcattttcaacacttgcaacttcatcatcatcctgtccaaataaatcaagtgaaggaagatcctttaaatctcttaaatcaaattgtcttaaaaattcatccgtagtaccatataagataggtcttcctggtacttcaagtcttcccacttcttttattagatctttttcaattagtctttgaagagcactttctgactttactcctcttatttcgtctatatcaattcttgttataggttgcttatatgaaattatcgcaagactttctatagatgcttgtgacaaagattgccttttatttttctttaaaagtttctgtatatattctgcattttcaccttttgtaacaagctgatattttcctttaatgcttataagctttattcctcttgtttgaactttttcataagcatccatcatctcttgaattatcaactcgattgtcttagatttttcatccagatgatttgaaagttcataaatacttaaaggttctccacttgcaaacaataatgcttctactgccgattttaattcagacttttttgcgtcatccatgaaaggaatctgtagtcctttagtctccttcaatgttatttctcctttcaataattatctttgtaaaactatcgttttgatatacctttaccatcctttgttttatcatttcaagtaatgctaggaatgtgacaattgtctctagtttacattcacttgtatctataagttcttcaaaataatttatttgttcattcttcattctatttactatatattgtaatttatcttcaattttatatttatctacataaattttcttttgaattatattccctctgttttgcttgttgttataaatttcaagaagattgttatatatattatatagttgaagtaaatcaagatttttcaaaatatcatcatgattttccttttgtttcacttcttcaattatctcaggcttctttccataaacctccccagaacttatatatctatccttaaagaaatttgaaactcctttaatttttttatatattataagcttttctaaaagatttttctcgacatcctcttcattttcctcttcctttttaggcttaggtaataagtgttttgattttatttctattaatgtagctgcaactactataaattccgatgttatttccaaatccatttctttcatttcattaagataattcagatattgatttgtaatttcatatattctgacattatatatgctcatttgattttttcgtattaaatgaagtaataaatcaaacggtccttcaaaatcattaattttaatctttggaagctccatccactcacctccgtctccaatttcactaactacatagattgtagcttttttcttttgcttaatatttctaaaacagttttgtcttttatttcatataataaaatattattatccatattacttatttcataaatacatatatataataacaatttctactccacaacacaagaaaatatgtaaacaagtgttctttcataaatatttaccactaattttagcaataaaattttaagcattaacaaagactgagataatagattacctcagtctttattaatgctatttattactttttttcttccttaccttcttctttgtctccaaataagtgtgtaatattgtatttaatattatcgaatatgttacccttctttatgtttctatcacaataaattgtaacttctccgattttttcattattaaggtaaatttcacacttacctacaacatcgccttctttgtattccttttgaagttcgtctattacaaccttcttttctacttcgtctttacatccttttggaagtacagctgttaaatcatcctgtgcttttgccataaagtatctatcagtctgttcatccatatatactttatctacttcttcatcttttgagaagatttttttaccttcatactttgaaaaaccatagttcaataatattgatgcatcacgatttcttattttatatgttggtgcacccattattacagaaagcatacgaactccgtttcttgttgcagtagcacttatacaatactttgcttcatttgtaaaaccagtttttaatccatcacatccatcaaaaaatctaacaagcttattatgatttacaagttctattggagatttacgtccttcagttattgtatccatataagttccagtgtattttaaaattgttggatgttttaaaagttcctttgacattttagcaatgtcattagctgttgataaatgtccatcagcaggaagaccattacagtttttaaatgtagtattggtcattccaagctcttctgctcttttattcatcataccgacaaaatcattttcagttccacctagatattctgctaaagcaacagcagcatcatttcctgatgctattgcaacaccttttaaaagctcttctactgttctaatttcaccagtatcaagaagcatagtgcttccgcccatctttttagcattttcactacatgtaactttatcatctaaagctatctttccactgtccacagcttcaatagtaagaagcatagtcattattttagtaacagatgcaggagcaaatttttcatctgcatttttttcataaataatttttcccgtgcatggttccattaataatgctgatcttgcttctatttcattactttcagcatttgaattttcattggttttttcaggttttgaactactcttattgctttcacttgatgaacctttatcctttgatttctcttcagtttttgattcattctgctttgagttctcacctttatttttatcatcttttttaggttcttgtttaacttcatcttctaaagcaatatttaaatctgaatcaaatgctgaagcacttattggtattaataaaaaagtgcaaataaatatcaaagttaaagctgtaatactttttaaatttcttttgaatcttcttttcatgttctttcctcccttcaaaattagtgttaccataagaaaaaatattatcacattgaatattaaatttctttcgaatataaacaatataaatttatctatatataacaaaaacttacactaagatcattttttagtgtaagtttttgttatatatgtttttaatactatttatacaagtcacccgataggaattttaatttttcaagattttttatcaaatatgactttgactttttctctagtataccttctttacaaaacttatttaataccctattcaaatgcctatagcttgttccaagtaactcagcaatttcagagtaactaccttcaaacttaaatactgatttattattacttccctcaacaaaagcataaatataacttgcaagtttattttccaaactatataaaatgttaattgaactattagtactacttatactaagcttttcaccaagatacctacatatataaaaaagaaatttacagtcatttaaaagcttagtgcgaacaacattaaaatttattcctataccatatgtatcatctattgcttgaacagtgcaatctgcagtattagtacgtgtgaattccacatctcctatcattctaaaaggtttataaaagcaaattaataaggctttaccattctccatatttttacacactttggcttttccatcaacaataaaatataaactgctgagcttttcactttctttacatataaattcatttttcttccactgaacaagctccatgtactgtttcatatcttcactaaatagttcatcaatatgatatttttcaatataatcatttaatattttttcatcttctatctttaccaatttcaattctccttcaatattagctttttatattttaacatatagtaatttttattaaaatatagaaacatgacatatgtcctataataatttatatttaataatttaaactatatttagaaaaataataattaaaggagagcttatgtataattttttatcattactaataggaatactgattgcaataatggttgcatttaatggagaattatcaaatggcataggaaattactcttcccttatagttatacacattcttggatatgcactattagtatttcttatgctttataaaaaaattaaaattccatttaaaatgactcttccactttggctctatagtgcaggagcaattggtgtggctactgtccttatcaataatattacttacagttcaattggagtatctctacctgttgcacttggtcttttaggtcaatcattaacatcaattgtatttgatcattatggtcttctaggaatgcctaaaattgaatttaataaaaagaaacttattggcataattgtaataattatcggagtgtgcattatgacatttttataacaaaatatttattattaaactacatataataaaattaaggagcataaaaaatgatttttatatttttatctattcttacaggtgttataatagttgtctcaagaattcttaatacaaagctttcagaaaaaataggacttcttgaatcaagttattttaattatctaacaggtgctgtaacatcaataatattatttttatttgttggtgaaagtttcaatctttcttcattaaaaactgtacctttttacggctatttaggaggtattttaggagtaagcattgtaattctaaatagtgttgttacacctaaactttctgctttttatgtaacacttctaatatttataggacagctatttactggaatagtcatagactggattgtttctaatcatcttcctataaataaacttattggtggaatcatagtagtttgtggattatcttataatttaatcatagattcaaatgatcaaaagcaatattctatagaacctaaatagttcatcataagtcctttaaatttgtgtaataaaatttaaaaataattatataataatttagtatattgcaaaaataaagaaatccttattttacaagttctacttatagtatttctttattttttaagattaagtgtaaactatatcattccaattttaaagatattgatgtaaaataaggataagaatcgagatattgcatatgggaggcgattatatgaatacaattagtgaagctttagaaagagaatgtttagaaatactcatagatcaaaatcctatgttaggtaaagattcaataattgcattactggatgacataaaaaataatgctataaaaaataatactatcaataacctaaaagaaataattcttaatcacaagtattaatttttagcaaagtaaaaaattaatcattcaggcacttgactgtccacaatgtggcagtctttttattttcacatttatcatttataatgcccaatacattttgaaaataaatttatatacatttatctaatatagtaactttaaccaatccaatatatatttagtataaatcattgacttttcatcctactaaatatactattacagatatgacttatttgtagaataatatctctttattctgtatcagtgagtatttataataaaaccatacataaaatatatttccggaggataacatggctataaataaaaataaaaatggaaacttcttttacaataatgctgataaaagcaataaaaactttatgtacagtaatcttacaagagctaattgctataactgtgatttttcaaactcacattttgaattttcaagccttaggggcgctcattttaaaaaatgtaatttctatagatccaatcttaaaggtgctgaatttataggttctaatttaaaaggaagcaaatttaaagaagcaagatttgaagatactgtttttgaaggtgctaatctaactagtacagattttagtaatgctaaatttaaaaatactatttttgttggatgtgatttgggcactgctaaaaacttaaatctggataacaaaaatatcaaaatattcgattctatgcctgaactaaatattagtgaagaattacaaaaagtagcacaaagtgctatggaaaatgaattcataaaaaaatcaagagttttagatactaaggatggaaatttaaacggactttcatttatgattttaagtgaaaaatttgatgagaatactcttattgaaggaatgcattatataaaacttgaaatagacaaggaatttcacacattaagctacataataagattaattgaacatatgtatgatgtcactgaagaagctgctgattcagaagaagaataaaatatctataaaaaagaaaactcaaagtatttttatactcagagttttcttttttataatattatgctaattcagcttttccagtataaagctgataatatcttccctttttagctaataattcatcatgatttcctctttcgattatttcgccttgttcaagaaccattattgcatcagcatttttaattgtagataatctatgagcaataacaaataccgttctgccttccataagcttatccataccttgagatataagtttttctgttcttgtatcaattgaacttgttgcttcatccattattaatactggtggattagcaacagctgctcttgcaattgcaagaagctgcctctgcccttgagataatccatctccatctcctgagagtatagtatcatatccatgtggaagatgctttataaatccatgggcattagcaagcttagatgcttgtataatgtcttcttttgttgcatttaaattaccatatcttatattttcctcaattgttccagtaaataaatgcgtatcttgaagtactatacctatagactttcttaaatcatctttttttatgtctgttatttttattccatcataagttatagttcctgaatttatttcatagaatctatttataagattagttattgtagttttaccagcaccagtagatccaacaaatgcaatcttctgccctgcctttgcatataatgatatattctttaatattgttttagattcattatatccaaacactacattttcaaatacaacatcacctttaagaggtactgatttctttgaaatctcattaatattccatacaaaatcattagatttatcatttactgttgatgacaaagtaacctttccttcatcaatttcatcttcttcatctaatgcattaaatatcctctctgcacctgcaagtgctgcaagtattacatttaactgttgtgaaacctgttgtactggctgtgttatctgacggacatattgcaaatatgcaactaatgaaccaacatcaaacaatcctcctattgtcataattccaccaacacaacatgtaattgcataatttatatgagaaagattcccaagtgctggcatcataaaaccagcaaaagtctgtgcccctgtagatgcatttctaagttcttcatttaaatctgtaaagtcatcaatagacttactttcatgacagaaaacctttataactttttgcccttctatcatttcttctacataaccatttaactttcccatatttttctgctgctcaccaaaataatgcttactctttacccctactagtttcattattaaaaacattatgcctaatgtacaaaatgtaataatacttagaactggacttaaaactatcatcattacaattacaccaataaatgtaagtcctgatgataaaatattagtaacactattattcaaagcttcattaatattatcaatatcattagtatataggctcattaagtctccatttgttttactatcaaaaaacttaacaggcagatgctgcattttattaaataattcatttctaatatccttaattgtattttgtgatatatagatcattatttttccatatgctaatgtagatagtgctcctgctgcataaattcctcctagaattatcaacatttttaataatcccgaaaaatttcctggaataatataatcattaacaataggttttaaaaagtatgaccctgtaatcatggcacatgaacttataattataaatatacatacagctgcaagcatgagcttatatttttttatatatccaaacaatctgcctaaagtcttcttaacattcttaggctttggtcctcttcttttcacgccattttttgaattattcaccgaaaccaactccttcctgttgagaattatacacatccttataaatttcacttgtgttcataagttcatcatgtgttccaattgctgaaattctaccgtcatccataacaataattttatctgcatcagaaactgaatttattctctgagcaattattatctttgttgtattctttaaatcttctttaaatgcttttcttatttttgaatcagttgctgtatctacagcacttgtactatcatctaaaataagcaccttaggtttctttagtattgctcttgcaatacataatctttgtttctgtcccccagatacatttactccaccttgtcctaagtccatatcatatcttcctggaagtctatctataaattcatcaacgcatgcaattttacaagctgcttctatttcttccattgatgcctcttcattaccccatcttagattatcaataatacttcccgaaaacagtgtatttttttgaagaaccatagcaacttcattacgtaaagtttctatattatagtcttttacattaactcctccaacaagaacttcacctttattgcaatcatatagtctaggtataagctgcacaagacttgtttttgcagaaccagttccacctataatacctatagtctcaccactttttatattaatagatatgttttcaagattaaattcttcactatcatcttcatatttaaagcttacatctttgaattcaatatcaccattcttaacttctaaaacattctctttaccatctgctatatcaggttcttcttctaaaacttcaataatacgcttagctgatgcaattgaacgagaaatcatcataagtgccatagctacaagcattaatgaaacaagtatctgagttgaatatgcaataaagcttgtaagcttaccaacagtcaaacttccttcatataccatatgaccaccaaaccataaaatcgcaataattgaactaaatattattatctgcattataggcattgaaataaccattaatccaaaagatttagatgctgtttcttttaactcctcattacctttttgaaatttttccttttctttttctgcccttacaaaagatttaacaacacgtactcctattaaattttcttgaacaagagtattcatgttgtctactctcttttgcattattccaaataaaggtccaacttttttaacaagaattcctatagaaactactagtataggtaaagttactgcaaatataactgctaattttccacttatattaattgataatataattgcaaatataagcattactggagctcttacaagaagcttaactcccatagtaactgaattttgcactgctgtaatatctgtagtaagacgtgttatcaacgatgctgtgctaaatttttctatatttctaaatgaatatgtttgaattttttcatattctgcttgtcttaaatttgcacccaatccctgtcctgcagtagctgcaaacttagataataatattccaaaagtaaatgatacaagtgccattgataccattataactcctagtttaactgtatatgacatattctgagatggtattgcttcatctacaatttttgccattacaagtggaataagcaactcaatcattgcttcaagagctgcacatactgctgcaaaccctaaaaattttttatattttcctgaataggaaaataacttctttatcatttgtttcacctctctaaactttaaaatatactacatgtgtctttatcatcgcaaacacatagcacactatatatatctataataaatacataatttgcacttattatgatagtttgttgaattattcccctaaattttttaatattctgtttagaagccttattaaaaaatcagcttcatcatctgaaaatcctttcaaaatctgtttttctttttcatttttcatataatctactgcaagctttgcaaattctctacctttgtcagttaatacatgacatttatatcttgcatcttcttttctacaatgcctatgtatcatttctttttgctcaagtctttttacaattcctgtaactgttggatttgtaagatttaagtgcttttcaatatctttttgaaatatattttcatctttctcatgaaagaataaatacacaagaacatttgcttgaactcccgtaagattatactgtaataaatccctattcgtttctttaaacatggcatgagcaatatgctgaatcataccacctacaacaggttcttctttatgtaagtccatcattatcatctccccttaacataaatacatagcatacaatgtattttaatttgtcttattatttttgtcaacaaatgtcgtttttttaacaaactttctttaatttatgtaatcgttgaattaaatttttaatcctgatttaatttatctaaaattttctactatctacctaaataattatcataaattttatttttcattcattaatttataatttaattctttagtattcacgttcattactctatatttgaaataattgtgcaaataatcacttaattttctattaatcaccatataaattttaaatcatataataaattgtaattttaaggaggaatttaaatggcagtatttctctcagctctgctatacagcctatcttctaatttagataatttggttataggaatagcatatggagttaaaaaaataaaaataggactaatctccaatcttataattgctactgtaacttctatagggactcttatatccatgtctgttggaaaattcatatcaggttttttacctacctcattaacaaacatgttaggtgcagtaatcataatgttgttaggtctgtattttttaatacaaagcatattaaaacttattcctaaatcttactctaatagccttgctttaaaaaatgtagatgaaataatggattatgcagaaaaatctgattcagataattctggaactttaaatattaaagaagcatttgttgtatctcttggtttaatgttaaacaatttgggaactggacttgcagctagcattacaggcgtcaatgtatctattacagtaatatgtacatttattttaagtattgctctacttatgttaggtaaatcaattggccataacgttttaggagctatatgcggtaaatatgctccactaatttcaggagttttactaatcatacttggtatttttgaattaataaattagtcagaaataaacagtttaacatcttcatgaagattctaaaatttaaggtgtcttaaatatgcataatacattatttaagacaccttaattttatctattatctactttttccggataaagatcatgattcatcattctatagttagccatttcttcaaatttagttccacgtttaccataattacagtatggatctatacttataccacctcttggagtaaatttcccccatacttctatatacttaggatccataatttttattaaatctttcattattatattcatgcaatcttcatgaaaatctccatgatttctaaagctgaataaatataactttaaagatttgctttcaaccatttttatacttggtatatagcttatatatatagttgcaaaatctggctgtcctgttattggacatagacttgtaaattcagggcagttaaacttaacaaaataatcattgtctggatgtttattttcaaatacctcaagcacctctggattataactataatcatattttgtaccttgatttccaagaagtgataaaccttctaattctttatcttttcgaccgctttgattcatgttttgtctcctcttatacaataattatttaacttttttattttttcgattttaacattgttttatatctaaagcacaccatttataccataaatatatgtcttataataaaccctctcaaaaaactgctcttttatatttatctttttttcttagattctaaataattgtctaatcctctttttctaaggatacaagctggacatttgccacatccatctccaattattccattatagcaagttaatgttttttctcttacgtattctaattttccgaaatcgtccgccatcttccatgtttctgctttatctatccacattaatggagtatgtactacaaattcataatccattgcaagattcatagttacattaagagattttacaaatacatccctacaatccggatatccactaaaatctgtttcacatacacctgtaacaatatgttttgcaccctttactttggctaaaacaccagcaaaagttaggaaaagcatatttcttccttctacaaatgttgaaggaggttcaccatttccccccattttaatttcaatatcatcccttgttaatgcatttggtgcaagctgattaagcaatcccatatctaaaatgtgatgctcaacaccaagttcctttgcaatactttttgcacattctatctcaagcttatgcttttgattataattaaaagttacagcaattacttcatcaaattgttcaagtgcccaaaacaaacaagttgtagaatcttgtcctcctgaaaatacgacaacagcctttttattcatatttttatgctcctattctataataattttttatttatatagaccatactatttactaagaaatttataagaataaaatttaataaaaaaactttttatttacagattattcccgcagaaaaacaggcataacaactgaaataaaaagtcaaaaaacaaaaggtctgttttattaaaaataataaaacagacctataattcaaactttataatatttttcaaaatacataaataatttcaattaaatagcctagttttatttaaggacaggatggtctaaatgaactgtccatattcaatttactttgtaataatatcatattcttacatattaatcaatataaaaagcattcactaatctataatttaataccatttacttttacatctgaagatttatataacaatttaaatattattgttttattaaaagaagtgcttcttgtcttaacatagaattctcttcaaaatcaccaataaaggtagttgttgtagtcaaagttcccggcttctttattcctcttgcagtcatacagctatgttcacctgttataacaacacctacgtcttttgtttctgtaatcattgatacaatttctgctatatctgctcctatgcgttcttgaagctgaagtctttttccaaccatatcagctattcttgctattttacttaatccaattatttttttatttggaatataaacaacatttaccttcatattatacattagagcaagatgatgttcacaatagctatgtataggtatatctctaacaataaccatattattatgtacttcctcaacacaactttcttcctcaaaagttgtgccaaacatggcagctatctcttcatttgtatgagtcatgccttcaaatacctcttcatacattttagctactctctttggtgtatctttaagcccttctctatctggattatctccaagagctattaaaatttctcttatgcattcctgaatcttttcagtatctatttttttcttcatatttatacccctattcttcttacaagcaattttatcttatgtcgtacaaaacatctggaaaggaaatatccacatatttaagtaatgataagctgattttctaaatattcaaaatagactcaactcataaaattaactccttaacactctgcttattccttattaaatcaattaaattgtaacacattaagtcaataatataaaccacttaatgaattgaaaattaatagttaaaagttgttatgttttttatcaaaatccatctattgtaatctttcatatctcaactaaactattagcttttaacagtttaacacctaaactcctcttgcatctttatcccatataattttatgaagctggacttgaagctttactttattcatattcttatctttcatgaactcaactatatcactcatttcaatgtttcctgttacaggacttaaataaaccttacatttgtttgctaaatcatatacatgaataatttcatatgctttttttaaatcatccatatttccaattacaaacttataaacatcatttttactaatcatatttatattattataattcatatgagaactcattttactgcttggaagtttaaaatcaacaatataacttatatttccccttgtatatttctttttaaaaggttcaatatcaatacttccatttgtttcaatatgtatatttaaattggaatcatcatcaagcagtcttaataattcatctatatttttctgaataagaggttctccaccagtcaaagttacattattaactttattactctttatataatcatatatctcttgtgcatttaatctctcattaatattttccttctgccatgaataaactgtatcgcaccatgaacatctcaaattacatccttgaaatcttataaaagttgcaagttctccactacttggcccctcaccatctacagataagaatttttcaattatattaaacatttttatcctccataatcaccatataataattaataatttttttattgattccatctatgcaacataattaactagtttaaatatttaatttaatactctatgatttttatgtttcatatatttattcactataaatacagctattattaggagtttcaaacaattccacttcacatacagaaagtcccatatctttaagtctattaaaaatatcacgtgacatttcttcagcagtaggtctataattaacaaaataaatatcaaaattgtttggaagttcttttaatttttctgataataatcttccttcatcattattttctataacaagtttatgatcaaatgtttcctcaatattcttcagtgcatttttaaaatttgaaaaatcatctaccatgcctctgcactgaccatactcatgtaatgtttcacttcctattttagcaataagcctatatctgtgcccgtgtatattagaacactttccattatacccactcaaataatgagccatatcaaattgaacttcactttttaacttaaacataaataatctcctcttaatatataaatttgtttaagctgccaatctaaaaataaatctttaaaaataaaagctgaaattaataaacttcagcttttaccttgcaatactacaattaaaatttacataaaaaacctgtttattatttttaccataataaacaggcctgtataatctaaaaattttattcaagatcaatagcctagttttatttaaggacaggatggtctaaatgaactgtccattattaaattactttgacatgatatcatatttgcttatttttttcaatcttaacaaaataatttataaataacacatctatttctacattaattaataaaaatgagtatccctaattgcattcattgtcacatattaattgctaattacaatatatgtcatagataatccattaaaatatattatttcttaatgaatattaatgtgttataattagcattaatgtgcaaattataaacatattaaggaggtctttttttggaaaacaaaacaggaattgtacataagtttgcttacagtttttttaactttaaagcatacaaggattttttatctcaaggattattgaaagctcttttctatttatttattgtatcaacaatattctcaactttaggaaatataagcactttaggtacacttaatgatgatgttacaagattagaaaataaatatgtaaaagaagcccctgaattcgaacttaaaaacggtgttctttctattgattcaaaagaacctgtaatttataaatatactggtgattcaccaatattaaacattcttattaaggatttcactttaggagatgtacttattgctgatacaaatgggacaactgatgtttcatctttagatgaatataacagtggtacatacataaattcaacatctatatattctaaaaaaaatggttccataattgcaagtattaacttttcagaaaatacttctatagctttaaataaggatatgctaacatcttatttttcactattaaaagtagcttttgcactttctcttttaatagttggccctatgcttgcatttataaataatttggctgcaatatttattattattggaccaatgactttaattttcagtaaaaattctaaagaaaatttgggatatcttaagtgttgcattataagtatatattctataacccttcctcttgttcttgaatcattagccacaataacaaatctttattcatctgaatttgtatttgtattttacattgttgcttttctttacagttctcttgctgtaaagaatttaggttcacacaaaaaaatagatactgtactttaattaatcttcagttaatattttatataaaaagcagcttttctcaaagaatcgctgcttttttaatttttacttcataataaactctagtaagttactttaataatattttataaatacatgttaattccatttacttttaggtattcatgttgtttttgataatctggaagaatactctctaccctgttccaaaagttctttgaatgatctctatgttcaaagtggcacatttcatgaacgactatatattcaataacatcttctcttgccatgctgcatctccagttaaaaagtattgcattttttccagtacagctagcccatcttcttttttgttctttaaccttaatatcactgactttatccacaaaataattttcatattttttgattttttcttttacaatttccatggttttttctctataccatttttccattgccactttcatttcttcttcattatttgtatttgtatatattataaaatgcaatttaggatatggactttttagggtttttccacctaaagaaattcttatacttttaaatgattcatcataaattatatgaattggatattcatttccaagatacataaatgtatttccatctttaaattctcttacaattttcccctcatacttttttatcatgtgatcttgtttttcaattatccaatcagcttttttccttacgaacaactctactgtttcactactcactcttaatggcgttattactgtaacttttccatctatgtctactttaatgcatgcagtctttctttttcttttaattatatcaaattctatgactctatctttatattcaatattcataaattcacctatattcttttaaactcttaatatacataaataatattataatatatatcccaactatattaaaagcaaaaaactatgactaatttaataatcatagttttcttattgaaaatatacttattatatttttcttcctagaataactgcacttttttctagtacattaatttcatttttgcagtctactttagttttaaatatctcagaactatctttatttattaaaagctgccattttccatctggaatatctagcttaacatctttttcagaactattataaacaacataaagttcattccataatccatcattgttattactattttttattgtaaatgtaactacattttccattttggtttctatgaatttaacatttttaacacaatcagctgtatttatatataaattttttatctttttcctaagttcaataagccctttataatattcaacaagttcatgatattcataagctcttctccagtctaacttattaaggtctgccgataaattatagctgttatcttctcccttttttgtacgtgcaaattcttctccagcttgtataaatatatttcccatacaagtgaaaactatagctgctgttaacttattaatatcaataagttctttatcctttatgcagtaatccttatttcccctcattgtttctattaatttatcatacaaagtaaaattatcatgtgctgaaacatatgaaattatttgtgatggtgatttaggattatattcttctgaattatcgcaataacatactacactgctttgaattttcttttcaagatcactggccccatttacaaacccaggaatttccccatagaatacatgacccttaatagcatctcttgtgtcatcacaaaatattcctactccttcatcaagatactgtatattttctttcaaggctggaacttctccattttccatatttgatgaagatgctctccatggttccccatacattaatatatttttaccgtctggaagtttatctagttcagatcttatttcatttataagatctacattatgaagtgccataagatcaaatctaaatccatcaatatgatattctttaacccaatgtagtatagacttcttaatatactgtccaaacatgtatctttcactggcagtatcatttccacatgcagaaccattacataatgttccatcatcattaattctataataataatatggcactgttttttggaaccatgaatctaatgaatatgtgtgattataaacaacatccataacaacacgtatacctgcattatgaagtgctaaaatcatttccttgaattcctttattcttaccataccatcatatggatctgtagcatatgatccttctggaacattataattcaaaggatcatatccccaattaaattgttcatcatctccactttcatctacagatccataatcaaaacatggcataagctgaacatggcttactccaagctcttttaaatagtcaattccagtcttgtgaattccatcattttttaatgttgtccctttttcagtaaatgcaagatatttccctctatgttcaggacttattccactattctcatcataagaaaagtcttttatatgaagctcataaattattgttgcatcataattcttaactccaaaaacatctttttcaaaccctttgggatttgtctcattcatatctacaatcatgcttcttttgccgttaacaccacatcctacggcatatatatccgctgtttcattggtttttccatctacttgaattttatagtcataatatactttatttaaatctcctataagttctttcttccatacccctttatcacatttctccatataaaagattcccaaatcctcagcatctttttcttcatcgctacctgttttgtataatcttaacactacactttcagctgttggagcccatattttaaatatagttttttcttttgtgtatgttattcccaaatcatccttatcataaagatatttttccttaaactcctctgaagagtagtattttttataatctaaaggtttcattttatatagctcctcctctattttctaaaagataataaacttttagtatttctgatacactccatgcttgtgcaaagcatccttttgaaattgttggattctttccatcatatatttccggaagctgaccaacgcaaccttctctcaatgatgcttcaataacttgaagctgtaactctacatttttaactgcatcttctgaatagtcatacaccctgagatatgctgcgtaatatgcacctagaggaaatacccatactgttccttgatggtatgccatatccctattaaactgctttcctccataaaatcctttaaattcgctatcttccatatctaatgttcttaatccgtatggagtatacagtttttcaaatatagtatctaaaacttttatttctttttctttatcaagcattgtatagttcattgaaagtgcccatatttgattgcatcttatttgtttatcattattattttcacacattgtttctacattatgtgataatgaaactatatcattaaggcaattattttcttcattccaaaacttaatattaaaactttcttttaccttttctgataaaactaaataatctttaggttcatttttagtaatagttgaaaattcatccataatcctaagtgcattgtaccaataagcatttatttcaactggctttccatgtcttggcgtaggaagtatgtcatttatccttacgtccatccaagttacttggtctaaaccttttcctgcacatataagtccatcatcatccataaaaatcccaaaatcggttccttttctataccataaaattatatcttctaaaactggatataattcttttataaactcaatatctgttgttatcttataatagtcatacaatgcatttataaataaaagtgatgcatccacagtgttataccatgctttttcacttccttctggaaaaagattaggcataagaccttttttacaatagtgtgtaaatgtcctaaaaatactttttgcattttcaaactgacctgtatatatgcagcaacctccaagagatatcatagtatctcttccccaatcaccaaaaaaaggatatcctgcaatgatagacttcccatctgtagaatcacgatttacaacaaacatatctgcacttttaacaagcatctttccaatttcacttttaatattacttttatcaataagattctttctataaataacagcatcatctattattttttcagcgcattcatttatttcttccatactataaataatataaaattccttattttccttagctgaaagattaaattctattttatgattatgtgctgcacaaccaatttcatctcttccatcacgctcatcatgtgaaaataatatatcatcttcatattcagtatcataatttacaatttctccattagtcttgtaatttaatttaatgttattacttataatagaattattatcaatattaaatgtttgacttttctttaaaatctctccctttggaacaaactccatataaggtgttacttcaaatttaactttatttttagtgcaatttcttacttcataaattacagcaatagtgttttctttttgcttaagtgctatttttttatttatctgaactccgtctgcatcatataaccactgtggtatgtcctcaaaggaaaatgaactttcatacaaatatccaattctattctttttagaatttacatattcttgagtcataagatcgtatacattaccatttgtgactaatttttctcccaaatttaaaatcatgttatatctattattcggtgcttttatacatgacataaaaaaagcatgatcattccttgcacttgatcctgttatagtaagagatgaaaatccacctagaccatttgtaagtagataacaattttccatacctctttccataatgctccaatcattttttccataaacaaacttcataatatattcccttctattttatacttatatcaaactacacaattcataatatttttcatcaatttaaaatgcacaaccaacaatatgcattttttaatatatgctgtgtaaatacatttttaattagtgaatttttccatataaagtcacactaatttttacactgtttactgttaattgtacatttagataatttctatttaatttttttcagtgtttttatttatttcatctcgaacttcatctgttatctttcttccgccttctttataccatctgtcaacaaaatcatcaaaataatctataggctcttcaccagttattattttaagatatgcctgcttttctaaatcttccagtttccaccataatttagacatagtctctgtttccttattataaaaataagttttaataattttcaccttagatctatcaagaagaccaccagcatccattcttgatgtatatgccgcccagtcttgtggcgtagcattttgaggatcattaagatatctcttaacctgctcataataagaatattctatgagctgaagactattactatccatttccccatttaacaccgaatttatgtttctataggattttataacagcatccttgtaatcaatattaattcctaaaggacgtgcagtaggatctacattatccctataatactgctttatttcttgcgctgaatcattattaccattgaaataatcaaatagtacactacttattttcattacaacctctggatgctcatacccctttcttactaccacatattttttattaggattttgtatacaaaaacttgtacttccatcttcatctgtaggtatcatatatggctcccagtctgcacttttatcattcttgatactatccataagtggattgttaggtgcccaccataagctaaagaaagagccacattttccattaatgatcatatcttgaatattactttgagtacgcactaaaaacttattatcaagaattcccttattatatagcttactcatataacccaatgcatttttagcattatttgttacagatccatacactatatttccattttcatctttaatccattgttttggatatgcattatattttgaaaaaataatatcagtctgaaacatataactgtatccattatcacttgtaacttctggagcacaagcaagtcctattgtattccctggtccatttccacctggatctttagttataaattcatctattattttttcaacatcatctaatgttttaggagcatcaagccctaatttatctatccaatcctttctaagccatatcatgttaggccctgaatcaatgctagtttcaggaagagccataagctttccattaaaagttgaactttcaaatattccctcaccatagcttttgtatatatcttttattctgtcacttgcacatttttcataaacatctgtaagatcttcaatcatatctttttcaacaagcaatttaagataatcataattgtctacaaacatgatatcaggaatattttcttctgatatagccatagcaaccatattattataattaatatcctgtgcttcaaaagaatctttattttgaacattaattttttcctttagatatctagtatatgcattattttcatatgtatctccgcctggcatatttgaattgtttgctccaattatctttcctaatgtgtatgttattgtttctggatattttccaaatggagttatgcacgcttcttcatattgattatctctatctgaattattattttgaacttcagaatattcaaagcatccaagtaagccctgacaaaaatatattactattagaagcattgttataacttttttcatgtttttcctcctaatttatacatcctcttctatttttatcataacctaaatagatacttcaaacaactttaaattaaccttttacagctcccgcattgccttccatgtaatatttctgtactgaacagaacaaaatagctattggtattgaaactagaactgctccagctgcaaatcttgtatagtaatttgttatattttctctagtaagcatattccataatcctactgaaactgtataatattgaggttcagatcctgctataacccttgcaaatatgaaatccatccatggtgccataaatgatgctactattgtttgtacaataattggttttgataatggtattataaccttagtgaaaacttgccatcttgtacatccatcaattattgctgcttcatcaatagcttttggtattgtatcaaagaaacctttagcaacatagaatgtcagtcctgcacctcctgagtatacaagaactaatgaaacaagttttaatgcaccagtagtaagtccaacaccttttaaaatataatatactgctatcattgccatgaatcctgggaacatcccaagtattaaggcaatattcataaatttctttctaagtttaaatcttaatctagacataacatatgatactgataatacataaaaagtagatattatacaactaaatatggcaactactaatgtatttccaaaccatagtggaaaattaaatgtatctgtctcagtaaacaaacgaatatagttgctgagagtatatgattgtggtaaaaatgttgatgtatatgctcctttttcagctctaaacgaaataagaacaacccatactataggaagcacccaaataactgctaaaatcgctaatactgtatgaacaataacatttgataatgatttttttattttcattattggaatccctcctcatttttataagaattagttcttttatatacaaataatgctgatactgctgaaattaagaatattattatagatattactgcacctaaattgtaatccttattttcaattgtaagcttaaataaccatgtaacaagaaggtctgtcttacctgctgacattttatagtaatcaagtgttgcaggaagtcctcctgtaaataagtaaattacattaaagttattaatatttccaataaatgcacttataagagatggtgctgtaacaaatagcatatatggtaatgttatatgaataaatcttacaactgagtttgctccatcaactttagcagcttcatataattcttcaggaatattttgaagtatacctgtcattgttagaagtgtaaatggaacaccaacccatatatttactattataactgcaactctagcccaagttacattagtcaagaaaggaagtgatgtacctggcgctattaaccctatgttccttaataatacattaactgcaccttcaggctgtaacattgtactcattactaataatgatacgaattgaggaactgcaactgataatacaaaactgaatctccaaaaagacttgaattttgttgctttacgattaattaccattgcaaggataatacctaaaatataatttgtaaaggtagcaaatactgcccatacaagagtccatcctaatacatgccagaaagttgtaccaagttctcctgaaaaactaagtaattccttgaaattcattaagccaacccatccgaataaatttccaggtggctgatgatctctatcataattagtaaatgccattgctgccatatatactaatggcataactgtaaatattattaatgacattactggaaagaacaataatgttttatgaagacattcatcaagatatgttgtcatttcttccttaaatgtaggaatatgttcatttttttcctttttaagctgacttttataagctgatttaatattagctctccatataattacaaatcccataattgcaaatatagttataacaccatataaaagtatcagcattgaattgtcaccctgaacatattcatacacctgagttttttcattaaatacttcacctgtcacatttgttcctaaagattttaacatataaagtgcattgcaaccgcttgcaatcatttcaaaaataaatacaagctcacttaataaaaataaagttcccttaacgaattcttttctagcaaaatttccagctcctaaaataaacatagaaagctttgtatatacatctccattttttatagcatttttaacagtatattctgtataaaattctatttttgaattttgctttttttctgccactatactccctccttttcattttaaggagtccattacagactccttaaatctttactattttttatttattgaatcgcccatttgttttgtagcatcagctgcattctctaaagttacatccccttgagtaattgtttttcctaaagcttcagctggtgaccagaaatcattcatctttttaaccattggttgagtcatagatgcttcattaatttctaatgtttgtgctgatgcaactggatctgcttttacttctggaagttctgttactgatttccatgttggagtatatcctcttactgtaaagtgaagcttttgagattcttctccacctaagtatgctgctaaagcaactgcttgttccatgttcttacatgttggattaacaccaacagctttgcttccagcaaatgatttcatttgtttttgttctccgtttaatgttatagttggaagcttagtaacaccaaagttatttcctaaatcttctttaatagctgctgcatcccagcttcctgatacgtaagctcctaatttaccttctttgaatttagataaagaagctccatttgcttcacagaagaatttaggactactatttaatttaactaaatattctgtaacttctggatgatctccaaaagtagttcctgcatcgttatctgtaccatcaggtccaaataattgtccgcctgctgcatagaagaatgctggtaaataccatgaattatttattgaacatgagaaattagtaactccatcacctaaatcttttgccatcatagtatcaagattttttacttcctcatcactaaacttgctcttatcataatataagaaataagtatttggtgtatatggaactccataaactccatcattgtaagttactgaacctaccattgaatcactgttgtttgccttaatatcatcaacaacttttccaccaagttttgcaacaccaccagcttcaactagcattggtatttggtcatttgcatacatataaacgtctgctgcttgatctaaatcttttaacgcttcttttgctgcatctccttctgacattacaccataatcaaattttaaatcccactctggatgtgcctctttaaattgatcacataaatatggaacaataccatttggatatttatctgaaggattttgatcctcttgtggtgcccatacttttaaagttattgttcctgaagatccgctatcccctccagaagccttactgcttgtctccttagctgctccacatccaagcatgcatgttgctgctattgatgcagttaaaagaattgataacatctttttcattttcataatgtttccccctatgatatatataatatttatgaaatcgtattcctgactacaatttaattttatattttcctcatcatatggtaaatataaaaaatcttagaaatatatcactttttaattttcttataaattttatattaattatggtaataatttgaattaaaacgtatacttaaaaagttcatattcataaaaaaacaaagactgattcattttataaaaataaatcagtcttttagatataaatttatttctgagctggaattctaactatcatagttgttccttctccaattttactattaatttttatttcatactctgagccatagtacaatttaattctttcatttacatttcttactccatatcccttggaattttcagtaagtattgtatcaactttatcctgttccataccaattccattatcacatacactcaatactacattaccattatccatatagccacttatagtaatttttcctcttccacttctttttaaatctataccatgatcaatagcgttttcaattaaaggctgaagaagaagatttaatattttatattccaatatttcatcgtcaatatttatttcggcatcaaattcataatcatgcatcataagctgaatatcaagataagacttcatgtttaaaatttcatcttttactaaaagaatattttttcctttatttagagctgtacgataaaatgaagataagcttaaagtaataccacttatgtctttttgatccgcttcgatagccatccaatttataagtgataaactattatataaaaagtgaggatttatctgagcttgaagtgccttcatttcataatccttttgtataattctgctcttatatacatcttctataagtgaattaatttgatttatcatttttccaaaaccacgcacaagagttccgacttcatcttcacttgtactctttacagttatcctcatatttccactttctatctgttccatattttctcgtaatttttcaagatcactcaccatatgtgctgccaaaactgatgatataacaaatgatattattacaacaagtccaattatcataattgatctataaagcattggcgtaatattattataaataagacttacaggcttatataaaactactgtccatgcttctgtctccgatttgcattctaccactgcatatttattcttaagtgtagagtttttctccttaagataagtatcatacgttatttccattaaattatttttcttatcgaaaacactatattcaaatatatctgttccattttgatcaattataaaaattccataattagaatccttcatatttctaaatggttcaaataactttttataatcaacatttatatataatgcaccaagagatgaatccgattgtagcgatggcatatttctaactgaaaaagcactttcttcttcttttgaaataagccaatgaatattactgttttcatttaaaagaccataccattcttcattttttatatcagttaatggagctattgtagtatcatgctggactatttcactgtttgcatatatagtaacttgatttatatcattatgaaaatactttaatgaggaaagcataggatcgagtatttttgtgtattgattatacatatcataataactatcatacttatgtcccaccacatccccaatagtctgattaaatgctatataatctgataaattatcatatattcgcaactgattgtccatatttgaaactgcttgaccaagataattttttatatttatattttccttatcaagtaaagtttttctagtatggttataccataataaccccataattgtaattggtattattgcaactataatatatgttgacattattttatgcctgaatttcatatttttgaaggtcttatatactttcattaatttattcaccttcatttctgaatttttgtggacttacaccaaaatattctctgaaactctgacaaaaataagatacatttctataacctacagcataactgacatttactatcttttcataagtagtttcaagcatttctttggcttttatcatcctatatgactttataaatttacttaaattctgacccgtttctttcttaaatatataacttaaataacttggtgcaaaacatacttgcgctgcaagaacttctactccaatatctttatcataattttcgtaaatatatttttttatggtttcaatctccttatgaacaagtaatggattatctgaaatagattcctcaaatctaactatatattcattaattattcttactacacttgcaaaatcagagctcttataaatcttattaatatcttctttaaaacctttttcactaacctcattaagattttcatataaatccttaagtacattagaaaaaataaacttcacatacatattagaaatatcattatcattctcatataaatcacataattttttaaaattatcttttaatgactcagtatcttttatgctcatatcctgttttattttttttaatataatatctgtgtcattcttagatgatataaccttttcattaacctcatcatctataaatatatgttcatcactattattataaaatcttttttctataagtaattcaatttttccataagcgcctagtatatcttctgctttttcaattttctttcctgctgatacaaaacattcactcatgcaattcattcttattgtattatatattgaataagcagcctctttaatatctctatattctaaacctatattatttataaacaacaatgattgcctctgatttaaattcaaatatttaaactgaatattagtattatcctttattattttttctatatcgtattcttttactccaaaaaagtcttctgcaaattctattaaaatcattcttctatattctttaataaatgataaatcaataacatcattaaatttaatttctagttctttaggtgatgtaccattaactaaggaataaagaatatgttctcttaaaaaactcatatttctaatatttttttcttccttaaccttttcgtcttttatttcttttagaattcttattatagtagatttaaattcatctggatctactggttttaaaatataatttataactcccattttagttgcaaatttagcatattcaaattcttcataaccactaaatattacaattttacactttatatcattatttttaacttcttttataagatccattccatccataaaaggcattttaatatctgtaaataaaatatcaatatcttgtgtctttaaatattccaatgcatccattccatttgctgcctcacagatatgaaaatcaactttaatttgttttaataaaaattttattcctcttctttcaattccttcatcatctacaatcaatattttaatcacagtaccccacatcccattcttatgtatcttctacataaactttattatattaattattatttactattatttaattcttttgacatgagaaccatgtcttcacttgaaataaatccattcctcctataaaatccttctgtacttttcccatgaagtgtaagtaaatatatattggttatatttctatttctaagctcattgataaattcatttagaagttttcttccataaccttttccttgcacatctgtacttatacaaaactctaatatttgaaaatgctctccatcataatattgttctgatcttcccattataattccaacaagtttttcttcttgataatatgacattccaaaataacctggtgtatttgcaatgtcagtaagccttctgctagctgtcaaataatcccacttatcattccatggaggattattgaaacattctataaataattctgtgacttcctttatattatttaaatttattgattttatcatatctatacatctcccatatacattctatataatgtttttaaattattttttacataaattgttaaaatttcattaactttgtttaattatataactaaaaataaaaatatcataataaattattttacatgaatattattgatttcttaatatatatttaaattaagggaatttaaaatactcttctataattaatataaaaaaggagctgattactttgggttctattttaaaaattaattctctaagcacaacttatgttgacagcggacattctaataataacttctatgaatgtaaaaatatatatgcaggaagcttccataaaacttcgtgttcttccgtaatgtttaaatcacttattcaatttgacttatacaaccttgaatcacgtccacttgaatatgcatatttatgcctttatgtaaaggatatcaactctgatacaagctattacagtaataacacattatctgtttacaaaaatctatcaaattatgaccctaaagtcgttacttggaatacaactcctgaaactgacaatgttattcaccttaatattgcatcaagtgaaatcggaaattacatgaaaataaatataacttcattcgtaaacagctggattaaaaatgatgataattatggaatcaccatagaatccggtaatttttattcttccttagtaaaatttgcttcctcatgttcggaaaaaccacctttactttttgtagaatataagaaccctaagtttgattacagtatatatgatgactacaaaacacacagcttacgctgataataaaatgcgcacataagtttgtaatagcaaggagaataacccactttcagcgggtttattctcttataatatatttattattagatcaaccttgaacatttatattatttaaaacaatgcatcttttggtctgcatcttgccattctacaatatatccacttccatgggaacaaaaaaccgaattagaagtatactcaatatcagcatttttattataatctcttcttttaattacttcatcactattatgacataaatcatatccatcataaacaaggtttactatacctttccctcttgtaaatgcagctatttccatagtataatccatgaatgttgaaacagggcccttaccaattattattacctttccttcattatttactggatcttcaaaagttccatgaagtctttgaatatctgttaaaactcttcctatatgttcttgaaaaacttctattgtaaatttataatatggttcaagtaaaatattttcaactttttcaaatccctgacgaatagccctgtatgttgcttctctaaaatcgcctccacatgtatgctttaaatgagatcttccatttaataatgtaatttttatatctgtaatactagagcctgtcaaaagtccatgatgttctctttcaaatatatggctttttataagtttttgaaagtttatactcaaatcatctacatgacagcatgtttcaaaagatattccactattcctttccattggttcaatctttataatcacttccgcataatgccttaaaggttcaaaatgtccacatccaattgtttctttttttattgtttctttatataaaatttcacatggaccaaattccacattaatattaaatctttctgatactatttctttaagaatttctagctgtattttccccattatgtgtacatgtaattctttaagactttcattccatataacattcagtgatggatcctcactttcaagtattttaaaatacccaagaacatcttttacattgtatgatttatcaaaaataactttcgacataagtgtaggcaccatttcacatgtatctttttctcttatttccccaattgtatcaaatgcagaagctttagaaagccctaaaacaccaaatatatctcccgatgttactttatcgcacgttctaaacttacttccattatatattcttatgctacttattttttgagttgttgcttcttcttcattcttcccataagtaacctcatctctcacatttaatgatccctttatgcattttaaaaaggttattcttgttccattatcatcatgtctaactttaaatacctttccaatgaaattttcattttcaacacaatcatatgttgtatatgttaattcatcaaatccaaaaaggaattccactattccttcatcctgaagagcacatcctccaaaacatgggaataccttacattcttttatcaatgttttaaattttctcttccatatttcttcacagtaatttccatcgaaatattgttcaagaagttcatcatcttgttcagttataaattctataagttcatcattaaaattcacatgtcccttactgtctgacataatgacatcaatttcaaatatattttctgccagttcctttttcatttctcctattactctttttttatccgcacctaccctatccagcttgtttataaagaaaaatgttggtatattgtattttcttaaaagattccaaactgtttttgtatgcccctgcacaccttctgctgcacttactaaaataactgcataatccattatcattatagatctttccatttcagttgaaaaatccacatgtcctggagtatctacaatataatatgttgaattattaaattcaaatacaccttgttctgagaatattgttattcctctttctctttcaatatcatgattatctaaaaatgtatccttgtggtcaactcttccacattttcttatactgtttgtatgatataatatatgctccgaaaatgtcgttttaccggcatcaacatgagcaagaattcctatagtcttcttcataaatgcgctacctcattaacaagttttatactaaattataggatgatatttttaataccatcccataatcgatcaaaacaagtataacataaattttatactgtatacacttcaataactcgtgtaagttcatttgcaatatcattttgttcgtttattgattttaatatattttcaacttcacatgcagcttcatccatactagattttatctcctgtgatttacctgctgtatcaagagatgttaaacttacagtattaattcctgatgcaatctgatttattatctctgtaattacgctgctcgtctttctaacttcatcagacatagaacttataagttgtgaatcttcaacataatttgttgctgtttcaattaaaagttcataatccttgtttacatcattttgaaggaaatctaatacagtttgactttcattactcaaattatcaaatgccgttttaacatcttttataactttttttatctgttcaacagtatctcttgtctgctcagccagatgtttaacttcctctgcaactactgcaaatccttttccattttcacctgctcttgctgcttctatagctgcatttaatgcaagcaaattagtttgttctgatatttctgcaattgaatctgccatgattcttacatcttcaactactttcccctgctcaattgcacactttacattttctattattttactataaacatcttttgcattttttactgcaaattctccttgtcccttaacgctcattgctttatcacgtatctcaaatgctgatgtactgtctttttcagcattattattaagctccttaactgtaagttctatttctcctgttgatgaatttacttcttctgatattgtacttaaattctctacttcatgtactattatactagtagcatcattaactctatctattctctcaacaattactttaacaacagtattcaaattattattagatgtaacaagtttttctgaatacttaaatatattttcgaccatttctctatttgcacttattgcatcatttaaattattaactacatgagcaatttccttatcatacttttcctcaagttttgctgtaagatcgccattttttaaagaatatgcaagtttattaagatcttttagtggtttaataattcctcttataatataaaacgataatataattgctataatagccccagtaattgatatccataaagaaatattagtacatttagatacaagactctgcacttctgtaattgattgtctcatactctgctttgtcattgcttgaactgctgcattatctattattgtctgcatatttaacaattgattcgttacaatatgcaacgatttgatgcaaacgcttgcaattgtacctaaaaaaatcaacataattatataacttgttacaattttgcccttaacactcataaatcccgttctatttttattctgttttttcatataactcccacctttaccttataatgtttacacttaattagataatattagtgaatatagtttattaatcgatttcataaattctacttttattataacttattatttcataattttccataattataattttttttattaaaaaagctgcttatcagtaagcagctttttaataaaatcaaattatatctatatataattttttaaaaccatatgtgaaacttatatttaaactatgataatacccaattaaactctatataaacggattgtaaaatctacttccagtttttatagaaataaatactgatactaaaagcaatattaataatatcccaatagacacataatcacttttcttaaaatctctctcactataccatgttctctttttcttatttccaaatgccctaagttccatagcactacttatagtctctattctttcaagacttgagaatataagaggcattaagatagctgttgagttttttattctttggctaagctttgctttctttgacatatctattcctcttgcttgctgagcaaatgatatatcactatattcatgctgaatatcaggaatatatcttaaagcaatagacactgaatatgcaattttataattaacacctattttattaagtgatgctgcaaattcacttggatctgttgctaccataaaaattaaagctattggtattattgaaaaatacttcaatgtaacattaaattggtaaaacagctgctctgctgtaagtgaatatggacctattatatgaaataaatctgttctgctattatatattttaacaccctcatatggcgaaaaaataaatattgctatattatttataatcaaaaatataagaataaaataaaaaacaaaagatatctgcttaaattttatttttgatattttaaatattatgaaactaaacataaccataaacaataatatatacgtattatatgtaagcatagaaacaagagaccataaaataagacatattaactttgttgcaccagttaatctatgtattggagaatctattgatttatattcaagcattgcttcattcattattctctaatcctcctatcctcttttataaatttttcaacaaaattcttaggatctttaatgccacattttaatgctaaggtatataacgatgtttctctaaggttagcctctcttataacttcctcatcagtaagaatatctgctgttgtatcatccttaagcatctttccattagataatacaattgctctatctgtatactcaagcattaaatgcatatcatgagtaatcattattattgttactcctctttcatttaattccttcaagaattccattatttcagtgtaatgcttaaaatcctgcccagctgtaggttcatcaagtattataacatcggggtttattgcaagtattgaggctatcgtaactctttttttctgtccaaaactcaatgctgaaattggccaattcctaaattcatataggccacaaatttttaatgtattcaatactattttattaatttcttcctcgctataatttcttattctaagaccaaaagcaacttcatcaaatatcattgtctgacatatcatctgattaggattttgcataaccatacctattttttctgcacgttcctttattgttgagtccttcatgtcctttccttcaaataatatgctaccttcagatggctgataaaatccacatataagttttgaaatagttgactttcccgcaccatttcttcctactatgcttaccatttcacctttattaattttaaaggatacattttttaatgtctgtctattactgttatactcaaatgatacattttttaattcgagtattgaattacctgtattatactcttcaggttcatcaatattatcataccactgttttatattttcactacatttttcataacacagcttttcaatactttcaggatttaaagtttcatctataatacatccagcatattttaatgcagttaaatataaaggttctcttattccgttttcttttaatatttctgaacttagtaatttacatggagataagtcgctcactatttctccatcattaactactattattctatctacatcacaatgaagtacttcttcaagtctatgctctattattataactgttttttgtgactcattttttattttttcaattaactctatagccatatttccagttgctgggtcaagacttgccagaggctcatcaaacaatagtatattggattcagctgcaataacacctcctaatgatactctctgtttctgccctcctgataatctatgtggagaagatgttaaataatcttcaatatttaccatcttagccgcatttattaccttttccttcattgttcttaattcaacacaatcattttctaatttaaaagcaatatcctcaccaactgtaagtccaataaactgcccatctggatcctgaagaacagttcctaccatattagataattcagctatactcaactcttttgtttctttatcatttatctttaggcttccagttatatctccttcatatttgaatggaacaagtccatttattgcatttgaaagtgtactttttccacttccagatggacctacaataagaaccttttccccctcatatatggttaaattaatattttttaaggttggtttactttgtgctttatatttaaaactaaaatccttaaattctattacaggttttttcatattccgcttccttttcatttatctaaataattatcaacttcaataacattatattttttacttttcgacacaattattttaattttaacatagtttaatgtatttcttcaatacaatctaattttttatttatttctgcaaaaaaaccatgtaaaagttgaatatatatcttcctttacacggttttcattaaattattcttcagccgtaagacttccttttttaactcttgttttagaatataagtataaaagtatagttccaagaactcctatagtaatcatattagaaattccagctacagcaccttgaatataaactttatttgcaggttcagcatatatgaaaatatctaaagtaggtgcaacaaaataccatgcaactatattagcaataatttgagttaaattaaacattataatttttctttttccaaaattaccttcatcaatttttattttcttccatgcaagtcctataaaaagtcctactactgctgatgcaattatccagctaaaccatggtgatccatatgctgtaagatcttttaatgtatgacctataaaccctattgacactcctgctactggcccataaattattgccattaaagctaaaaatgcgtaagctgtctgtatttctgtattaggaattcctgttggaatagctgcaaatcttcctaatatcatgaatacagcagatcctataccaatagcaactattgttttaatagttaattttccattattcattattattcctccattatatgtaaatatattatatttttatcttatgcttttttaattgattgttaatttaatgtactcatattaaattaacataacctaattcattataaatgatgaatttattataatcaaggttgcctagtaaattgtgtatataaaataacatcctttgctaaaattcatattatataattatcacaaaataaattatagtataaaacaaaagacattaaacaactttatagtcatttaatatcttttttagtctatgctatttttttctatgtcttatctttctatttttagataaataattatcaacttcttctccaacagactttgaaaaattaattcttcttcttacaccattaccttcataatataatgtatacctattcttttcttctgttatagaataagaactaattttatcccacgttgtaagataactgcttaaaagaattccattctctgtaattccacatttattacctacaaatgccactggaataataacaattacaaccataatatctgctggcttaatacttcttccagagaaaaatgtaactcctataaaaataatgatgattaatggaactaaataataattctggtttcgtccacaataaataagtttatgttttctttcttttaaaaataacattccgcttatacccaatattacaattagtccaattattgttaataaatccacttaccttccccctttatgctacaacgtatcttaaattttcatcaaacgattacagcaattttgtatgattctctatacgattataccatattttattatttatcaaaatctatactaaattttaatctatcataacctattattgtatctttaaaaacttcttttgcattgttctcatataaaacaggatctgacatagctgttccaaaatgagttaaaatcatatttttaacttttccctcacaagcaagctgtgctgcttctctaaaagtcatgtgtttatttttaactgctttttctatatcatcatcacttccatatgttccttcacatataaacaaatcactattatcaatgaagtctggaatttctatacttggccttgagtccgtaataaaactaatctttattccttttctctcttctcccataaccatatttctttcatatataactccgtcaacttcaacatattctgattttttctgaagtatattccataaatttttaggtacattgtttttcatagcactatctaaatcaaatttcggagttctttttatataaaaactatatccaagacatggtgctgaatgatctgcttcaaaaaaagaaacttttacttcctcgttcataatatcaatactctccttaggattttcaataatatctatttcatacggaagccattcaacaatagttcgtaaaccatttactgcttttgtaatcccttctggaccaataatagtaagtttttcacttcttccactattgcctatagttccaagaagacctggaagtccaacaatatgatctccatgtatatgacttatgcatattacatcaatagttttaaaaccagcattacacatacgcattgatacttgagttccttcaccacaatcaattaaaatcttacgtcctttatacattaataaagatgctgataaaaaccttcctggcattggcataccaccaccacatcctaataacaaaatatcaatcatattacctaacctcctttaagctcttataaaattatatctctcattccacattatgtaaaattctttcttcccatccattctctcttgtaaaaatcatttcattttcatttgataactcttcatcatactcatatccttcataattaaattttttaagttcatgaatttctgttatcttatttcttattataaatgttgccataagacctcttgctcttttagccttggttgttactactttatattctccatttttattctctttaaatgttggtgttataacagtaacatcatcatattttttaatacattcaatacttttaaaatattcatttgatgccagattaactaatattttatcatcatttataagttctttataaatattttcttgtatttcttctccccaataatcatataaatctttatatgttttaaatttaagttttgttcccatttccaatctataaaaatttataccgtcaaatggtcttaaaaccccatataaaccactaagtattctcaaatgatcattagcatagaataattcttcaattgaataactgcccgtatcaagacctctgtaagcttctcccttaaatgctccaattgatataaacgcattatctagacttttactccactgttcaatcctatctttgtttagggctgtaagttttggacttgttttcataagactagctaatgaatattcatcatatttttttaattcctttattaaaatttcagatttctctaaaaattgtggctctgtcattggaagattgctaaaattcttatttatttctaatgttttcgctggtgataatactattatcataatactcgctcctcaattatttttatcatttttaataaatattatatatttattaaaaatgattatcaacttaattttacacgcacatataaattactcataacaccattatttataaatgtcatttattataatttcattcatatataaaaaatgtattaattacaatataatttcttttatattataaatttttatatttaactttaattaactatatttattataagtatttaataactcacaggacatactatatatgtacctatttttacttctaacctttaaggagatgatatatccatgcaaaataacaacaaaagaaattactcaaaggaaaactttttacgtaacggaaataaatctcaaggacaatatgccaaaagcagctttaatacaagtattgaagaacctggcatcaatgaaagtggagtgattgctaagaaaaatggattttaattaatatcactctaaaaaattcttttctttagcaaaaagagatatacagcatattattttatttgctgtatatctcttctttattaaatatgttaattaaaaattcttattcttctaaaagttttagaatttcttccacagatttttttacttctttaggaagtttatctaattctctctgcctctgtacatcgttacttatctgtgctatttgtaaaaccttattttgaagtccgggaactttatttagctttccaactgcttcattaaatttattagcaaaattagggtcattctgtattttttgctgaaccttaactatcaattgatatggattcattatacttcctcctgaagaaccttttacttataatttattctattcatcatgaggctaaatgttcatataaaatttatttaaatataaaacactttacaaccaaggtaaatcttgattataaagtgtcttattttatatataagctactccaaatccctttaatttgctgcttaacttaatgaatctttcttcgtttactgttgctgttgcactgcgcattacacttactttaagtccaagttctactgcaccttttgctgtagcagaaactgcattacaagcatcacatcctactatcttaacttcatttatgtcattttcttttataaatcttcttagattattatttttaaaagcatttggtgtttgtttttcaaaataattttctgatactatttttattttttcattaatctttgccccttcacttcctgaaattccataacctataaattttttatttatatagctgcttggaagtacatgtgcaacatagataacttcacaattgccatcatcataacatgttatagcattattaatattgtcaatcagttcatcaatgtcattttcataatcaaactttttcttactccgctgctccccaataaaatcatcttgagcatcaataactaaaagtgcttttttcatttaccttccccattttctttacaaatattataagtatattaattatatgtataacatacctatttaattcgaaaaataatataataaattttattttacaattatatttaaaaataaatataatgccttgcttttattttatattagtttcattttttgtcaatgtgaaaattttttgatttttattcacatttcaatgaaaaaagtaaattatcaaagttatctctcaagatatattattttcttttagtttctagtactattctttttgtgataaatataattttaaaaccaagttatactcttaactgatagatttacttttagatattgatttattttaacttgaaattatttttataagtttatttcaagttctactggacaatgatcagaaccctcaattgatgtatgtatctttgcatcttcaagcttatcatttaatgattgtgatacaataaagtaatcaattctccatcctgcattattcgctcttgcattaaatctgtaggaccaccatgaatatacaccttcaatatctggataaaaatatctaaatgtatctgtaaaacctgaatttaaaagttctgacatcttgcttctttcttcatcactaaatcctgcattttttctattgctggatggattttttaaatctatttctttatgagcaacatttaagtctccacataaaattacaggcttatttttttcaagatccttgagataatttctaaatacatcttcccagctcattctatattctaatcgtgcaagtttctgttgtgagtttggagtgtacacattaacaagaaagaatttatcatattctaatgtaattactcttccctcattatcatgctcttctattcctaggcccatttttacacttataggtttttcttttgtaaatacagcagtacccgaatatccctttttctcagcataattccagtaatcataataaccttcaagttcaagatctatctgaccttcttgaagctttgtttcttgaacacagaagatatctgcatccatttcattaaaataatctaaaaatcctttttttacacaagctcttaatccatttacattccaagatattaattttttcaaagtcatcattctccttgctaaaatcatttgtaaaggttaattataaatatatctatttttaatatttctatatgcttctctaaaatcatccatagtcacaacagcatccgtactattttgttctggttcttctgcttttgtaaaagcactttcttgctctgtcattttagattcttctttttcttcactaatttcatcaaagacatcatctgatgattcgatatattcttcattatcttcacagtccgcagcaatttctttttcagcatttataactattaatttaggctgtatattatcttcagatttattatgatcttcctcatcagttgctaaacctgatatacattcattttctgcttttttctcttcatcatatacaactgattttattaatttttcttgtttttcattattctctttttcttttctttcaattgcatttattgctgccataaatattatgtccttaatatcagcacctgatacttttgtaaattcctgtgcaagcacttctgaattaacatcttctgcaagaggaagtttttctggcatatgaacatcaaatattgcttttcttcctttttcatctggtattttaaattcgacacttgcaagtattcttctcttaaatgcctcatcataattctctaaaagattcgtagtaaaaattacgactccagagaatttttctaattctaatagcataacacttctagttatatttacaccataatctgccgattggcttatattggtaagacgttttcctaaaaatgaatctgcttcttcaaaaactaaaacagcatcatcagttctagccttttcaaatgcttttttaatatttttaggtgtttgtcctacatattttgattcaagattagcataatttattgaataaattttcttattaagatactttgccacagcttcagctgccatactctttccagtaccaggagctccaaaaaaattaaatataactggtctgtttccattgtaactattcttaaatccccattgtctatatattatattttcatgctttttaatatttaaagtagttattatctgtttcttttctctatcttcaagataaacatcttccatactatatcttggctcataaacatccatgaattcatcattaaaaactgtttctttaagctcttctttatcttctttatttaataattcttcaattttactttcatcatttgcaataagaattctcttgctgcttggattatgccttgagctgttaatttcacacgccttattcacatcactaaacagcttgtctaccttttcttcatcaagaagtacatctttaccatcaacttttttatatttagcatcaagaattgttattcttgcattcttatactttcttgtaatactctttctagtaatgttctctttacctaaaccactaattccaaacatatttataccttccttaaatgtaataattatgatgccataagttttcttatatttatgaaactaattagtaacccttcttctccataactttggcaaactctaatttttttcgtataaaaattttataattttattataaaacactcatatataattattatgtcacatttatacaaacaggcgcaatactataaaataaattaaagaaaattgtaataaaaaattgtgcctaaattataatatctaagcacaatttttaataatttttattttatcttccttttcttcctgaagttttactcttatttgtctttttctttccaatataatttttgtttccagaattatctttagctttagcacttcctaattttgaattcttatctgaatttctgttattatttctactaatctttttagaattctttgattttccagatacaactttagatttatcatgtaagaaactattttggtttccatttccattgcatcttttcttatctcttattaaacactttggtccatctcctattaaatcagttcttcctgcctctacaagtgcttcataaacaagattgtaatatttaggatttctatattgaagaagagctctttgcattgctttttcgtgcttactctttggaacataaacttctttcattgtaattggatctattcctgtatagtatattgttgttgaaggtgttcctggcgtaggataaaaatcctggacctgttcaggatgataattaatgtcacgtaaatattctgcaagctctattgcacattctaacgtacttccaggatgagatgacattaagtatggtactatatattgtttttttcctattttcttagttatcttttcaaatttagatacaaatttatcataagtatctccgcttggtttacccatatactttaaaacttgagctgaaacatgttctggtgctactttaagctgcccactaacatgatgttctacaagttctttaaagaaggtatcgtccttatcagccattatataatcatatctaagaccagaacgtacaaaagcttttttaacccctggaacttttctaatacttctaagaagatccaaatattccgtgtgatctacatccatattgctacatacacttggagaaagacattccttacccttacatgcaccaaaagccaactgtctatcacatgcaggcttcctgaaattggctgttggacctccaacatcatgtatataacctttaaagtctggtaagtgagtaattccttcaatttcctttaagatagattccttacttctactttgaacaactcttccctgatgaagagtaatagcacagaacttacaatccccaaaacatcctctagaacttactgtactaaatttaacttcttcaattgctgctattcctccatgcttttcataaataggatgataatttttcatatatggaagatcataaactttgtcaagctcctctctgtttagtggaggctgtggtatattttgaaccatgtatatatttccatgtttttgaacaagtacttttcctcttacagaatcttgttcttgatactctatcctgctagattctgcatattttttcttgtcactaactacttctttataagaaggaatctctatataatcctgtacataatctaaattctctgctagataacacgttccccttacataatttatatctttagcttttacaccatttttaagtccttcagcaatttccactataggcttttcacccatcccataaattaaaagatctgcactactatctaaaagtattgattttctaactttattttcccagtaatcataatgagcaaatcttctaaggcttgcttcaacacctccaattacaatatctatattcttatatgcttctcttattttattacaataaacaatggtagcataatcaggtctaagtcccatttttccacctggagaatacatatccttttctcttctttttttacttacagtataatgatttaccatagaatccatgtttccaccattaactaaaaacgcatactttggacgtccaagtctttgaaagtcataaatattcttccaatcaggctgtggaataattcccactttatacccttgtgcttcaagaactcttgatataattgcagtaccaaagctatgatgatcaatgtatgcatcaccggttacaattataaaatcgcactggtcccagcctcgatctatcatatctctcttgcttattggtaaaaacttcttttcatttgtcatcttttcacctactctatgttaacttgaaaatatataattaactataatgttttatctaaattgtatcttaaataagatatcaatttttatattcttaatcttctatattttcaattataattttacaaattctttaaatactcatattagtgtatattgtttcactgatacagtcaagatatttaaaagttagttttttataaaattatgtgtcaagttatgttactttgaatattatatattatgcaattaaagtttaacttcttaagtattatattgaagggaagttaactcatattatgtgctaaattattatattgctttactcaataaataaatttgtaaattaaaggagaaatttttatggcaactttaaatacaactgcagccagtaccttaggtatactcattaacaacttaccttctaatggatatgaatccaatgctgatactgatattactgttactgttaacggacaagctaatgacctattaaaagaagctaactatttactatctactggtattccagctaacgttattgatggttcaatagatatctctattgcaaaatcaacattaaatcaaactgctcaatatatcggtgtaagacttgtttctgtacttgcaagtgatgctaatgcaagtaaatttaaatttgcagcagattctgcattttctactgatgctccaattgttatttcagcatcaacagcaccagtttcccttgcaaatactatttggtctgatagtacaatagcttatgctgcttctggtaatctagatatttctgtagatgttagctatattgcatctaataatacacctggtgacaatgtaacttatatagttgaattttatgaaactgataatactagtactggtacacctgttttaataggatctgtaagtcagacaactgatacttcagctgctctttctataacatcttactctgcacaagtaacttctgttatgactgcatacgatccaactaatttaacaactgcaaaaacatcttattacagaaatgatgctatagcacttcagacagctcttacaacaaatacagcagattattataaacacgtttcaacaatttctgttgaattagatataccaaatgctatttcaatagcatctggcttcctttatgtaactacactaacagcacctgctaatgtagcagctctagatacagatgctgcaagtggtactggaactgttaaaatagaccttagcaatactactggtcaaggtgttactattgttggtaatacaataactttagctatgcctacaggaactgtttatgataaggtatttactgcaacaggaagtactggaactttaaaaacacctgtatctgtttatgttactggaaatttaagtggaatctaatctactaatattgttttaaaatctatatactaaaattaattaacttttaaggaaacctttaaggtttccttattctcactcatcactttttttacatattataggaataagttcccttacatatgcatttactttaaaattaactataagatccataaatgcatttcctaatatttcattaggtgtatctactttgtaataagattgaattttcatactatctatatttaaacaactatcaactgtctgagaaataaataaatttttaatatttattaaagctttatcatattctttatcttcaactaaattattgttataatttaatgaaaaatccataattctatttatatttatatagccaaaatgtggtgatgggttcgttataatatcaaccggcttagatgttgttccactttctccttcaactaaacttccatcactttcaattccgaatccaccgctacctattatacctgcatttaaaattgttgattcagacatatttaaatttactgctcctgttccactaatcgatgatccattactaccaccactacctggctcattagcaccatttgtgttttttagtgtatctaggtcaagattattattatctaaataagctttaggacttccaccttgtcctccctctccagatgctaatattgatccatcaatctgtacatttgctgaattacttcctaaaaaaagtgaatgtcctccacgccctcctttagaagatataattcttattgacgacgtatcaaaatcaacatatacgccacttgttcctccattgcctccagataatacagcttcattactagataaaaaagtattccttgctgtagtagttccaataaattttacagctgatcctccatctccacctactatagggagatttccatgtgattcaactgttgttccatctccacctcttaattgcacactacctaaaagatcaacagtaccgcttggaagtataactgcactacctccatttcctcctatcctcaaatcagtcatagctccagaattacttgaatcaattattagtccaccatttcctccaaatacagttaagctcgttgaaatatccggacatctttcaactataagaattcctgattctccaagacttattcccggtccaccatttcctacagtcatactattaggattgctcacatcacattcctgaccatttcctccaaatacattaactatggcattgcattttattaaaacagatgaatttccagatgtactttctacaaagcctactccagcaccaccatccattgcaacattataagcaggttgatctattgcatctcctccatgtgcacttacagttccttgacctgaaaaaacaatttgacctccagaattaaatacattactatttcctacagcacaattccctgccctccatgaacatttagtatacttcctttttcttctcctattacttctaaagattgtccattcattactagaatgccaatactgttgctacttttgattgtgttttcaagagaaaaacgtatcctatttatatatgaattatttttagaatctcccctaagatcaatgcctatattattcccagagttaataaatgcattagaaagatatatttcaatatcttttgttcttccagcagctactacaatactaaaattatattgctctgttggatctatagataaaaatgaaattttttctagcaatactggcagaataatcaatgctgtagttcctaaaatatttgtataatcagataaattgatctctacactataatcaccattatctactgaacttgtaattacattattaattgcacttaagtcagccattatcatatcccctcctttcttaaaatataaactttataatatttaacctataagtcttaaaattattccattgataaaatctatcaacaattgaacatacatataatcataactcatcaaacaattgatccactatatgtgtatgttcctataaaaggttcatctccaattgttccctgaacagttattacaagattttttatttcaaacttaatatttgtttcacaaaattttattttattataatattcacagcaattcatatttgcatgtcctaaatactctgtatatatcttgtatccatttaaactatcattaactatcatcccatcttttccataaaggttaatatcttcacatccgatttttcccttgataggattattatttattcctatataatcatagctataccacatatcacttatacagatttcccctttatctacataaattatacctaaatccgaaagatcaaatctcatattttcaactacacttgactctgatatggtaaaatccagagaatctaataatctattaagcattacaggccttaacatctcatttgttaaatcttcatgaataacttttttattatcaaaaaccaatgttgcatcactccttgctatacttttctaacatatattatgaatattctagtgcattgtgtgtgtatatttttcaccttttaatatgttttacatattatatactataatcaatttataaggagtgtaagatgagtacagaagagattttatacaaatatggttattcatataaaataaactatagctattcaacagttccaactgtccctggaactccaatcaatattgaaataattccttctccgaatatttcattcattctatcacctgctgaaatatacaatactaaatggcaggatcaaattaaatttaatgtctttataaaaaatgaatcatcctcaataattgaagattttaatataaacctaactacaagtggtaatttaacatatgtaagcggtacgcttatgaacagtagtactggaatatattacccttgcacaaacttagaatctaattattgtatcactgaatcaattgcacctaattcaattcttaatcttaattactatttgatgccgctacctgacagtaatacagaatcatttattaacaatcctctttctgcatataatacaacaaaaactccatctttacagaatacaaattattcatacatttatttatctcagcagaagctggttatagataaatctcctgatggcatgtttgtatatatagaaaatagaggtactattaactctttaacttttacttataaatatatgccacctcaatattctaagtattttaatgcatatttatcaggaataccctttataaatataacagtgtctaaattaggatcatactatttatttaaaattggaccacttcctgtaagcacacctaataaccgtaaaattcttgtaattcttttttcttagcctattgattaaaattattttactaattaataaagcttattcataaaaagattattatacttttatgaataagcttatgattatttttttacttttacctatatatacaaaatatttttctttacaatcataattttaaacacaaaaaaactgaatactatataagtacccagtttcatctttaatattattaatttttaaatgaatgtattggtgctggaattcttccgcctctgtttgcaaataactccgaagatttcccattaaccttcataactggagctcttccaagaagccctccaaattcaaccatatcaccaatgttacatcctggtgctggaattattcttactgctgttgttttattattaattactccaattgcagcttcatcagcaatcatacctgaaattgttgatgctggagtatctcctggaattgcaatcatgtcaagtccaactgaacatacacatgtcattccttctaatttttctaaatttaatgaaccactaattacagcatctatcattcctgcatcttctgatactggaatgaaagctccacttaatcctccaacatgactacatgccattactccgccttttttaacagcatcatttagcattgcaagagctgctatagttccgtgtgttccaacttgttctaatccaatttcttctaatatttctgcaactgaatctccaactgctggtgttggtgcaagagataagtcaactataccaaatggtacatctaatcttcttgatgcttcttttgcaactaattcacccattcttgtaactttaaatgcagtttgtttaattgtttccgcaacagtatcaaatgactctcctcgtaccttttcaagagctctcttaacaactccaggtccacttactcctacatttataattctttcagcttcaccaactccatggaatgctccagccataaatggattatcttctactgcatttgcaaatataaccaacttagcacacccaaatccatgggtatctttagttaattcagcagtttgctttacaatatgtcctaaatcccttacagcattcatgttaataccagatttagtacatccaacatttactgatgcacaaaccttttttgttattgccaatgcttctggaatagaatttattaaaattctatctcctttagtgcaacctttatgtactaatgctgaaaaacctcctaagaagtctattcctaatgtttctgctgctctatctaatgtttgtgcaaatttaacataacttgtttcatccgttgctccacaaatcatagacattggtgtaacagaaactcttttattaactattggaataccaaattcagattctatttgtctcccaacttcaaccaatttttctgcacttcttgttattttatcatatattttaattcttgctttatctccatctggatctatacagtcaagtaaagaaattcccattgttatagttctaacatcaagtttttcttcttcaatcatctttattgtctcaagtatattattagtattcatattgcccctcctgattatagtgaatgcattgacttgaaaatttcttctctttgaatctttatatcaactccaagttttttaccctcttctgttaatgccgatctcacttcatcaaaatttcctttcatgtttgtgcagtctaacatcatcatcattgtaaaaaaatcctgcattatagtctggttaacatctaaaatattaatattaaattctaacattttagcacttacacgcgctataatccccactttatcctgcccaattactgttaatattgctttcatgcttatctactccattcatgtttatatttatataaaatgtacagtttaagtttacttaaatctgaacaaatctttatcaacaaacatcaagttataatatctagataaattccaaaaaaaacgaaataatatgtcaaataaattggccataatcatcatgttattttaaagaaataatatcattataacttatatctacattatttttttaaaattcaatgtagatattatatttataatataatttatattatattttgtcaatttttaatacaactcccaatataaatcatttaattaaaatacattctatataacttttatttaaagattgataaatgtatattttgtaatatttctccatacattttatatataatttcatctttactgctaatctcttcaaaaccatatatcattgtaagatcattttctgcatacaactcgttaaactcatggcatattttctctataatactaactgaattatttttattgtaatttataaaaaacaaaataatactactactttttgataaacatgctatattatttttaagcttattctttataactatatcggctgctttaaaaatagctttctttttttcttcttcttccattaagcacgataatccttttatataaaaaacagctattgttgttggtataaatttttctttattaatttttcctaatatattttctaaaaatacactattatatagcccactaatattgtctttgcaattatataattcaaattcccaattatctatattttctttttcaataattgaattcatgtttttaattttagtagattcatgattctcctttaacatatatctaactttgtcacttaatattatacatacaattaagcctactaataaatacaaaatcatacttttatgtttaatggcctcatataaaattaaagtaatagtcattatacacaataaaagattgagcatagtgacacttcttaatatatccacaatttgtcctttgtttaatttattcctatctcttctttttatcacgttaattcctcatcttaaaattcagattttttagttacttgcctttaaaataccttctcccttaattattccaaaatatataatttaatgtaattttttaattaatattattatatcataaatatatttataggcattaaaataaagcgaagaatactccgccttatatattaaaattaatttgctgctgttttttcaaactgagaattatataaattagtataaaatccattcatagccatgagctcttcatgattaccctgctcaataatatctccatcctttaaaacaagaattatatctgcattttttattgttgaaagtctatgtgctattataaaacttgttcttccttccataagtgtatccatggctttttgaattttcaattctgttcttgtatctactgaacttgttgcttcatcaagtatcaatattttaggatctttaagtattgcacgtgcaattgttaaaagctgcttttgtccctgagatacattgcttacttcttcatttaaaatcatatcgtagccttcatgaaatgtacttataaattcatctgcttctgcactttcagctgcattatgtacttcttcatcagatgcatcaagatttccatatcttatattttcctttattgatccattaaatagccatgtttcttgaagcaccattccaaaaagtttcctaagatctcttctattaaaattgtatatacttttcccatcaataagtatatcaccattatttatatcataaaatctcataagtatctttataattgtactcttaccagctccagtaggtcctacaatagccacttttttaccttcatttactttaagactaaaattattgattattgttttatctggataatatccaaatttaacatttctaaattctacgtttccttcaatattttcaatactttctggattatctgcaaattgaacctcttcttcttcttctaagaattcaaaaaccctttcagaagatgctgctatagactgaagcatatttgatatttgagcaatctgagcaagtggctgagtaaaacttcttgtatattggataaatgactgtatatctccaacacttattttattttgtattgcaaaaaaacctccgagaattgcaactgcaacataaccaatattacttataaacatcattataggctgcataagaccagataaaaattgtgatttccatgcacttttataaagtgtttcattgtcagtattgaatctatttattgcatcctcctctccattaaatacttttacaatattatgcccaccataaacttcttcaacctgcccatttacatgacccaaataatcctgctgttccttaaaatatttttgtgatttttttgctataaaagttataaatataagggatattggaactatcaatactatggtacaagtcattatcacatttattgtgcacatcataaatacaattccaattattgttgttattgatgttattatctgagtcatactctgattaagactctgatttaatgtatctatatcatttgttattctcgataaaacttcaccatgtgttctcctatcgaaatagttcataggcattctatctattttttctatcatttcttttcttaatctatatgtaagcttttgagaaactcctgtcattataaatccctgaataaatgaaaatactgcacttattaaatatatgactagtaatgtaattaagattctacttattttagtaaaatctattccacttccaccagaaagtttgctcattattccattaaatatttctgtagtagcattacctaaaattttaggacctattattgaaaatgcagtacttcctattgcaaagaatataaccaaaataactgaaaatttatatttaaataaataattaaagagctttttcatgcttcccttaaaattctttgcctttacttttcctccacccatacctctcatttgtcccatgccgcccatggtaggtctcatttttctatcttcattactcatttgcaagctcctcctttgaaagttgtgaaaatgcaatctgtctatatgtatcacaattttccataagatccttatgagttccacgtcctacaattttacctttatctaaaacaagtatttcatatgcatcaagcacagtgcttattctttgagcaactaatatctttgttgtattttttgtttcctctcttagtgctctccttagtgccacatcagttttataatcaagagcagaaaaactatcatcaaatacaagtatttcaggattctttataacagctcttgctatagatattctctgcttttgtcctcctgatacatttgttcctccctgagaaatttctgtatcatatgcttcatccttactttcaataaactgagatgcttgcgcaattttagcagcccttttcatttcactatcttttgcatttttcttaccatattttatatttgactttatggttcctgaaaacaatactcccttttgtggcacaaatcctattttttctcttagttcatgctgagtcaaatttcttacatcaacaccatcaataagtatctttcctgatgtaacatcaaaaaatcgtggaagaaggtttacaagtgttgacttaccacttcctgtactccctattatcgctgttacttttcctggctttgccgtaaatgatatatcacttaaaacttcttcaccatcaggatacttaaagtacacattctgatattctacatacccctttttgctgacatttatgttttgggatgaacttggatcaattattgtaagttctgttttcagtacttcttctatacgctttgctgaaacaagtgctcttgggagtatcattgaaaccattgaaatcattaaaaatgacattactatctgcattgtgtattgtataaacgccataagatccccgacctgcatattaccatcattaatctgtcctgcaccaatccatacgataagaactgaaattgcgttcattattaacatcattgatggcatcatacatgtcataattctgcttacaaaaagatttgttttagtaagatctttattagcatcatcaaatctgttttcttcatgtttttctgtagtaaaggctcttattactggaagtcctgtaagaatttctctagctatctgattcaccttatctataagtgtttgtattcttttaaatctaggcatagccaaaccaaataaaatgcttattactattagtattgttcctactgcaacagctattatccatgtcatagatttattggttcctaatacttttattattcctccacatcccagtattggagcataaaaaatcattcttaacatcataacgacaaaggtctggatctgtacaatatcatttgttgttcttgttataagcgatgcagttgaaaatttatcaaattcaacatttgaaaaacttaatactttttcaaatacgtctttcctcaatatttttgcaagacttgctgcaacccttgatgcaaaaaaagaaactaacactatagatattccacctataagtgcaagacctatcatttttattcctgaattaaatatgtagttaatctgttctttgtctgtatctatcccaaccgccttatattcatttttcacatatgaaattccagcttgggataataatgtttgtggcatattattaaagttgccatttattttttcaactatgttattacgcacatcttttggaagtataccaagaagttgaaatacattcatattatctccaaccataccttctggcatgttttctacaataactttttcaagtccttcagacatttctctattattttcaatattttctacaatagttattggttttgtaaaaatttcgtcaagcctttcctgactttctctatcatttattaaattttccttatataatggagtattttttaattcaggataaacctttaaatatttttcataatctatttcaggtaaattctcctttacaataagtgtatagttatcatcaacataatttttatcttcatcatccataaaaagtattaatttgtttaattcactttctcttatgacttttggtgcaatttcttttatgccattttgctgaattcctatatctacaatatcagatgtatattgtggaagggctaaatcagtaagtgcttgtataataagcagtactataatgagtaaaattatgccagtaaatctttttaaatatttaattattgtagccactctcattcaatcctttcttaaagaacatatctttatagataaattttattaatatatatttttagtttttctttaaacacttaagtcaattcaagattttactggtttatattgaattttattcaatttattgaaatatatccaatgggctatttgaataagttttaaatatattacacaaattaaaatgtattattctatataatccataaaaaacatgtacttgtacgggagggtggtattttggaatcagattatgaaatattagagttattaaataaattatccgctgaaatatgcagtaaatttgatggaattcattttgaaataaattccatgaaatctacaatatctaccctcaataaaagaattgaaaataataatctgattattgataaaatagataaaactcttgataacttatataaaaactccaatttgtcatttgataataatgataacccagatgttaacgaaaatataaattcattaaagaatattatttcaaacaattcagaacttttaaatgatatgaatgaagattcttcaaaaaaacttcttctcatatctaaagacttaaaatttataacacataaagttcttcaaagtgaaaaagatctcttcaatcttcaagaagaaatcaaaaatacttataaataaaattgagcttcaaatataaaaaaactgtacaaaattcaaatataatctattccaattctgtacagtttacttactattacttctttatgttatttataatataattaatgttattccaattaaatgtataatctatacatattctatttaacatgctaaaattatcatctctatcagcgtatccatgctcaatagtaaatcccattttatatcctgcattttctactgcactcttagtatcatcattatacattccttcaggatatgctgctgcaataactgatttacctgttatttcttctatttctttctttgattttgatagttcctctaattgttcattataagacatttcactaagccttttatgtgaaactgtatgtgattctatatcaattccataatcgctcatttccttaatctgctgcgaggtcatactagtttcaccatttattaagcttgatactacaaaaattgtagcattcatattaagttcttttaatataggaaatgcatttgtatagttgtccttatatccatcatcaaatgttattaaaatacttttcactggaatcggtttatcatttacaaggtaatcttcaagttctgatatagtaagcgctgtatatccattatctttcaacgccttcatatgttccttaaatttttgtggagatactataagtggactttttccactttcatcgtacccaattgaatgataacacaatactggaacacctttattctcattagtaatatcaaccttttcaaatttatccacatccgttttcagattctctactggagaatttgatatattctctgaatttattttatcctcaaatttttcagtttcataattatattcattacttgcttcatattgattgctatccacttttatagatgctttatgattataaatatttactcctatccctattaatataacaagcactaaacttcttactagtttttttctcctacgattttttttcaaacgctttgacaaagtattcttgcacttctttttattatccatatcttctcctaaacaaaattacaaatcatattatttttccactcaataaaacagtgagcataaatagcatctatactcaccatgtattattcttctatttgatttttctgtcacttatctttactgtttctaagtgttctggtgacaatcttggatgatgtttagattttgaatagtcattagaaaaatataccctaagactttcactactgttttctgcatcaaccatgtacataacattttgaacatatccatggatgaagtcatctttgctaaacaaaaggtgtatttcagtcccaactttagtaatgacattcaaaacatcagttaaatctttagaatcttttgtaaatacaacatctccactgtctaaaaggcaaaattcaaccttcatagctttcatccctttcttctatgcttacaccattattatactgaatttattttataaattcaaacgtctcttaaagtgaatctctatactagtttgcatctttataatatattttgtaatatttatttaattcattaagaatagtaataatagcatttaatgctatactctttaggttaatatataattcttgtttttatatcttgcataatttatatattttatacatctaaaacatataaattataagaaaaaattaaaaatgcagataccatacattagtatctgcattttattaaatatttagctataataaatattaaaccttactacactaatctcttaatgtagctccaagtttatattctaaagatcttaaaattttatcatgtactttatttacatctttatcttgtagagttttattttcatctctataagcaattgcataagctatgctcttcttaccttctggtatttgttttcctttatagatatcaaataattgaactttttctactatatttccaccagcttttcttatacagtcttcgatctcttgaactaaaacagcatcatctacaagtaaagctatatctcttgttactgctgggaatttaggtaatgctttatactttctatccatgtcagcagcttcatataatacatctaaattaagttctgcaacatagcatgattcatctattccatagttttcagtaacatctaagtgaacttcacctaaagtacctgctatattcttgcctataacaagtttagcagtcttacctggatggtaacttacattttcactttctctttcatatttggcattctttattccaagaccttcaactatattttcaactgcacccttaaggtctaagtaatcacaatctccatacatacctatagttaaaatatttctttcaattggaagcttattttcatcttcattcttgatgtaaactttacccatttcaaataatcttgcatatgagttatttcttgagtagtttcttcctaaacattccatcattgatggtaaagtcgaagttctcattacactataatcttcacctaatggatttttaatttttactacatttcttaattcactatcttctggtacacatattttatcaaatacctttggagatacaaacgaataacttatagattgatttaatccacttccagtagcaagcattaccattttatcatctaataatctctttctgtattttggttctctagaagtagaaactgagaatattgtagcaggaataacatcatatccatgaattctagcaatttcttcggcaatatcttctcttattgcgatatcaattctaaaagttgaagctgttacaactaaattatctccatctatttctgtaaataaatcaacactatctaagcatctcttcatttcttcttttgaaaggtcagttcctaagaatttgttaatccaatttgcatcaactactactttcccagcttccttctttttgttgtatacatcaatagttccatctactacttcaccagcacctaattcacagattaatgcacatgctctatctatagcaagttctgctaagtttggatctatatctttttcaaatctacttgaagcttcgcttcttaagtttaatttcttagaatttactcttatattagttccatcaaaatttgcagattcaaatataacttctttagtatcttcttttatttcagaatttaatccacccataattccagcaagacctactattgtatcgctgtctttaatgcataacatagaatcatctagaattctttcagcttcatctaatgttgtgaatttttcatcagcttttgctctttcaactactattttattagtagttatttctcttgcatcataagcgtgcattggctgacctaattcaagcatgacaaaatttgttatgtctactatattatcgataggtcttataccagcttcaagaagtctttcctgcatccaacctggtgatgattgaactttaacattcttaacttttcttgccatatatcttaagcataagtcatctttaacttctactttcaattcatcatttacatttccttcacctattgttttatattctaagttcggcatcttataagatgttctaagtgcagctgcagtttctcttgccataccaacaatacttaagcaatctggtctgtttgaagttatttcaaagtctaatatggctttatttaatttcaatacctctttaatatctgcacctaatggtgtatcttgaggcatgatcattaaaccatgaactggttcatctccagcaattccaagttcttcttcagagcagaacataccattagatacttctcctcttaatttaccttttttaattttagttccatcagctaaagtagacccatgaagggcaactggaacaatatcctgttctttcatgttatttgctgctgtaactatttgaatactttcagttccaatatcaacttgacaaatactaagcttttcagcatctggatgctttactatttgagttatttttcctgttactactttatctattgtatcaccttgaactattaattcttcaagctgtgatccagttaaagttaatttatctcctaattctttaggacttacatttatttcaacataatcttgtaaccaattaaatggtaccttcatattattctcctcctcagagtcaattgacaaagaataattgacaattgacaattaaatgttgaaattcctctggaatttctttattttttacttctataattcttcatattataataataaaatattaatatttttctcaatcaattcctatattttctcagataaacttaatttttaaaaaataatcacttaatattataatttttaaaaatcagtcataattcttatccataattgttaatcgtcaattgattaaaattggtttaagaatctcatatcactttcatataacaatcttatatcatcaataccatacttaagcataaccattctatctacaccaaatccaaatgcaaatccactatatacttcaggatctattccacagtttcttaatacgtttggatgaaccataccacatcctaaaagttctatccatccactatttttacatactctacatccttctccaccacatacgaaacaagttgcatccatttctgctgatggttctgtaaatgggaagtgatgtggtctgaatttagtttgaaccttatctccaaacatctttttagcaaatagttctaaagttccttttaaatctgcaaaagtaactcctttgtctataacaagaccttccatttgataaaatataggtgaatgtgtagcatcaactgaatctgatctataaaccttacctggtgatatcatcttaattggaggcttttgattttccatagttctaacttgaactggtgaagtttgagttctaagaacgatattatcatttatatataatgtgtcctgctcacttcttgctggatgattcttaggaatatttaatgcttcaaaattataatgatcatattcaacttctggaccttcttctattgtaaatcccattgaaacaaatatatcttccatagtctgaagtgttaattctaaaggatgtctctttcctataacttttttcttccctggaagtgatatgtctatagtttcacttgcaagtcttgctgccttttctttattttttatagctttcattgcagcttctaatttttcctcaactgctgctttagcttcattaaccattttacctactaaaggtctttcctctggggatactgatcccatccctcttaatattgtagtaagttctccttttttacctaaaaactttactctcacttcttctaattgtgaactatttgttgcaacatcaatttgttgtaaagcaagttcttgtaattctttaagtttttctttcatgatttttctcctttcaataacttatgccgtttatttagttaacagttaacaagtaacagttatcagtaattttaaatttaaaaacctattctgctataattaactatcaacttatacttttagacataaaaaaatcgtcccccataaaaaagggacgaattatccgcgttaccaccctgattggtacctaaaaggctacccagcttaattttaataacgacatatatatgccgccagatgctactattacttcacagctggaactcctgagtgaacttcacaattacttcatttaaaaagacttccagtccaatgatcttttctccctgaaaacttcataaaagctactctctcaatcacaatttttaatttatttaattaatacaactaattatacaaataaagaatagaaatttcaaccctcaattttaaaattaatccaaatataacacacttatttcaatatactgaaaaatttaagctacactgtaaaaataatcatttcaaattgacttcttattgatctttaacatacatatattccctaaactatgaatttactaaaaatcacttcctgcaaggtatccagttgaaaatgccatctgaagattgtatcctccagtttcagcatcgatatcaatcacttctcctgcaaagtacagatttttaattatttttgattccatattggaagcatttatttctttaacactaactcctccagatgtaacctgtgccgcttttatagttaatgtttctcttgctgtaagtctcatttcttttatgtattcaagaatcttattttcatcttccttttttaagtcacttgctttaacttcagtaattcctataatagaaaatatttctttcaagaaattctgtggtaatattcccttcaaattatttaatgcagtcttattaggattacttcttattatttctgatagttcttctttagacttgtcactcataaaatcaagttttatttctacttcaccatcatttaaagctttatttatatatgatgatagttttagcactcctggaccggacactccaaaatgtgtaaatatcatatcgcctattttttctatttttctcttcttaacctttgcagaaataaccacatccttcattgaaacaccttgaagtgattttacaaattcttctttaataactagtggtattaatgctgggtaaataggagttattgtatgaccgtatttttttataacatcatacatagatccatctgatcctgtatttggaaagctctttcctccagttgtaacaataactttatctccatatattctttttccaccctcagatataacacccttcacagtattatcttccactataagatcctctatctttgtattaaacataattttaacattattatttttcaaatcattttttaatacttctataacttcatctgctttatcacttttagtatatactttttgatcaagttcttctttatattctagcccctgttcactaaagtattcaagtaaagaataatttgaaaaagtataaagagcactatataaaaatttattatttgtaactattttttcaaaaaactcctcaatatctctgttatttgtaatattacatcttccaccaccagtaagcttaagtttttcaccaatattactatttctctctattaaaacaacttcgttattctttgcactgctaagtgcagccataatcccagccggacctgcaccaacaacaataacatttgccataaatacacctcactattatttcatttgttcttttatgattatagcataataaataaaattttattatccataataaattattcataatttttcattctcacaaaaaatttgtatttaaaactctttataacaatttaaagtaaattctatcataaaactaaaaaacatgctcatatttatagagcatgcttttcataaaataataaatatactattctataatttaaaaaattatactaatttggaattgttctaatcgtataaatcttgtcgtatcttttcatacattataactgaagtagctatagcaacatttaaagattcagcatttcccggcataggtatcttgactttcgtatctgccaattcatatacctcatcacttactccatttccctcatttccaactgttaagagaacttttcccttaaggctttcctggaagaaatctttatctgtatcaagagatgtaacaactatcttaaacttcttatcctttaaagatttcacaagtgtcatattttcatcatcataatgaactggaacataaaacaatgatcccatagttgatcttattgtcttttcattgtatatatctactgtcccttttgttaaaataattccatcagctttaactgcatgtgctgttcttattattgttcctaaattacctggatcttgaactttatcacatagcaaataaaaacttccattcaaatctaaggttttctcattcatatgtacaatggcaactattccttgtggcttttctgttgaaataatttctttaaataaagaatttaccatttcatatatcttaatatctttatttatatattctcttaaataggaatcaattttatcttttccgtcacatgttactattaagcattctatattcaaaccagctttaaatgcttcttgaacaagtctaaaaccttctataatatatttattactttttgttctattttttctttctttaagcttcttagtttctttaaataaattattatctttactttcaataaaagtcaaagttttcacctcaaaattttcagctttttccaatagcaccttcaagctttcctaaatctttagtagttcccagtgctactataatatcatttttcattatcatttcatctggtcccggagaaacattcacatcattcccatccttaatggcaaccacatttattccatatttttttcttaactccagatctttcaaagatttattaatccaagaatcaagtgcttcaatctccattatactgtattctgatgataattcaatgtaatccagtatatttgatgaaacaagattatgtgccactctctgccccatatccttttctggaagcaccaccttatctgctccaattttataaagaacttttgcatgcaagtcactatgcccttttgcaattatatatttcacacctatttctcttacaagtaaagtaaccataacacttgcttgaatatcagatcctattgttacaaccgccacatcaaaatttcttagacctaattttctcaatgcattttcatcagtggcatccatctgtacggcatgagttacataatctgcaatatcagcaattttttcttcatccatatctataacaagtacatcatgacctaagttataaactgttcttgcaagcgattcaccgaatcgcccaagtcctattacaacaaactgttttttcgccatattaatctcctcctaatccccttaccactataaaacttagatactattatatttttctcgtatatactaattttataataaaaattttctaatttaaatacaagtacttatttatccaatcaatattttaccttctggatacttaattcccgacttattatttctttttatcaaggcaagaaagactgtaattggtccaacccttccacaatacattgtaaacataagaacaattttacttaaagttcctatttcttgtgtcacaccagtagtaagccctgctgttccaaatgcagatgaagcttcgtaaagaagatctatgaactgctgatttggctctgcaatactaagtattgttgtaacaactaatactattgccataccaagtgcaaacacagtaaatgctttgtatacagtttcttttgaaaatcttcttccaaaagcttctgtatcatttcttcctcgtaacacagatataacagttagcacaagaactccaaatgtggctgttttcaatccaccagcagtcgatcctggagaaccacctataaacattaaaattatagtcataagcttaccactcattgtcatatcacctgttgatatactgttaaatcctgcagttcttggagtaattgatgaaaacatagaatttagaatcttttcacctaaatttaaattacccaaggttgccgtatttttatattcaacaagaaaaataaaagcagctcctccaaatattaaacttgcagtaatgcatattacaatcttagaatgaactgataactttttcatttttttataatttaatatttctattaaaacagtaaatccaataccaccgattataattaatagacttattactattattacaagataatttcccgaaaaactcgttagactggaaaaactaccaaataaatcaaagccagcattgcaaaatgcagacaccgaatggaatatactataaaacacaccagtcgaaataccaaactttggcacaaatacaaagctcaaaagaaatgcacctgcaatctgtactgtaaaagtaagtccaagaacatatctaagcatttttaccaatccttgaatattaaatgtattcatagcttcctgcataatcaatctatcacgtagtgtaatctttcttccaagaatcattgcaataaatgttgtaactgacatgaaacctaatccaccaatttctataagtatcattattatgcattgaccaaaagtattccaataggttcctgtatctagtgtcacaagaccagttacacatacagctgatgtcgctgtaaaaatcgaatctacaagacttgtatatctaccactttttgatgaaataggcagactaagtataactccgccaagtaaaattactactgcaaagccaagtgctaatattcttacttcgctaagcctattttttttcgtaatgactttttccatattcttcacctcaaaggttaataatatattcttttttatataaaaataaaatgcggcccaaagaccgcattttatatgtaatattaagctaatgcttttttagcagtttcaactaattcagcaaatgcttttggatcattgatagctatttctgataacatttttctgttaatttcgattccagctaatttgattccattcatgaattttgaataagacatttcgttcattctagcagcagcattgattcttgcgatccataagcttctgtagtctctcttcttattctttcttccaacgtaagcatttcttaatgctcttattactgattcattagcagttttaaataacttactctttccaccgtagtatccttttgcaagttttaaaacttttttatgatttttacgagaattctttgctctctttactcttgccattacttaaacctcctgtaccaaatactctatcttataggtatggtaataatttcttcattactttttcttgtgctttacaaacgtatccagcttttctaagatttctcttagtctttgagctcttcttagttaagatatggctcttaaaagctttagctcttttaagctttcctgttcctgtctttctaaatctttttgctgcacctctatgactcttcatttttggcatgataaaatcctcctctcaagttatgcctttttaggccctaaaaccaatgtcatgcttctaccttctcttttaggtcttttctctataatagaaacatcttctaatttagctgtaaaattattaagaattctttcaccaatgtgacctaactccatttctctacctctaaatctaacagtgattttaactttatctccatctaataggaactttcttgcattttttgctttgatatcaatatcatgttcctcaatagttagacttactcttatttcttttatactgattactttttgtttctttttagcttctttttccttctttgattgctcatatacaaatttaccgtagtccataaccttacaaactggtggttttgcatttggggaaatcataactaaatctagttcattttcatcagcaagtcttcttgcttcatttgtcgaaacaacaccaagttgttctccatctttacctatcaatctgacttctttttctcttattccttcattcatcgaaaaatctttactaatatttttcacctccgaaaaattctatacataataaaaagacggcctcacttagccgtctcatattatcaatacaactgtatagacatccataaacctaactagcaatcatatgacactgtaaggtgagaaacggctgtttcttcttaacaaaacttagtatatcaccatatctaaaacatgtcaacatttttactcaatatttttttaggtagatattctatacattcatcaaaacaagttaccctatcaccaaagacatttttaattgtctctaaaaactctttattattacaatttcgttttccgtaaattattatatttttaggcgaacttgttataagaccacttatcagtatatcttctatatttatatcaaaatcattttcatcaccagtaagttcttttaaaaagtccttgtataaatccttgccgtattcatcctttataatatagtgacttcctgcttcaattgaaattattattttttcaattttacattcttgaatatcaacaaaatattttaacaaccgaacaaattcttcatattctttttcaaccatgtacttttctactactttatctactatcttctctatatcttcacgtaacatacgtaatctaaaggttataaaaccatccacgttaatctcttgtttttcaccaatacactgtcttattttttcaataatgttatttattctatttaaacaataaatagaatcttcatccttacaagctgcttcacagtttagcacttttagtatcttattttctacctctaaaatttcactttgctttaaaaagaaataattgtctgttataaattcaaacatttctcttttcctataataatcaataactattctatataaaatattactaacatataagttaataatttcttctatcttattgttatacgaatccttatcacacattattttaattatatgtgtctttccttcaatactttcaaccaaacctattgttatatcttttttcttaagtgattcttttagctcctgcaagtcatgcgaaaatgtaagctcttcattataagctaattttaaaataagcatggatttcactcccttctttatattagtatgtatgaaaaaatattagatatactcatatacaagttctatttttatatgaattttaatttttttatatggacataactcttacatctatttcttttcaataaatactatgagcattacagttttctatttttaatattctaatgtatgtatttgtataatacgcttaaaaatttacaatgtgttatttacaagcaaatttaaaatatttataattttcttaataaaaattttattttaaaataaaaaggagattaagatgtacgcttttgctgattatagaattactgatgaagaaatccaaagtcttttaaaattaaatatagaagtaatcaaagttcccaaatgcacccaagtttatgaagccattaatggacatccagatattcaactaaatatactaaaaaacaatagtgctactcaattaattgttcaaaaagatatttctgaagattttagaaatattttagaagaaaatcacataaaatatattgtttcaaagaaatctttgaaaaattcatatccatctgacattattttgaatgctttaatacttaaagatcattttattcatactttagcatatacagatgaaaatcttttcaattcccaaaaatcaaaaataaatattgatgtaccacaaggatatacaaaatgttctgttctaccaataaacgaaaaagcattaattacaagtgataaaggtatatacaaaaaattaaaaaattttaattttgacattctacttcttccaccaggcgacatccttcttccttctttaaactatgggttcataggaggtactggaggaatgatttcttctgacaaaatagctttctttggtgaattagaacattacaaatacggaaatgaaataaaaaaatttttatctcattatggaattacccctgtttacttaaaaaaaggcaaacttatagatagaggaagtcttatagtcctttaattgtgtcactatataatatgtttttttgttttttatgttactttttaacttagtactgtaaaaattttattaaaaaaataattctaaaaaataagcatttttttagcttactacatatatataatgtgtagatgattttaaatgttcaatggcactatagccaagtggtaaggcagaggtctgcaaaacctttattccccagttcaaatctgggtggtgcctccaaaactttaatcaacaaatactaattttaaaagtaaaaaggcccgtagacttgagatttctctcgcctgcggactttttattttttacttttatttttccaacttagcataagctaaaagagccatgcactgatcaaatgaatatattccacttccatccatatttccaaaagcaccataatataaattttcagaatcattaattttcattttttccattcttataactgcattattaataagttcacagtcattcacttctattcctatcaaagctgccagtgcataagctgctgtagattcatattgatatccgtctataacatttcctaaaacagaatattttccatataaagtgcccttttcaacttgcttctttaaccatgatattgtttcaggcttttcttgccctacttcggacaaatgaagaattgtaacaagcgcttctgatatgtttaagtcatctttttcatattgtttagcattatagttataccaactgtagtataaaggaaattcatcatttatatatccattcttcactctatcaatagtattactgtatacctttttaaatttccagttctcagcccataattcattaagagcattaaaatctccataacataaagtaaacctattagatttttgattgttatcaaaatcataacaatccacaagattattgttttcaacattatatttataaatatctctactgtatgcttttaaatctttttccttaattccaaagttttcttcaccattgtaaagtgcatcatatacccttaaatcatcaatcgctgcatttactctgctagcctcattattttcaaccttccaggaaataagactatcatttttcatatatttatttatgtaatttaatgtagattcaaataattctttatttccttttaaattagcatattcaatcataattccttgagattcactcagtacagtatcgaggctaccattattaaaagttatatttactccgccttcagaattaatcatatttttcattacaaatttttctgtactatttgatcctgaatcttttattttgtttacaattctcacaatagaagattcatctgataacactccttcatttaaagttacaagatgcccctctttgtctattgaaaaagtagcaggtacacttttgatgccaagtttactgtgtacattcatattactatcaaaaatcaatttcacatctatattattatccttaagatattttacagcattttctctaactttagaattattttcatcacttctgtgtacaagaacatattctacattatcaagctgctgtacagcattctttaatttttcagctatggaaatttgaaatttagaatcttcaaactcgctatcccaatatgtaaaaataacatttttcccattaaaatcatttatagaaatctcatctccatcttccgaaaaaaacttaatatcgttaatttttccatataaagtatatttatctttaatattacttcgaaagtccatcttctcttcttttgatttaataatttcttctttcttattattttcaatattatttgtaataaagcagtatgtaccactaattaacaaaatacatgccaaaagtattacgtatattttcccttgcttcattttcttactcctcataaaatcaaactattattacattaattataacactcttattgtttcaattaaaaattataaacaataaccttttctatactttaatataagacaaactaattatattaaagtattccattgaattttaatatataaaagactgattccctaaaaaaatcagtctttacataatttataaataattcattatttaacttccaacaactttagctactgcttgtattaccctttcattatcaaatggctttacaataaagtctttagctccgccttttattgctgatagaacagtctgttcttgtcccattgctgaacacattataactttagctttcgagtcaatttcaatgattttattaagtgcagctattccatccatttctggcatagtaatatccattaatattaaatctggttttaataaattgtacttttcaatggcagctattccattttctgcttctccaataacttcatagccgttatctaccaatatctccttaagcagtttccgcatgaacattgtatcatcgcagactaaaatttttttactcatatttctcctcctattttacataggcaaagtttaataaagcacattttatcaacaaggtaccttattatttatgcaactggctgccattctataagaaaggccctctagctttgcgtcacagcttttcaactgctttgcccaatatgaaaatttatacttattcataactattttaccataactattattttttacaatataaacaaaaatttctttatattacttcattttaatatatttttctatttattttactatatatttctataaagtttaaaaagactcaaagtaatagtgtgcattactttgaatcttcataattctatatattattgtacgatgatttctacagctgcttttattatttcaaaggctttatcacaatctttctcatttaaaattaaaggtggaaccatacgaataacattctttcctatagctgtaatcaataattttctatcaaaacacttatgtttaacatctaaagctatatcgcaatcaaattcaacaccaactaaaagtccttttccacgaacttcttttacatgtggcaaatcttttagtttacatttaaaatattctcccattgtatctgcatttgatgctaaatctctatctaataattcattaatctgagcatatgatgctgcacagcacactggatttcctccataggttgtcccatgagatcctggtgtaaatgcttttgacacttcctcgttagcacatatagcagctataggcattcccctcccatggcttttgccatagatacaatatctggttttatatcataatgcatataagccatcactttcccagttctacaccaacctgtctgaacttcatctagtaataaaagcattcctttttcatcacaaaattttctaagaccttccataaattcttgcgtagctggatgtactccaccttcaccttgtattggttcaatcataattgctattgtattttctgtgcatgcatccttgaatgattgtaaatcattgtattcagcataagtaaaccctggaaccatcggtttgaatccaatctgacacccattatcaggttgtcctgttgcagacattgaaccataagttcttccatgaaatccattcttagctgttacaatgttatatttattaggaccatatttctcaactccatactttctagccattttaatcatagcttcattagcttctgttcctgtactttgataaaatattttgtccatcccaattgtctcacatattaattttgcaagaagagcttgaggtatagtatatggataattaaatgtatggattatatcattaacctgttcctttattgcttctactactttttcattacaatttcctgcactgtttactgcaattcccccataaaagtctaaataactttcgcccttttcatcatatagatacatatctttagctgtctctgcaacaaagtcaaatctttcatacgtatcaatcatatatttgcttactaactcttttaattcttcctttgataatttagtatcttttaatttcataataaattcctccttataaccataacaactttacaaataaaacattaaagagcttttctaaaaattctctttatatcttctaaattaaattctttaggatgacttttcatacctgcagctgaaactttcaaacaattttctgccatccaatctatatctgcttcattaatcccttgttctcctagtgttgtttctaaatctatatcttttaaaagatttcttattacctgcacacaatcattttcatcacttccacctaataaccttgaaatcattgcaaatttttctggtgctgcacttattgattcttcataaataactggtgtaagagctgcaagacctctcccatgtactatattttttagtccacttgcaggatgttccattccatgtggtgctgtaacaccagctgtatttataaccattcctcctaaggtacttgcccatgttattttttcaaaagcttccatatcatctttattgttatagactttaactaaattttttcctattaattcaataccttgaagggccataatcgttgtaagtggttgttcatttttagataggtaagcctccatgttgtggcataaagcatcaaatccaacacttgccaaaatgtgctttggcattgtagtcattaattctggatctattatggaagctttagccactatcgcattacatcttaatgattttttatcattattatctgggtttgttaacaccgcaaatccatttccttcactgcctgtaccacatgttgttggaactaatattattggaagtgcctcatcactggttttttttccaaatatgtaatctgaaacatccccttcatttaatgtaataaatgcaatagctttagctgcatccataatgcttcctccaccaagacctactacaacatcacacttttcttttttagcaagctccgctccatcataagctgttgtagttaatggattttgttcaaccttatcaaaaactatagtttttatatctgattcatttaataattttatagttctatcaagaagtcctgttttctttgtactattttttccagttacaataagtgctgttttaccatactttaaaacttcacttccaatttcactaactctacctctcccaaatataatattaactggtaaattgtaattaaaattcataaataaaatctccttcaattcttaaataatttaaatctccattgattaaaatttatagttcgttatttaaaataaaatggcgttctggattaacatccagaacgccgttgttctctataaaaatttattattgtcttgtatatatttaatatatcacttgtgcgttataatgtcaataatttcgaaatattttttcaaaaacgtatataatagttctataatatccttaaataatcagatatatattgtttaatttatatatttcacatttttaaaatacgttatcttgtccaagcacttcaactattttttaattttttatcaataataaccgctgcaaaaatgctgcggttgttattgattattgaattaatttaatgcttttttaattgcttcttcaaatatttcaagccctgcttttagctgttcatcagtcattacaaggggtgctaaaaatctaataacttgtccgtatgttcctgaattttcaagcataagtcctttttcaactgcattcttcactattttagatacaatctcaccatttggagtctttgattgtttgtcagttacaaattcaattccaatcataccaccaagacctcttacatcaccaattacttcatatttgtccatccattttttatatacagcttgaaccttctctccaatttctaaagagcgctttgctaaattatccctttccataatttctattgttttaatagcagctgcacatgctaatggatttccacaataagtacctccaatagttcctggtaaaacagattccattatttcttccctcgctactatcgcacttattggtagaccagcaccaattgattttgcagttgctaaaatgtctggcataacccccgcttctttccaatattcacttgcaaacatttttccagtacgacaaaaaccactttgaacttcatctgcaataagcattattccattttcatcacatatttttctaactgccttaacccattcaataggcgctggaataaatccaccttcaccttgaagcggttcaacaactattgcagctatataatctgctggagaacactcttcaaatactttataaatagaatttatataatacttaattgcttcttcttcattcattccttttggttttctataaaggtatggatattcagctctatatataccttcggggaatggtccaagcccctttgcatatgcttttttagatgtcattgccatcgtaagattagttcttccatgaaaagctcctgaaaaacaaattatattaggtctttttgtaaatgcctttgctacttttactgcattttcatctgcttctgcaccactatttgcaaagtaagttttctttttatcgccttttacaggaactatatcatttaatttttctgcaagtttaacatatccttcatgtgttactatattaaacattccatgaaaatacttttcactttgctttttaacttcttctataatttcaggatgactaaatccaacattgagtacccccactcctccaatccaatctaaaaatctatttccatcaacatcttcaatcatagcaccttcaccacgctcaattacaactggatatacacattttattgcccttggtattgcttcctcacgtctttttataacttccttagcctttggtcctggtagtatttctgtaataatttttggtaattcatctcttaacattgtaaacatctcctataaattctatttttatttacttatagctcatctcatattagtagtatctgttaatccacaaaactttcaataataaaagcgtcctagattaaaatccagaacgcctttgttcaattgatataataatatgtatttactatatttgttttttcttgttataatcatcttaacaccattttttctcacaaacaatggtattgagcctaaattctttatattttttagtgctattagcacataaatgattttatatcttataattaacctttactcacatttatgtaattaaaaattaggaggtaatttattatatgtccataaccttgaaaaagctatataccgaatcaaagtcaaaatacaaattaaaactactaactggagaaaatgcattagataatgtagtaagttggtttcactttatggaagatgaatcaacaatagatttcatacgtggaaacgaacttatcgttactacaggacttggttcaaaaaatgctgaatggcttgataacttaataaaaggtcttattaacagacatgcttctggactaatggtaaatataggtcagtatatttcaaaaatccctgaccatactataaaattttgtaatgacaatagtttcccactatttacaatcccatgggaagtacacctagtagatataatgcaggactattgcaacggtattatcagtgcggaacagcagaaatccaatatatgctctgccttctttaatgctatattttctccaatgcaaaaagatttatatattccatgtctcaaacaagcatcctttgacttgcatggcgaatttatcattatatctttagctttagattcttcactttacaaaaaaaatactgaaataaagcttaaaaactttattatgagaatagaaaatactcttaactcattttcttttaaatatagtatattatctcaaaacggagaattaaacataatcacaaatttttcctcatcacaaaatccattaaattatatagatagctatgttgtcagacatttaaaaaactattgtgaaatcaaacatattggagtaagctcatcaataactgcgatagaaaatttgaacaaagcctatatccaatcatctaacgcaaaatatacatccataaaagacgatacttttattatttattatgaaaacatggggattgataaacttcttttaaatgtaaatgacccccaaattttgtgtgacttatataagaaatatttaggcattattcatgattatgataaaactcacaaaactgactatgaaaatattcttgaaatatatctaaaaaacaattgcagtatacaagctgtttcaaaaaaaacatatactcatagaaatacaataaattatagaattaaaaaaatcaaagaaatactcaataaccaacttgataatagcgaagaaaattttaattaccttcttgcttttcatatacgagatatacttaatatagatcacaatctttaactttctagataaaaataaaagaagagatgtatttaaaattaacatctcttcttatctttattcatagcttaaatttgtgaaaatgcctttactcctcttgattcttcttcttcatgtccttcaatatttattatttcatgaactccaaaatctgaatatttcaattttgctattgaataaaatataattccaaggacagtccatgcaccaaccattattaactcctctttaactaaacctgagggcatccctggtaaatataataacatcataaatccacttaataaaacagctatacctcctataattttcccacatttaactttataaggtcttatcatatctggttctctaaatcttaatactaaaaatgacatagaaacaagtacatatgctactacaactccaaaacttcctgcatcagtgagccataccatcatagctcttccaaagaatggagctactactgaaattacacctattagtaaaattgcgtttgttggtgttttatatttaggatgaagtttcgctaaaaatcctggaagcatttttgattctgcaagggaataaatggctctgcttcctcccataaaaaatgagttccaacttgtaactataccagccatgccacctattattacaacttttgcagccatttcactaccaaaaaatgcatttttcattgcatctgctgtaactaatgttgaagtatctaattgagattttgtcataaccatcgatactgcaataataatcataatataccatattactgccattacaattgaaagtatcattattttacctatctttttaaacggaacatttatttcttctgccgcctgaggtataacatcaaatccaacaaacataaatggtgtcattactgcaactgtcaatatacctccaactccatcagtaaataaaggctttgtattttcaatatttcctgaaaatcccgaagctgcaactaaagcaactccaatagctgcaatagaaatagttaaaattgtctgtaattttgctgctgatttagcaccaaaataattaataattgtaataattattgatgcaacaaccccaaccgcaacccatgatgcataaatatcaaatcctgcaattgtgtacatataaccttttaaaaaccctggacaaatatactgtataacggttgggaatgcacatgcctcaaatgcaacgactccaacataacctaaaacaataccccaagtacatacaaaggacccattttttccaagagctcttaaactaaacacatgctctcctccacactgtggcatagcagccgtaagttctgcataagtaagtccaacaaaaagtaccattattccaccgattataaaagccataatagaacccagtgttcctgcacctttaatccaatctcctgccatgactacccaaccccagccaatcatcgcaccaaatgctatagcaaatatatcttttttacttaaaactctttcaaattttgaatcttccataataattccccctaatttaaaaattactttagttagtagtagttatttggaaacccctttgttttcaaataaaaaagcgctccagatataaaatccagaacgcctttgttcaaatttgttataacaatattcgattcattaactatacccatactataccatttatgcgttatagtgtcaatattttttacatttttttctttaaataatattttcatattatttccaataaaaaaccgcattaaaacttaataattcattagtatcattaatataaacatgatctttatccgtattaaatcttacagcatccccgctttttataacatattttttttcatcaatttctaaagtgagttcacctttaataacatttatgtattcacaagttttttccccatgagaaccagttgtatagatacctccaggttttatttcaatcatatatatttcaaaattacggtcttcctcgtaaggaaaatatgtataaacactatattgatcagttgattccttagatggttctaacgattccttttttactatatatatttcctctttaggcatacatacaagatcattaaaagacactctaagtccgcttactatcttgcctaatattgctactgtaggattagattctcctctttcaatttgccctagcatacttttactcacaccagtttgctcggaaactacatcaagactcatttttttactttttcgtatattctttaaattaattgatacatttctatttatataatccatttttcctcctcaaatcaaaatatagcacactaaattattgtgcactataatgcacccaaattataaaaaataaagatgcctttcttatattttaaagacatctttattttattataatctatagttttattccatacaatacatttattaaattctttccaatggaaatgtcatgcagtgaggaccaccacctgcctttaagatttctgttatatcaagttctataacatgcatccccctttttttaagttcctcatttacttttacatttttctttaaagacaatactctatgatttcctattgcctgaagattgcatccatgttcaaatatactttcttctggtacagatactatatctattccaatctcttctatcagtttaacaaaatcctctggaagaccttctttatatgatactgctatattatgatcaactaaattaaaacacatatctaaatgaagatattctttcttaagctttacaccaataacctcatatccatattgtgatatctgctttcgtatttcttccacaccttcttcattacttctatcagccataccaacagctattgttttttcattaagaaacataaaatccccaccttcaaaaatccccttctcaactcttgctattacaggtattttgagttctttcattttttcctcataatctatatgttccttatatcttatgggaagcttaaatctccctaaaatatatccttcttttacacaccctccaaaatctcttgcaaagactgaattaggtctatttttatcagcttctaaatactcaactttaactccattatcttcatatgctttaactaataactcatgttctattttcatctttttcaaattcaaatccaaatcccactttttagctatctcatttattttagcagcttttaagtactctggttttgacaatagtactctctttaatactccagttccatttttaacaaacatattcatatatcttcctttcacttaaacttataatttaataattatcaaaatcaatatatgcttcataaattataaataatctttctaaatcacttactgttcttctttctatctcagatatatatacaataaagcctgttggtgcatttgggttagctcaaataatatgactcttacttttttataaacttattcatataaacttattcatataaacactaaaatcatctttaattaagttacatcttttcaataactatacttatagtataaacataccaaatattctaagtataaaattcacaatttgttgtaagactaaaaaagcagtctaaattcagactgcttcttattatccatttaaaattcaatgactgtacctgttctattagtgaatgtatttttacatttttcttcaaatatctttactgctttttctcccgtacaatgagaaagtcctatactttttaatcccatacgctctaaataatccgcacttttatttattctctcatcatctccctctacaagatgagttcctcctataacaccacagattttttctcctgtaaattccttaatactatcaattatatttaaaaagcccggatgtgcacatcccaataatataacaacaccatcttttgtcttaagcccaatggaaacttcatcatcaaaagaatctgttatatattgatccttatctactttaataagcatatttttattttctttttctatactatgaatctttttgaaattagtaaatatataaacttcatcatttaccttatacatattctcctttatataattaatacttatattcttttcttttaaatattcttctccaaaatctataccaacatatttatatccaacttctccggaaaaatctgtttttaagccaccatcagaataatgatatctgtcactatttttaaaaaatgtatttccaacaataacatttggagctacattatatgtatctaaaagccttttaaccccaccacaatgatcatagtgagcatgacttaaaactaatgtttttatcgttcctaagtcaatattcatctttttagcattctctacgaaatcacctgattttccagtatcaaacaatatgtttccatatgaactctcaataaaaattgataatccatgttcattttttaacaaacctttttcatcttgtgaattttctattaatgttgttattttcattatacccaccatcctctatattgtacttgcaaattcatttaaaagagcagcattagaagttaattcctgtattgttgctgttatttcttctagtccagcagtctgattttctagtagattatttgaattttcaaatcttctctctatctcaccaatggaattttgaatatttctcaatgttgtattaatttgttctatagattcttttgttgattttgaaagctttcttatttcatttgatactacactaaatccttttccatattcaccagctctcgctgattctatagctgcattcaatcctaataaattagtctgtttagctatatcttcaacaaaagacaatacttcatctgtctttttagaatactcgtttgtcttacttataaaatctcctatacccaaatttgtctcacttatctcctgaaatcttgatgccatatctactgcatttaaactcatttgagataaagattctgacagtgttttagccatatttgacattttttctttattttcaacactcattcctattactatagttccctctattttattatctaccattacaggtactgccatagtctttagaggaacaccaaatacattgtccggaaccattacataaaccttactcttttcttttaaacagacatctgccgcacatcctttaggaataatatcacctgttttagcaaccatccttaatttgtcattatctttaaccaaaagaaatctttcagtattagaaattgtaaaaaccaaatccgtcccaaaaaaatgttcaaaatatggaattaaattataaaatgattccataagttcattttctgatattttgttaatcatcactatacctctattctagtattaattaatttataaaaacaatattagtcctataaattcatccccaatatatgataccataatattctatattttcctttttgtaattgtgacaattttattaatatatattctaaaataattaatttataattaatgtttaaaatttacataattcacttaattgatatacaaaatatttgccaatatatacatactgtttaaccatccattaaatataattgatattatattttaccacttaaattttatacaaatatttctttataaaaaatgactgatagttaaatcttaactatcagccatttttctattatcctataatcatagcatatgcattcataaaaattaatttttactgtttaacaaatctccaatatgctcatgagtaaattcatattttttattacagaagttacaaactatctcttcagacttgccttcatcataaagttcctgtaaatcatccctacctatggatattaatgctttctcaactctttctcttgaacagtcacatttatattctggttctacatcttcaagaatttttaaatccattccttcaaatataaattctaatatttcttcaatagtctttccttcacttattaatgtagttattggcggtatttcttgtaatctatatgttattaaatctgctaacagttcatcagcacctggaagcatctgtactataaatcctcctgctgctttaatagataaatctttatcaactaaaactccaagggaaactgctgatggtgtctgttctgacacagtaaaataatatgcaaaatcctctgctatttctccagtctgaatttttacttgaccaacatatggatctttaagacctaaatccttaataacataaagcataccatttgttccaattgctccgccaacatcaagcttacctttttcattaagaggtctgtccacgtatggatttcctataacccctttaactgtgcagtcactatgcgctgttacagtaattccattaatttctccgccaccatttatctttaaagtagtaatttctttttcactttttaatgttgatccaataagtgcccctgctgtaagcattcttccaaaagcagctgatgctacaggtgctgtatcatgaattttagttccttcatttactaaatttgttgtaatacctgcaattattctaaccatatcatttttggctgtagccttaactattttatcttgcattttttcatctccctgtataattcttatttacttctacttttttaaaatgtaaagtattcgttcactgttttcatgaactttatcattactatatccatcaaactttcctattaatttaaatttacatttattcaagacttgttctatatattcatctgcatacgctctttcaatgtgttcttcttcaaatctttcatataaaccttcattattttttacaaaaaaggttaaaaacatatttaacacatcattttcaaaagcattctcccatgtataaaaaatatcttcactgctatatgtgtaaatattatttcctaatacttcacttaatttataatatgaatttatatcaaatataaataatccatcctctttaagatgatcatatacgctgctaaaataatcatataaatcttcatcttcagttatataatttgtagaatccagaacacaacttataagatcaaacttatgatttaaactcagttcacacatatcctggcatattacttttgcttttaccttatttgctttaaatttttcaaaagccacatttaacatatcatctgaaagatctacggcaaaagtatttttaaattctttgcatactttcactgcaacattacctgtcccacatgctaaatctaaataatcttcaaatttaatattattatctttacatatttccaaaatcttttctgcaactttatcatagttaatatcttcatatattaattcatcataaatatttgcaaattcattgtacgccacatttatcacgcccttaagtaagtctatacatcatctaatatattatatcttaatttttaagttagtcaaacatccgagtatgaaaaacatagtaatacagtgacgtaacgtaaaattttatgatttatttttgcgtcttcctaatatttcatcatttgatggcatatttaatacttttttacgttttgtcataagacctcctatacgtccagtctcttctgctgaaagtcctccccagccttcactttttaccttatcactaagtccaagttcttcagcaatctcatattttattttttctctcatcttctctgcttcagttaattccttatttcccttaagcttcgatttaattattttttttaatggagtattactcaaaatatcaccgcatttcctctattttttcttacatatttttattatctccaaatattattttcatattctaaatttcataagaccataaatatacactttaataaaatcattttcttttttcaacttatttcctttatatacttgctattttttaaatatttatctatagtatttgtatatatatttatttatttgtatattttttattaaataatcattagttttattgtgtaaaggtaaatcaatttattaatatatttaataaattagaagtgttatttctatataattaaatgcatttaagcctattcaattatatagacgtcttccttaaaaataggttatactaaatatgtataaaataataaacagtatactaaaacttctatttatatatctgaaacataacttagaatatgtaaaaaatatatgtctttagtaatttacatgattttatcagcaattctttattactttttatgaagtatttattctataaagtgattattcattgaaattaaatttgaaacacaaaaggcataaatgtatatgatattatataggaagaaaaaaatattaatatcataaaaatatcttgttgttataaaaatttaatgtctaaaacataagaaaaatgcctgtaaattatcattataagtactaatgataaagaatgataaatagttttagtaatttaattggaggaattataatgtcaatatttgaaggttctggggtggccattattacaccttttaatgatgaaggagttaattttgaaaagctaagaactctgcttgaatggcatattgaaaaaggtactgatgcagtcataatctgtggtacaactggtgaagctaccacaatgacagaaaaggaaaaaaaggacacaataaaatttactgttgatgtggtcaacaaaagaatccctgttattgctggaactggctctaacaacacaactacggctatttctatgagtaagtatgctgaaagtgttggtgttgatggacttcttgtaataaccccatattataataagactactcaaaaaggtttaataaaacactttaaggccattaatgatgaagtaaacacacctattattctttataatgttccatcaagaacaggcgtaaatattaaaccagatacattgttaaaacttactgaactaagcaatgtaaaagcagtaaaagaagctagtggcgatatcagccagattgtaaaaataaaagaattatgcagagataaaatagatatatattctggtaatgatgaccaggttgtttctataatgtctttgggcggaaaaggtgttatatctgttcttgcaaatataattcccgataaagttcatgaaatggcagaaaaatgtcttaaaaatgattttaaaggtgctttagatattcagcttgatactctatctttagcaaactctttatttattgaaacaaatcctatcccagttaaaactgcaatgaatttaatgggattagaagttggttcattaagacttccactttgtgaaatggaacctaataatgaagatgttttaaaaacaactttaaaggcaaataaattaatgtaaggtgagatagtatggtaaaagtagtgttaaatggatgttgtggtaaaatgggtaaaatgattaccgaatgctgcacaaaatttaaaaatgtagaaattgttgctggaattgatagattcccaagtgatatatcatatcctgtcttcagtagtcctgaagaattaaacattgaatatgatgtattattagacttctcaagagcagatgctttaaacagccttctagctttaacagaaaaaactagaaaaccacttgttatctgttcaactggattttctgatgaacaattagctttaatcgatgaaaagagcaaaacccttcctctttttagatctgctaacatgtcactaggaataaacttattaaattctttattaaaaaaagttgcacctcttctttatggtaactatgatattgaaattatagaaaaacaccataaccaaaaggtagattctccaagtggtacagcacttttacttgcagacacaataagagattctctaaaggatgaaacaaaatatgtttatggacgagaaggtcatgcaaaaagagaagaaaacgaaattggaattcatgcaattagaggtggctctatagttggtgatcacgatgttatttttgctggaagtggtgaaataattgaacttactcataaagccatatcaagagaagtttttgctgttggtgcattaaaagcatgtgaattcatggcttctataacagaaccaggtttatataatatggatgatgttattggacttaatgactaattaacagccatatatttttaattttaaaaaatgaaaagcttactatataaattaaaaagtttcctagttcatacaataattaagtatgaataggaaactttttatttactatatttttcgttataatgctgattctatcaaaagcctcgtataatcacttttaggattattagttacttcgcaagattttccttcttctacaagttttcctttatatattactcccattctctgacagaagctacttacaagttttaaatcatgggatatgaacaaatatgttatttctcttttttccattgttctttttaaaagttctatcacctgagcctgaacagaaacatccagtccacttgtagcctcatcaaaaattatcacttgtggatgaaccgatagtgctctagcaatagcagctctctggcattggcctccacttaattcatatggatatctatcataatgttcttctcttaatccaacctgttctaaaagttcaacaaccttttttcttctttgttttttatctatataacataaattgcatacatattccaatatggaatttcctattgtcatttttggattaaatgaacctttggcatcttgaaataccatctgtattttactataataatctctattttttcttcctttaaactttgatatattttttccttcgattagtatatctccagaatcactactttcaagcttcatgatcattctagcaagagtactcttcccacttccactttctcccacaattccaaaacattcacctttataaagttcaagacttatattatcagctgctatatggacatgaccttttttcttaaattcttttctcaagtttctacattctaatataatatcattcattttaaaatactctctttttagtatctatattttatttgtttatttcttaactattttattgctaaactagaactaccattttgtaaaatactacatcttacaaaatgattcttttttaactcaattaattctattctttctcttttgcacttctcattacaaaaatcacatcttttttcaaatctgcatccttctgtatacacttcaaaagaatgcatgtttcctcttattggttcaggtagtactccattcattttaggtactgaatttataagggctttagtatatggatggaaagggttatttaaaatttcatagcatgttccatactctacaatttcacctgcatacataacagctattttatctgccatgcaagatacaactcccatactatgagtcacaactatcatccctgtattaaactcatttttaagtgatatcagttccctgacaacttgtgcctgaacagtcacatcaagagcacttgtaggttcatcacaaataagaagttttggtttcattatcattgccaatgcaatagcaactctttgattcatacctccactgagttcaaatgtatagctatccaaaatgcatttagcatcatttagatttaatttttttaataattcttcagcatatctaagacactctttcttattcatttttttatggacatttatcgcttctacaaattgttttcctatttttattaaaggattcatagttgatgccggattttgaaaaacaaaaccaatatccctaccccttattttttgaattttttcttctgataaatctgatatactcatgtggttaaatttcacatctccatgagttattttttcagtttctccagtcatttttgtaatagctctaagtagtgtactctttccacatccactttcacctataatcccaagtacttcaccttcatcaacttcaaaacttatattcttaagtatttttacattactgtttgtcacatttaaatttcttacttcaaataacatactcatatatttctccacggacaataattattcaacatttgtttcccagttaatttgataataatctgtctgatgaatatcaaaattaactacattacttttcattataaacttcattttcagatgagcaataaaatcaaatccattatcatcaatggtattttgtataatctttatagcaagattatctctcatctccttatccaattcactttccattaaatctaaaaatttttcagactcttcatttttatactgtccataatttgatgcaccactgcttcttacaagattatttaaatacgcatatgaatctcctgtaggtgcagttacatttgaatatagacaaatatcaaacttactattgtttaatatatccataatattatcacttacttctactgaaacatttattcctatatcctttaaatcactctgaattgcctgtgctaaaataggaagttctgctcttgaagaatatgtaataagttttagttccaatttttctgaatttttttctagtattccatcattatcattatcttcataaccagcatcttttagaattcttctagcctcatctgcattataatcatctacattaatactctttcctccacatttcattccttctggaaatggtccttttgcataagatgctgaatctttcaaaagcactgatgtatattcaggcttattaatagacatactaatagcttttcttaggtttttatcatttaaaaatttattctcataattatagtacatcaatatcatacgtgatgtatcaatactacttattttatatagtgattcatcttcaaacagactcactgaagaataaggaactccttgtgcaacatcaatttcaccagtctgcatagccattgtaagtgtatctgcatctgatacatgaattatctttatattatttagctttggctcacccttccaataatcattatatttatctaaataactagtatttttcaaattaaaacttccaatcttgaaaggtcccgttcctataggattattatcaaagtcttcagttgcgtccacattaataatagatgcaaagggatcacacaaatcatttataaaagttggattaacttcttttgtagtaattacaagttcccaatcctttacttctatattttctattttcaatgtatcctctgctcttttattcaaagctaaacttctttccaatgattttttaaccttctctggagtcatcatttcaccattatgaaattttatatctcttcttattttaatcagccatgtctcaccatctatattttcataatcctctgctagatttggaatgatattcataaacttatcgagtttaaataaagtttctgctataccatatcgtacagtaaaccatccattatattctttagcaggatctagacttttagttgctaaagttgttccaaatactagttcatcacttgatttccacaaagcattggaacatccgcaaaatatggtaaacactaaaattatcaatatacttatgatatacatacgtattctaattctcattttacttatctcctttgtccatttttaagaagttcacatattgtatcgcctaaaagattaaataaaatgacaactataagaatagctgttccaggaaataatgtaatccatggtgcagattgcagcatgcttttcccctcattcatcatagatccccactctggtattggaagtggtgaactcaatcctaaaaatgataatcctgcaagttccattatcataattccaacatctgctgatgctgttattactagtgctcctataatattaggaattatatgctttaaaataattttcagatttccgtttccacttaattttgcagctaatataaaagtttcactatttattgccattacttcacaccttgcaagtcttgaatatttgggccatgaaataagaccaattgctatcatcgcatttttaagtcctcctccaagaattcctgcaacagcaaccgctataataattcccggaaaagatagaaaaacatctacactccccatgattatttcatctacaattcctccataaaatccgcttattacacctattatagtacctcctgaaaaagtaattaaaactatagtcattgccgatataatagaattggaaattccatagagtactcttgaaaatatacaccttccaagagcatctgttccaaaccagaactctattgatggtgacttgagtgtattaaacaaatcagtcttatacggatcattaggtgctataactggagacataatacccacaataattattaatactaaaataattattattaacttaaatcttaactctacagatatttttttatcctttgctaacatattaatttctcctatttttaatagttcttgggtctaaaataccatatataaaatcaactattaaatttattattacaaatattattgcagtccacataacatatccctgaacaagagggtaatctctagctttaactgcatttaatgcaagacttccaaggcctggccatacaaatatattctcaactattgcagaaccacctaaaagggatcctactgaaagtcctattaatgttataactgtaataagaatatttctaaatacatgtctataaattattttccattgtggcacacctcttgaataagcaccttttacatagcccttatctaactcttccataacaacttctcttatctgtcttatatatctgctagacattgatattgccaaggtaacagatggcaatataatactttttattccactttcacttaaaacgggtaaaattcttaattttaatgcaaaaacaaataataatattaacccaacaaaaaagccaggaattgaatttcctataaatgtacatactctgataatataatctgtaagactattttttttaagtgcgcataatattcctagtggaatggatatcaataaagttattatcatagatgataaagttagcattattgtgtatggcatatgttcttttaactctgttacgacacttctttgtgttgaatatgattttcccatatctcctttaagtatattagaaacccaatatgcatactgttctgtaaaagacttattcagaccaagttcctctcttgtagtttctagtacttctgtacttactgatatcccctgactatttaacatcatttcagctggatcacttggggataaatacattaaagaaaatgatataaaagatactgctattattattaatatagctcttaaaaacctgtttattataaattttcctataattattcactcatttctcactttatttttaattgcaaatggtttgcattttctttataagtataaataatacttattcttatgtcaataataaagaaaaaatcgctgataaaaatatagtctcagcgatttcttaatatatactatctatttacttataaattttaactctaataaaaagttgtaagcatttattagatgttacttgttaattacaaaatctatttccatacttatatagttttatagatttagctcgccatatgcaatgatggactctcctttatttattgcaagagatactgtattatataaaactatgccttgaaactcagcataatatgtatcaataacatttccaaacaaatcaattacctcatataatttctgcccttgcactattctttcaccagcttttacaaacatttcaagacatccattttttaatgaatctatatatttcacattagttatttcaattggtgactgttcacttctaagtacatcaccttctaaaacacctaatcctcttaatgctattatcatatcttttttatacttttccacatcttctcttctacatatgccgcatcccccacgctcaataagaatacttggaattcctcttatggcagcagaattataagctccgcttgttgcatttgattttaccatgtagtctacattaaaaatctttgcaatttcttttgatctattgcatatttcatcttcacaaattcctggataatatacatatggatgaagttcttcatgaagatcgccaccatgcatatcaaaataaaaatcagctttatcttgaaactcatgagtaataacatatgcaattttatcacttatagttccatttttatcaccaggaaataccctattgatgtttttaccatcctccggtacaattcctgcacttttatctttaaatgcttgcatatttactggatgaattattattatctgtccattcacaatttccggatttatatcccttgcaagttctatagctgttcttatacaaggatactctcctccatgtatacctgctgttattagtactgttttaccttcatttttaccattaattatagtaaccggaatttttgtttctgtatctaaaatctttacatagtcctgtatttttccatagttttttagagtcaatccacaaattgaaaattcttttttcatcttttacctcgttcgcactgcttatatcgcaaattatattcaactgatatttattatcattaattttagataattttcttcattctgtcaataaaaaattaactttattaaaactaatgctttaataaaagaaattatgtaactgtctattttttgccaatacaaaatgttctagaacctgcttttcggttcttttcattattaagaacaaacctttttagataaattataataatattcagatataaaaattaaagatatttgtacattttttaaatttacaaatatcttatttactattggtactatgtatatatttctattagctctctatattgattttttatatttaagtacttgtccattgtgtctctacactgcttcatagcctcatctattatataatcataattatgtataaataaatccacaatattcctatctattttattattttcaaccatttcagttaatatgcaaactatttttgttttactaaaactttgtttataacttctgctacctattaatgcactaataatatctcctatagatactattctcatttcttttgttattttctcttcttttaaaccaaatggatatccgcttccatcaagtttttcatgatgtagtgttgctatatcccttatttcactcatactcaattcacttagaatatcatatcctatttgagaatgttttttcataatttcaaactcttcttccgtaagttttcctggtttctccaaaatctctactggaattgctatttttcctatatcatgaagaatagcacatatttttatcagtgatatcctttcttcagaaagtttgcacaatcttgcaagttgctcacttattgcttcaactgttattgtatgtattactgttgcttcacttctaaaatcaatcgcataagatatcattttactatagctcataactttttcctcattaatgaatctattcttaaaaaaatcatcgagttcatttatgtacgttccatcagataacttacttaaaaaattatatttttcatctgcctttttaaacaattcaaaatgctcttttagataatactttttaattttattgtaatcaatttttatattatttaaagttaatctatccaaataatctgcaaaactcaacataagaccttcataagaaagtacttccatattgcgttttctataataatccattgtaaaatgatgacttaacacaacatcataatattcagctaatggtgaaaaattctttataaataaagctccatatactgcatgattcactggagattccatatctgcatttagtaacttatctctttcagttactttatatgctcctatatcatgaaagattgagatgacacaaattttcaaaatttcttcatctgtatatttccctgacacttttaaaagattaaatattatataggaaactctattcccatgttctataaatcttccatcaatagaatttattgttttatttaatacttttattaattgatttgatgttatagttaaatcttcgccctttataaaaatcccctcttcctctaaaatatacacgcagattaattttatatagtagtatggtaatgttatcctatatatagttattgtactttttttatataattatgtctatattcatgaaaatttttttctttatatataaaaagtgctatacatcctatcttagaacgtatagcactttcttataacattaatttacttactaaattctattttccttcaatataagctttatcaaagtatatatatccaagtggtgatgccactaaatctttgatgtaactcttaacacccatagtttggtttttatagtataatggtataattggtaaatcagtcattaataaatcttctgcctgtctaaatatttcaagtctcttagcaggatctgtttctgattttacttgattaataagtttgtcatattctggattgttgtatcctgaattattttgacctgacgtactttggaacatatctaagaatgtcattggatcaacatagtcagcattccatccatctcttgcaagttcataatccttagcatttcttgttgcaataaatactttccattcttggctttgtaattgaatgtctattccaagattagttttccacatatcttgaactgcttgcattactgttccgttaccaccttctgggttataaagaagtgttgctgctgggaatccttcaccatcaggatatcctgcttctgctaataactttttagcttcttccacatttgctttagtatcaaagtattttttatctgaaaaatcttttccattgctatctttaattcctgttggaactaaactaaatgctgccactgatcctgatttaacaacatttgcagttaaagactctctgtcaatagcaagagttaacgcttttcttaccttagggttactcaaagcttttgctgcttctggatcaattgaatttaatgaatctgtcatattaactgataagtaataactgcttaataatgggaatgttgtagcacttccatcttgcactgctgcatcaacatctgattgtggcactgaataaaccatatcaaattgtcctgccttataactagcccaagctgaagtttcatcagcaaccattttaacattgatcttatcaagttttactgaatcttttccataataagtatcattcttttctaatactacttggtcttttattttataatctgtaagtttaaaaggtccattacttacataagttgcagcacttgttgaccattgatcatttccttcaacaacttttttgtctactgggaaatagcatgggaatgatgttaattctaagaagtaagcacatggtgatactaaagttacttctagtgttgagtcgtctatagcttttactccaacttcatcaactgatcctgttcctgctgtatattctttagcacccttaatgtattccatttgatatgcatattcagcagcagtgtttggatccattactcttttccatgcatattcaaaatctcctgctttaacaggatcaccatttgtccatttagcatcacttcttaaatggaatgtataaacttttccatcttcagaaatatcacatttttctgcaatacctggaatagctttttgattttcgtctaacttataaagaccttcaaacatgtttacaagtaatatagcaccatcaactgcttgatttaatgctggatccaaagtcttcacatctgatcctaaattaaatgttaattcttgtccgcttgctaccgttgatgaaccgctatttgaagaaccacatccagttaggactgaaactccaagcatagctgccataacaactgagcaaatctttttgattttgcttgttttcataatatattcccctatttatttagttaacagttatcatttaacagttaacagtttttagtatacttttaaatcatatagctgattttttatttaaaatcccattggaattttacttcttaatcatataagtgacaggcaacaaaatgtccatcttcaacttccttaagcacaggatctacttcagagcaaattggttttgcacatttacatcttcctttaaatctacatcctggtggaggatctataggcgatggaatgtctccttcaagtactattctctcactgttttttgcaatttctggatcaggaataggtacagctgataaaagtgcttgtgtatatggatgtttaggattgctgtaaacttcattacttccacccttttcaaccatctgaccaagatacataaccccaatatgagtagatatatgcttaaccatagaaaggtcatgagcaataaacagataagttaatccaagttcttcttgcaattcttcaagcatgtttataacttgtgcctgaatcgaaacatcaagtgcagaaataggttcatcacatactatgaaatctggctcaacagctaatgctcttgcaataccaattctctgtctctgaccacctgaaaattcatgaggatatctatttatatgatcactcataagacctactttagataacagacttcttatcctttgtgttctttcttcacctgtaagaagtttatgtacatcaatagcttctcctataatatctccaactgtcattctaggatctaatgaagcatacggatcttgaaatatcatctgcattttttttcttaatgataccatttccttacttgaatattttgtgatatccttcccattaaagattatttgtccacttgttggttcataaagctttaatatggttctacctgtagtagtcttcccacaacccgattcacctacaagacctaaagtttctcctctttttaatgtaaaagaaactttatctactgcttttacataactattatttttaaataatcctttttttgcagggaagtatttacatagatcttttacttctaaaataatgtcatttttcttatcttccactacttatccctccttataggtgattcaacctttggtgcatccttatgacatagccagcatgcagttttatgattttcaccattttcaaataatggtggctgtttttgtagacatattttcattgcatgttcacatcttgctgcaaatgcacatcctgtcggaggctttagtaagtctggtggctgtccttcaattggttttaacttttcttttgtattttcctttggatttggtacgcttcttaaaagtccccatgtatatggatgtcttcctctatagaatatatcttctgtagtacctgtttcaattattgtcccaccgtacattacattaattctactacaaaggtcagcaacaacacctaaatcatgagttataagtattattgatgtattaagcttttcttttaaatccttcataagatcaagaatttgtgcttgtattgtaacatctaaagctgttgtaggttcatctgcaataataagttttggtttacatattaaactcatagctatcattgctctctgtctcataccacctgaaaattcatgaggatattgtttcattcttttttcaggacttggtattcctacaagagaaagcatttctattgcttcctttttagcttctgctctgcttatttttttatgtttaagtattggttccataagctggtctccaattgtataaactggatttaatgatgtcattggatcttggaatatcatcccgatatcatttcctcttatgccttccattacagattctttaacattagaaatatcttttccatcaaaatgtatttctccgcctgttaatttaccattatcagcaagaagtctcattattgacatcatggtaacacttttaccgcatcctgactctccaacaatccctaaagcttcacctttatctaaatgaaaagatactcctcttaccgcttgtacttccccaacattagttttaaatgaagtttttaaatcttttacctctaataacttttccattttccttttctcctatctcttattcttaggatctaaagcatcgtttaatccatcaccaaaaaggttgaatgataatataattagacaaatcattactgctgggaataataattgccatggatatgtgtaaatagctttcatagcttcatttgcaagtgttccaagtgatgctttaggcggtacaagaccaagtcctatgaagcttaggaatgcttctgtaaatactgcttctggtattaacaatgttaaagtaaccattattgaccccatacagtttggtattaaatgtcttattaatattctaaaattcgatgctcctaaagctttagatgcaagtacaaattcctgttgttttaattgaagaacatcacctcttacaattctcgccattccaatccaatacgaaattgaaagtgctaaaattatagttgcgagaccgcttccagagcttccaggttttctcaatatagccatgaatattattacgtatatagttaatggaattgaatagattacatcaactattctcattaatattgcatcgacttttccaccaaaatatcctgcaattccaccatataaaactccgataacaagattaataaatgcagctacaattgcaattgtaagagaatatcgtgctccatagaatactcttacaaaaatatctcttccaagctgatcagttccaaataaatgttctgcacttggttttaaattagtcatacttaaattatttgctgcataatcatactgagaaaacattggtacaattatagcagataagataattattataaccatgaacaacgatcctaaagcaaccttattactttttaatctcatccatgcatctttccaataactgatgcttggtcttacgactacatctattttcttttcttcatcagttagaggagtaaatagttctctatcaatacttaaattttcttccattttccgctcccctaactttcagcattttctaattttattcttggatcaataacaacatataatacatctactaagaagttaaatgtgataagcattgtacagtagaatactgtaactccaagaagcattgaataatctctattagtaacagattgtacaaattcatttccaagacctggaatggcaaaaatctgttctactataaagcttcctgtaagtatacttgcaattagtggtccaacatatgttactattggaattaatgaatttctaagagcatgtttgaaaactatctttcctttacttaacccttttgccttagctgttcttatataatcagatttaagtacatctaaaagcttatttcttgtaagtctagttataaatgccatagaagacattgataatgcaattaccggcattatataattcttccatccactaaatcccgttggaggcaacaatccaaactttacggctaagaagtagataagtactgcactaataacaaaacttggaattgtaatacctagtgttacaacaaacactattgtagtatctgcccaagtatttctttttaaagccgctacaattcctaaagatatacctacaactattgatgtagcaacactacacatccctacttttgcagatgctggaaatgaagtctttatagtttcacttactcctcttcccttaaatatcattgactcacctaaatcaccatgaactaaattcttcatgtacataaaatattgttcactaagtggtttgtccattccatacttagcttccatattagcttttacttgtggtgtaagcttatcactatcaaatggtccacctggcattaatctcattagaaaaaatgtcagtgtaataactacccatatagttagcaaacttgcaacaagtctctttcctatgtatttaatcatttcaatctccctcacttatatttcgatatttatcaacaaggtatacttattaaatcattatataagaatataatttattgtcaatttattataaaatttcaagctattactttatagctttatttttaacattttattaattttatactagtgtatttctattttattttattttcctcattttgtaattgtttacacttaaaaaatagtatcttttttaaaaatacatctgtcttcccagagaaaacacttatcggttataattagtttattgtttatttttctttaaattcctattttaaagttttaactttttatataaaatattaatttttcatacaaaaagcattataattgattttttaatattaatatgagatattttttattaaaactttatttttttaatatttttaataaaatactaatattttactctttataaaaaaactaacaaataaagagaattcaaatttgaattctctttatttatatttaatatacaattgttactattaaacttcattctacttttagtttttaaaattatctcctataaatttttctaacctatcaaaagcttcttttaaaatttcatcagaatagcaatatgatattctcatataaccttctccaaaatctccaaaagcatttcctggaacaaatccaacttttccttcgttcaaaagcctttcgcaaaattcttctgaagatatattaaactttttaatactaggaaaaatataaaaggcacctttcggatctacaacatcaatatttaattcttttaatctttttatacaataattctttcttctttcaaatgactctttcatcttttcaacatcttccattgctttttttaagccttcaagagcaccatactgagcaattgaaggtgcacatgatactccatattggtgtaccttcattatttctttcatatatatatctgagcatgcaacataccctattcttaaacctgtcattgaaaacatttttgaaaaaccacctacaaaaataactttatctcttatactatcacactgagcaactgaataatattcatcaaaaataatagaagcatacatttcatcagttatcacagttatttctctttcttttattatttctataagttcatctcgctgatcctttgttagtattgctcctgtaggatttgaaggaaaagataacattaagtatctaatatcttcagtatctaatttattttttatttcatcaatattaattgtgaaatcatcatttaatctataatggacaacatctgcacctatcattgtagatatattttcataagctggataagctggacctggtatcaaaattttatctcctgtattcattaatgcaaaaaatacagaaaatagtccttcacttccaccaacagtaatacatacctcgtctttattatactttatattaaaatttcttaaatatgtacatatttcttctcttaactcgtcaattcctgcatttgaagtatatgatgttttatttgtttcaactgcatttatcattccacttgcaacagcaattggtacattaaaatcaggctggcctattgtaagagaaattgcaccttcaactttctttactttttctgcaaatcttcttattcctgaaatttgaattttttctactcttttattcatatatatgaacccccaactttttcagttaacagttaacggttaacagttaacaattttattttttaaatatgccgctaatttatttaaagcttgttatattgtatgaactctattttacaatataattttgattacatcaaattgttcatattgaactattttatccatatacaaaaatgtacatatattttgtaaaactttctatttttgctctttcaattgttgatgttttttattataattaaatagattacaaatgtatagagaaaggatgatataatgtcatataatttaacagatccttatgaaatagcaagatttattaaggaatcaaaaaaatctactccagtaaaagtatatgttaatggagatttaagcagcgctgaaatgaatgatgtagaatggtatggatctaatggtttctatttattaatgggagaatccgattctataactaaaatagtattagataataaacatcttataaaacacttcagaatagaaaatgatagaagaaactctgcaattcctatgttagatctacttgaagtagatgcaagaattgagccaggtgctattataagagacaaggttacaattggtaaaaatgctgttgtaatgatgggagctgtaatcaacattggtgcagaaatcggtgatggaactatggttgatatgaacgctgtagttggtgcaagaggtcagcttggaaaaaatgttcacttaggtgcaggtgcagttgttgcaggtgttttagagccaccaagcaaagagccatgtcaaattggagataatgctctaattggagctaactctgtaatacttgaaggtgttaaaattggaaaaggttcagttgttgctgcaggctctgtagtaactgaagatgttccagatggagttgttgttgcaggttcaccagcaaagataatcaaacaagttgatgacaagacaaaagacaaaactcaacttttagatgatttaagaaagtaatttctatatcaaatagtattctaatttttacatataaaagtctgatagaattaatatttttattctatcagacttttttatataatgacttttttaatttaaataataattaaatttcacatcacttattcttttcataacttatagtatctactaatatatatgaagtattagcaggtaaagttattttatttcctttaactttctctatttcatctacccctgctttatctttatttacaattaatgtccaatcatccattggtaaagttacgtcaacatctttatcacttgcattaaacattactgcaatattaccccaattatcacctaccgcagcaccatttaaaatatatgctactacattattcccattaaaatctttaccattttctaaaaatttcaaattattttgaatatcttcttcagaattcattctaaatgctttgtgattatttcttaaatttaacagacctttataatattcatataaattattataactttttaatctattccaatctaatttattcactgtatctgaagagttatagctattatcaattaaattaccatgttcatcacatttacttcttgcaaattcttctcctgcctgcataaaaggtattccttgagatgtatacacaatagctgctgcaagtttatacatatctaatttttcgccttcactagcattaggttcaactttttgcaatctatcataaagtgtataattatcatgacatgtaacataagttattgtttgatatggctcattagcccaaggttcctttgaataattcactttgtcataatcaatatcaccatgctctgtagatgcaactattccaaatttaattgtatcttcaaacccttcttgtccatttataaatcctggtgcattttcagtaaaaacatgaccttttaatccatctcttaaatcatcgctaaacattccaatttgtgatgttccaaagtccttgcaatttgcttttattgctttttgttcatctggaagctctgatgttccacctgtccatccttctccatacattaatatagctggatcaatcttatctagttcagatcttattttgttcatagtttctatatcatatacacccatcaaatcaaatctaaaaccatccatgtgatattcagttacccagtacttcaatgaatctacaataaactttcttaccatatatctctctgttgcaacctcatttccacaacctgatccatttgtaaaatttccatcactatcatgtctataatagtaatcaggaacagctttttggaaagatgaatcttctgcagaaaaagtatgattataaaccacatccataataactttgattccattcttatgcaattcatttatcatttttttcaattcttgtattctaatttttccatcataaggatttgttgaatatgatccttctggtacattatagttcttaggatcataccccaattgtattgactattattttcttttgtttcatctacagttgcataatcatacataggtaaaatttgcactgtatttactccaagttcctttaaatgatcaattcctgttttaatatcacttccaggcaacactgtatttttttgccacacaccattatatttacctctatattctaatgaagcaccactattttcatctattgaaaaatccctaatatgcatttcatatataactgcatctgttggtgaattaagtactggtctcttatcttcattccagccttcaggatttgtagtacttaaatttataaccattcctctatttccatttaccccaactgcttttgcataaggatctacaacttctttttcttgaccatcaacactaactaaataattgtaatataccccatccaaatttccagcttcttcatatgtccattctccttgatttcctttagccatatcaattattttttgaggtgcacttaaataatccttaccatctttaccgtataagataacctttacatccattgctgttggtgcccataatataaacttcgttttatatggagaatatattgctccaagatctccattatacttatacaactcttcaaatgttttagttccaagtatatttccataactagaatttaaactttcataattaggtatttctaatgtataagtactatttaaatttatacaatctctcataaatatttttccaccaagattatcactatttaatcctatcttatatctacttcctgaaatacttacaccattttcttttaatactatatcattataatctttaatttcagaattaactttaaatgtcatttcattcaatgaatctaatttaaaatatgttattttaggatttcttattggttgatccttataataatatacattgggatcattttgaagaatataagcattaatttctcctttattgtttgcatatgctaaattaatttttctttcattagctatatcattttttataataaaagatatatccttagatccattaatattttctttagtaatatcaactacttttccatagtcatctgtatctttaaaatcgtaatcttgcttgtctccttcattaacccaaccttctgttgaagatgcttcataatcacctttatatctgtaatagtgtagttttaaattaactttagcaaaatctgtattcaatactttatcttctctatttattccagaatccttttcactaatggtaatctcaacatttccattttgcaaatctactttttcatcttctgtggccttttcctgccaatcacctttacgaattataaaattcaaggattctgattcttttgttgtttcaaccactgcaaactttccttcatcatcttctccagaaaaatttacttgctttccctccttgtttttctcccatacccaaagattccaattattataatcagaatcttttttacaatatcttatctttacgtataccttattagattcctctgccgcttttgcacatttttctggtatcggtaccaaaaataagcttattaatactactaatattagtgctaatgatttttttatttttcccatattaaccctcctgcataaattctttacttattaagtatattatgtaaacgtatttttatcaagtttaatataaaaaaatcgccaaagccactatgttatatcacataattataaagttaactctattaaaattaataaagaataacaaaaggatttctttcagttatatttccaaaagaaatccttttatttaacacagatttgatttcgtgtatatttttgattaattattgaccattgataattctatagccttttcataagtatatctattataattaatcattagtactacagaaagctatacagctccttctgtgccatcaatattagattcattttcttctttttgagccttttccatcttggatattgatacttcataagctattttctttataacttcattttctgaaactttcttttgatattctctactttgtagtctaccccatactttaatattatcaccgacttctaatgtctgacaaaatctcgaatttctaccccatgcaattgttggaatataatctgacttattgtatgctctgtttactgcaagtaatacatctgcaatctcacgaccaaaaggtgttgtcctataaataggttctttacagatatatccatctaagaatatttcattaggatttttgctacgttccatgcatggttcaatatttctcgcaaaaactgtaagtataagcttgtttgacccatcaataaacttgttatacgatctaagctgaccttcgacaattacatcactgcctattattagctgcatatcgcttaacaatctttctgatacagtaatatttaaagtatctactgagtcacttaatctcattacatctaaattaaaagtataaaacccctccccatacatctcgtggctaaactctaattcagacgttactttaccttctaggtaaatcttgttatttagcattaaattatccattgttatccctctctccatcggaaattattattaattcatataatatatgcacccactagcatatattaccattataatacagaaactagtttattttcaataattttagatatttttatgttgaataccttgttcatctatagtgtaatcgtttttatatatcatctccccaacaggtttaaatacatatccctgtttttgaagctcattaattattttttctaaattttctggagtatattttgcattattatgaaataacataattgaaccaggtttaaccttcttcataaccctgttatactccacatctgcaccaagttccttccagtcaactgaatctgtatcccactgtatacaggtatatcccaatcccctgaccttttcaaaacaatctttattatattcgccacttggaaatctaaaaagttctggtttctttccagtatatttttctataatatcgtctgtcttttttaattcctccttcattttctcaaaggttattttagtaaaaccaggatgcatataactatgatttcctatttcattcccccttttattaatttcaattaatttatttatgttgtcctcactataattgacccaccctcccattatgaagaatgttccttttacattatacttatctaatatgttcaatatgctttctaaattatctttttctgcccagttaatatcaaatgtaagacttacagttttttctgctgtatctacagaataaataggctgttcttcctttatgtctcccataacagaatgaatattatcatttatggtaaatgataatattatcactgcaatgattaaacctatatctatagctatttttctaaatctccatgccaaaataatacctcccctagttcactccagtaaatattacgttactgttttattattaactatattcactaatcgttaatttatgctataatgaaattagagtttcattagtcatggaggtaattatgtacgaaagttcatcagaattagcagaaaataaactactcatgttatatgtattgaaggcaataaaagaaccaatatcaaatactcagcttacagaaataattcttgaaaataattttataaattactttacatttcaacaatatttatctgagctagaggaagcaaaatttgttgaatatcataaggctaatgacaaaaatctattgatattaacaaaacatggtgataccgttctatccttgttcaaatctagattatcaccagctaaaatagcaattattgatcaatacataaaaaacaaaattgagtctataaaaaaagaattaactattcatgctgattatactttaggtgataatgacagctttattgtcgatttaaaagctgttgaaaaccaagctttattaatggagttaaaactatctgtaccatctaaaaatcaagctgtagctatatgcaataaatggaaggataatccttccgatatatataatacaattataaatacatttataaattaatatgtgtaaaatctgatatttttcaaattgctgaataatgtctgaaaataacagttaatcaactaaagtcatggcatttggctctttcccaactgctatggcttttgcttgttttgtttttagatttattacatttacaactccatttaggtagtctgccacaaatatcttttcgttaaatttaattattccacgtggcataccagtaatatctactcttttttcttcctttaagatttttaaattaacaatgcttattgattgtccacaaaaattagacacatataaataatcattatcttcaaataaatccactggtgaaaatcctactctgattttgtaaacaagttctaatgattctaatgatattatgcctacataaccatccttgtcatatccaagataactcatgcatacatataagtaatgattattctttgacaattttatctttataggagtgttttccaaagaaattctttttatctctttattgctttgtatatcaattacagaaatactatcatctcccatattgcttacaaaagcagatctttcattttcatataattcaatattatggggaaatcttcctacaggaatattaatattaattttttcctcttccaaatcatacataataacagaattggattcaccacatgttacaaaagcattattattatattgaataacatcatttggatgagcacctatatacaaatttttccctttagtgatgaactttcttttattcttatcaataccattccacttgttacttttcttcttttcttcaaattgtaatttaggaataattgaaatagtattattataattatttgctgtaataatattgtcattatataaagttatttcatgaggtccaaaatttctctcattaccagataaaatataattttctatttctaatgattctgtttcaattttgcttattatatcagacccagtattacaaagaataatataactcatctctttgcctccacataaaaataatcctattgtattattaatatattcttccttttaattaatggtacaagtaattgcactgaatctctttatttattgacaaatttctactataatataatacataaagcttataatagcctaatttgcgtcttaggaaatataataagaaataataagtctaactataatgcagacctattagctttttattttttatagtgcctaagtgaaaggagtaatatgatgtattcatataaaacgtctggtgtatgttcttcaactattaatatagatatagaagataacatagttaaaagtgtagagttcgttggaggatgcgcaggaaaccttttaggtataggtagccttgttaaaggaatgactgtagatgaagtaatagctaaattacatggtattgactgcagaaacagaggaacttcatgtcctgatcaattatctaaggcattgactgcttggaaagaaaatcactaaaattagagctttaaaataggtatttcacttattttaaagctctaatattttataatatactattgaataaattcatttacatcatctgataacagcattaaagtatctcctatttcatccaccacatctctataactcattaccacacctatagaaatttcttcatagttatcactgattttttctactattccataaaaatatttaccattatcaattaaattttttattatttcccctaaatttataggtatcgttccaataacaagacctttatctgttgtaaccaatattacattcgaattatccaagttatcagaatctcttattaagtagaccatatcgtcttctttaagcttgttaaataactctgagcgatcgtaagtattattattctcaatattgactgatattaaatatatatctttaacatgaattgtcatatcactgaaattatccacattcactatctttttctctcttttataatcatcagctaataatgaattcaaagctcttcgcacactgcttacagattcagagataattgaattttttatatattctatttcctttaaatcaaattttcctttaaacttctcaaggtttgaagaagcttgaattcttgtttcaattaatggagattttattgctcttagattaaattccttatattcatctgcaaaatcttcataattcatatacttactcattataaaaaagcatacatgttgaatatcttcatattttaatttatctattgtaaattctcctggtcctgaactaagttcacttacacttaaatttttcattgcaatgttatatgcacattttttaatatttttatttccaactgaaaaagcatatttatatagtaatgcattttcataatctcgcctaaacaaaatttcaaaatctttctttttaattttatatcctattttttctgcgcatgttattaaaatgctagtctctaattctatgtttgttagttcattttcaactacggtcttccaatgttcttttttacatatctttttgcacatgtctataatattcttatatttattatacaaagatatctgaaggtttattttcttttctttataataatcaattaaatctgcttccaatgaatataatattgagattgttacatacaatgaataaatatcagctgcattttcatttatttcttctaaaagtttctcacaaacacttacttcatctcttatttccttaacaccataatctgaaaacatgatactaaatgattttgataagttttcaattttttctttagaaaaagtagtcttattcatataatcaagaatgtctatagaaagcatacttaagcatactaattcagttatagcaacattattgttgcatccttcttcaatcatccagtcagaaatttcataatttacaggtttcaagtgcaaaatagaaaagaattttccataaccttttgatttttttgctatttcaaaaaattcattattagataatccaatatgctcgtaaccattcaaaacatagaataaatattcgttatgaatttcatatatttttagtatttcttcaatattattgattttaattatatatgctcctataagcgctccctttattaattctttggaattacttttagttataattttatatattaaattctcaatatatattttattgttttcatattcgtaaatacacttaaataacttttctaaattttcataataatttattacaggatttaaagttacatatccctcaagaaccgtaacttcttctttatcttgtgcaatatctaaaaatatccttataaaatcatctgcaagcctatttttttcataaacttttaaatcattaattttgtgtgatgacatattaaattctttaaccccagatttttcaaagtcctgatagctatagagttcaccattattgttataataaaattctttaagttcatcaaatacacatctatcttcaaaatctttaaccatataactccccaaccccttttctcacaagactatatctatatattaccatattaatttattattttattaattatttttctcatatcaccaatcatatatagtgaaccacttacaagtatcaaatcatcatcttctgccacttttagtgcttcattaattgcctcattataatcatcaaaagcttcaacattttggtttactttctctatttccctctttaaatcttcactgagctccgctctatcactatgaggtgttaatgcaaatattttttcagccataggtgttatttctttaatcatctcatcaacctgtttatctgctaatataccaagaagaagatacatcttattgtatttaaagtattttctgatattgtttttcaatactcttattccatcaatattatgtgctccatctattactattaatggctttctatttaacgtttcaagtcttcctatccattttacatcttttaatgactcttctataatttctttattatattgaattttttctacttggcataaaacttccactgcttttattgctacgcataaattaagaatctgatgttctccaagtaaaggaagatcaacattataaatcccatttaatccattgacctgtacattttgagttatattatcataatcaattcccttaagatttccatcatctgttttcacataataaaccttactattattattatgtgcagcttttaaaattacatcttctgcttcttttttttgaggatataatataactggtacatcctctttaattatacctgacttttcttttgctatttcttcaattgtatttcctagaatatttatatgatccatacttattgatgttattacactaactttaggtattattacatttgtagaatcaagccttccaccaagccctacttctattactccataatctattttttcattataaaaatataaaaacattaatgcagttataatttcaaattcagtaggatgttcatatccttcttcaattactttgcttacagcatatttaacattttctaaattatctataagcttatctttaggaatattgacaccattaatctgtattctttcttcaaacacttcaagatatggagatgtatacattcctactttgaatcccattccaattaaaactttgcttatcattgatgttgtagaaccttttccattagttcctgctatatgtattaatttcaatttattttgaggactaccaagcagttctaataacctgtgtgttcgttctaatccataattcgagccaaacattccaacattgcttatatattccattgcttcttcatacgtcattttcatttgatttacctcttcttctcttatttgctaagtaaattctatatttattagtatatacttcaataatactattattatagcagaattacccttaaatttcttaatattaattaacttttagagtacttacaattatagaaagaaggattgtaaaaataaagtctagtattttataaatactaaactttataataaatgactcctttaaagtcaaattattcatgtgatatatgttatacaaattataattataaagttatatataaactttataaactagcaagtaaaactccaaatttcattatatccaataactatttatttccacgatataatgtacttcttttagctctattagtattatcaaaaataagagatgctaaaatacttaatagtaaaattataattattatcaatactgaattagtaactgaaatctcaattccaaaaaataatgctacaagcttccatcctgtgaacatcaaaataattccaactccatatttcataaatttaaacatatcattcattctctctaaaatataatacatacttctaaggcctaatatagcaaatatatttgatgtataaactataaatgtatccgttgttattgaaaatattgcaggtattgaatcaatagcaaatagtacatctgaaaattcaattactacaagaacagctaatagtggagtagcatataaaatcttgttttttctcacaaaaaatttactgccctcaaagttttctgtaactggaataaatttttttaacatctttattgcaaaattattgtgaaattcaatattatcattattatgattaaaaagcatttttattccactatataataatactattccaaaaaaagataatatagaatgaaattgacttataatactaactcctaaaagtataaatataagtcttaaaaccatagcccccaaaactccatataataggactctttcttgatactcttctttaatatgaaaattagaaaaaatcattaaaaacaaaaataaattgtctagactcagtgacatttcaactatgtatcctccgaaatattccaccgcacatgtttctccacgactataaaatatataaatgttaaataatattgataaagtaatccaaaatatcagatttaaaaaatgctttttagctttcacttctcatatacctccagaatttattaacataatacatatatattaatatttattctgtaatatcctttatattaaaaaattttaatataaaaatcccaatacctataaaaatgggtattgggatttttactatttatatttttagtttaatgcttctattctaaccttaacagcttctagcatttcaacatatttaactctcttttctttttctgcattaactacagattcaggtgctttagctacgaacccttgatttccaagcttcttatcaattctttcgatttcaccttctaatttcttaacttctttatttaatctatcaagttccttttctttatctactaaatcaagaagtggcataaacaattctccacccttaacaactagagatacagcatttgctggaacagatgatttatccgtaataaattcaacttctgaagctgaagctaatttttccatgtatgctgcaccatttgtaaatgcttctttagcatcttctgctatataagctataaccttagcttttcttgaaggtggtacattcatttcagctcttacatttcttaatcctttaattgcttctataacatatgccatattatcttctgcttctttattaactaaagcttcatcaaattctggccatgcagcatttactattgtttcttcttcagttaaatgagtatatatttcttctgttatgaatggcattgctggatgtaataattttaatcctgttactaaaacagtatttaatacattataagctacgcccttagctttttcatcttcaccatagaatactggttttataagttctatataccagtcacagaattctgtccacatgaaatcataaacttttgacattgcaattccaagttcatatttttccatattttcagtaacttctttaactaatgtattcatttctgataatatccacttatcagctaatgaatattctctgcagtctttatatttgttcatgatttctttatcaagattcatcataacaaatcttgaagcattccatatcttgttagcaaagtttcttgatgattcaactctttctggatagtatctcatatcatttcctggagcatttccagttgcaatcatgaatcttaatgcatcggcaccatactgatctataacttcaagaggatcaacaccatttcctaaagatttactcatctttcttccttgagaatctctgataagtccatggattaatacagtgtggaatggagtttctcccatacagtgtaatcctgagaatatcattctagcaacccagaagaatattatatcatgtccagtaactaatacactgtttggatagaaataatctaagtcttctgtcttgtttggccaacctaatgttgagaaaggccataatgctgaagagaaccatgtatcaagaacgtcattatcttgctcaacatttgtactaccacatttagtacattttgatggagcatcttcaagaaccatcatttcaccacaatcctgacagtagtaaactggaattctgtgtccccaccataattgtctagaaatacaccaatcttgaatgttttccatccagttaaaataagttttatcgaatctttctggaacaaacttagtttcaccatttttaacaacttctacagctggtttagctaattgatccattttaacataccattgtttagatattattggttctactgtagtaccacatctatcatgtgtaccaacattatgagcatgatctttaatcttaactaaaagcccagcttcttctaagtccttaacaatagcttttctagcttcatatctatcaagacctttatattttccgcccttttcgttaattattcccttatcatccataactctgattatttcaaggttgtgtctctttcctacttcaaagtcattaggatcgtgagctggagtcattttaacggcacctgttccgaattctaagtctacataatcatctccaactataggaatttcacgattaacaagaggtaatattacagtttttcctattaaatgtttatatctttcatcattagggttaacagcaacaccactatctcctagtaatgtttcaggtcttgttgtagcaatttcaagatatcctgatccatcagctaatggatagtttatatgccagaaatgacctgcttgttcttcatattcaatttctgcatcagataaagcagtctgacagtgtgtacaccagttagtaattctatttccttgataaattaagccttcattatataattttacaaatacatgttttacagcagcgcttaagttttcatccattgtaaaagcttctcttgtaaaatcagcagaaactccaagtttcttaacttgatttcttattgtagctctgtatttatcactccattcccacactttttcaaggaatgcttctctccccatttcttttttatcataaccttgctcagaaagcatattagcaaccttaacttctgttgcaatagaagcatgatcttcacctggtaaccataatgtacagtaaccttgcattctcttaaatcttataagtatatcttgaagtgtatcatcaaatgcatgacctaagtgaagttgacctgttatatttggtggcggcattactattgtaaatggttttttactcttatctacttctggtgtaaaatattttttttcttcccatgtcttataaattctgtcttcaaattcttttggatcatatgtagttgatatgtttttaatttctgacatttttatttcctccaaacttattcaattgacaattgacaattgacaattgacagttgttgatgatatttctttgaaatatctttaatttttattgttcactgttcattgtctattatcatatgtaaattgaagtaattctattattaaaattcctatggaatcttttttacctttattaatatatctatatataaaaaaagagccctaatcctaaaaaggacgaagactcgcgttaccacctttatttccacgtaaacatataaaataaatatgttctaatggactcttaattcaaataacgatttagataaccgtctttagctacttacattcactaaagaagctcaaaagctaccttcaaaattctccacataagggttttcagctcctccctctctcttataatgcttataaatttctactcctctttatcattgcttttatattaataatttattttcatttttatgatatattaatcattgtattttgtcaataatttatataatttctcaccttatatcgtataataatattgcagtttcattatgacataattgtaaaaaactttagaaggatgtgactaaatgaaaatattaattatgaaaataacacttcgtgcaccttgggttcattcattaaaagaaaagagaatgattgtaagaagcttaattcagaaactaaaaaacaaatttaacatttcagtagctgaagttgaaaatcaagatattcattccacaatagatattggtattgcaggtctggctggaaacagcgcacaggctgattctatcatggaacatataataacatttgtagaaaacaatacagatgcagaaatagtgcaaattgaaaaagacgaggatattttttaaaaattatcccgccttttatttattatttttaattaactactcaaagactcaatgtcaaattttcacctataataatgcacttagaatcttttccatggccaatttcattagtctttataattggcatactctggtcatttactatacttgtaacaatatcaactattgttggtgaataattttctctttccatttcagtatagcttcctagtattataccattgaccttctcaaaaatccccatatgtttatattgtgtaagataagaaaccattttaggtacatcaccgctaaaactttccaagaataaaagtttatccttaaaatcaggcatatattctgttcccgcaagttttagaaaacatcttatatttcctccaacgactataccactcataaaatttccctgaatccattcatattcaaaattcaatattgacctcttatcatcaataaaagtatctttaaaatttttgatttgttctattttattactatctaccaagtttcttatttgatataaatagtttttttgatttgtctttgaatataaagcatttactacaactgttaaatcactatatccaaaatatggtttataatttttatttatatcattaaaatctagatattctaaaatttcgttagataaatctcctcctgaaacatcaaatattgccttaacctcattatgtctataatattttaaaagtacatcagctctttctttcccagtaccattaaaggctgaatatttcttataaactttatcactaattattgtttttaaacctatttcatttaaaataattactagttcttcaatcttaggtttcattttttcatctagtccattagaacaagctactattgctacagtatctcctattgataatattgccatgtttattctccttcattttatctttattgtttttataacttatcattactattattattataaaaaaatcttttcatccataaccttaaaattcttatctataaaaggtttaaaatccatttgattgattatatctttctcaatatctatacctggtgcagcttctgttaaatatataccatcctcttttagtttgaatacagctctttctgtaatataaattacttcttgcccatatttttttgccttttccccgctgaaagtaatctgctgaacttttgtcttaaacttcttatttttaccttcattttctataaacatctttccatgtcttatatttatttcaagacctttagctgtaaaagtcccacaaaaaataattttttttgtattttgagttatgtttataaaacctccacatccagctagtctagtgccaaatttacttacatttatattacccattttatcacattctgccattcctaaaaaagcgatatcaagaccacctccatcataaaaatcaaattgacttatttggtctaatatacattctgcttttaaagatgctccaaaacccttgccactttgtggtattcctcctattggtcccggctccactgttaaagtaatcatcttagaaaagccattctcataagctatacttgaaacttcttctggtatgcctattcctatatttacaatatcacctttactaagctccatagcagctcgccttccaattatttttctagcatctaaagtgtttttttcactttttaattgactttttctattttcctctctttcttcaaaagcaaaatctgttttattcttctcatattctgctgtcaaaaaaggattgtattccaatcctaatacctgttctttattatctttatctaaaacttccacaatataatcaacatagattttaggaattttaacacttttacacttcatttcatttttagacactactttatcaacttgaactattacaattcctccagaattcttaactgcctgtgctattaaaaatgcttctgaatatgttgcctcattatctaatgaaatatttccattttcatcacaataacttccttttattagcgcaatatctatcttttgatgatgatataataaaaattcttctccattaaatttaaatagctcaactattttttctttacttatagaattaacttttcccccttctattcttggatcaacaaaagtcccaagaccaaccttgcttagggtaaatccagactttctagatatgtctctaaatatattacacataactccctgtggcagattataaccttcaataatattattattcatcatttctgcaagctttggtgcaagattaaaatgtccccctataactcttttgacaagtcctttatgagctaaatgatttaaacctttacttttaccatctccttgtgcagcagcaaacattagtgtgagattattgggatacccttcttcaatatatctttcttctaatgttttaagtaaactttctggaactgctagtcccgcaaaaccagaaacagcaacaacatcattattttttaataataatacagcttctttacaatcaataaactttatcatttttatccctcttttataattaatactatttttaacatatctttattatctctaataattttttataaaataaaaatcaatgatatgtgtttttacactaatcattgattttctctaatactctatcattgatttttatttaattaatctattctactataaacttttaaatatactttatatgtgattattgcgcccttaccattgacttttatttcatgatttaatttcctcaatatctaatctatttggttctctaaaattgttcaaaagtaatactttatagtatatttctgcaacatcttctacatatctagcctttgttaaaatttcatcaattttttcacttgttattacaacaccatgtctttctagaagacatacatcatttttacttaatggtcctattacacttttagctaactctatagtctgagctttttcgtaaggtgcaacatatatataacctccatagtgtcttgaatctgcaactattggaggaataactttgtttgcaactgcaaatatagttgcatataaagaatgtgcatacataacagcttttacgtcctttttttgattgtatatttcaagatgcagaagaatttcactacttggatttttattattttcaacttctattgtttttccgtccatatctactatacaaatgttttcaggtttcaagtcacttctgctaacttgagaaggtgtaattaaaatatatcctgtagtagaatctttaatactaaaacttcctgttttctctttacataatccatacttctctgcttcttgagctatttttaccaacttaattctaagattttctagcaaatacaccgcccccttaaaatatatatattaaattattgtttgttatttttttatcaatccaatttataataaaatcatataatatagattttctataatcttaatgtattatatgatatatatatattttatgacactaaaatttagtacatatttatttaatttcattaataagtaataataaaaaactcttgaaaaatattcaagagttttctatattaatctttaaaggttattttaagttagatagcttttaatgctacagtatttaataaactccaaggcttgttaaagtgaggctggaagaagaaatctgtcattgctaattcttcaactgtcatttcattttgtattactacagatagagtattcatatactgagtcaaatcaacatttgaacatatttgtcctcctattacttttctactatccttatcaaatactaactttatagttgcaggttcaaaagtaggcataaattctggtctataattatcagttatagtaacacttcctgcatttatatttgttgttattttagccccttcttctgttaatcctgttgaagctatacatttatcatatattttaattcctgaagttccttgtgtccccatatacttaagtgttggcttaacaagattcttagcaactaatgtacccattctaactgcatttgttgctaatggtatatatctttcttctttagctgggttaaatttcacaacacaacagtctccagctgcaaacacatcttctctgctagttctcatatattcatcaatgattatagcaccattcttcaatgtatctaattttccattaatgagctttgtattcggtgcaaatccaatacataaaacaactaaatcacctttgtatgttcctttatcagttacaacttcatttacttttccattttcaccattaaatttttgaactttttcacctaaaactaaattcacacctctatcactaaattccttttctgctatatctgtgaattctttatctaaatattttgccattattctattttcagcatctataagagtaactttctttccttgcatttcaaaagcttcaactagttcaacaccaatgtatcctgcacctataataactacattctcagctttttctcctttattaataatatttaatgcatggtcatagtttttacataaaactatattatctaagtttcctccttcaaattctggtacaataggccaagatcctaatgttaatactaatttatcataatcatcataaaatacttcttgtgtaactaaattttttacttctactcttttttcatcaaaatttatatctaatacttcatgtttcattttagtattaacaccacttttagctaaattttcaggtgaattataaaacaaactttcagtactttctattacttttcctacgtttaatgctattccacatgatagaaatgagatgttatcatttttttcatatatagtgatttcactttctggatataattcctttaaatttacaactgctgctgtacctgcatgtgtacatcctaccactaaaactttcatctatattcctccaaacactttttattaataaacattgttaataaataatcaatatccttatttatattctatatctatattataaaaaagtaaatactatttaataataattatcatattattaatagcaaaaaataatccaattaatctaccctttatagattaattggattaaatgtttttataccattataccagaggagtttacataatatccttcaacccaagtatttgcagccatctgaccacttgaatataaataataccaatttcctttataatttacccaacctgtctgcataacgccattactatccatatagtaccattctccattaacaagcttccatccagtaccaggctgattattctcaagatatatccaatttccattattagctcttccccatttagcactgcttcctggaattgcattaatagtgacaatatcactagcacttataggtcccacttgattataagtataattttctatttgttcataatcatcttcatcatcaatgcttggtgcttcttttgcagaaaatgtgttcttccctgaatttacatattgaacacttttggctatatcactagcataaaatcctggtcttctattttcaatttcttccctagtgtactcatcacttttcttcgaacttgctgcattagcacaaatactttgtagcatcaatgcagatagcacaaaagtaaaaacctttaattttttcattttactcatcctccacgtaacatataaaatatgttaataattctttatttaacaatattttataacatcattactatatacatcttagttaattatcgaaaaaataccagttatcttaacaaccaaaaattatttttagactataaatgtactttcatctatccacttataatctggtcttattaatttaatgtcttctgacagtttatatagtgcttcatctttttgcttacattcaagcataacatcaaaatctcggtcaatgcttttagcactttcaataaatttaacaaactcctttacatcaatataatcagcatgttttctatcattttcatattctcttggagaagaaaaatgtattttaggtggaagactttcattattccatgtattaaaaattgcttctattaatttttcaattaattcaccgttattgttacaattatgatgatgtacatctaataccattggaacattcaatgttttacacaaattcaaaacttctcctgctgtatatgttttatcatcgttttcaataataagtctagatgttatttcttctggaaattcataaaaattattaataaatctatgaattccttctcctttcccaccagttgcacctcctacatgcaaaaccatctttccatcattatagttcatatcttcaaaccactcagtctggcatattaaatttatcttagtatttgctacaactcttggatttgtactatttaatacattaaattcatctggatgggtatcaactctcatattatttttttttattattctaccaatggcttcaaaatcctttttaaatatctgtctatgtccccaatatcccacttcaggatgtgtgactaaaggtattaatgcagatgttattctataaaaatgtatactattttcaacattataattcagtattttctctaaatcatttaaatttgataaagctactttcttcaacttattaattcgttcttcttctgaatttaatcttgtataatttttaaaagtaaccgaactagagctagtaacctttttgcctaatttcattgaaatagcaacatagccaagtcttatcttcataattttctcctaataataaaatatttttatttatttttctcatatttcattaattaaatacataaaaatagccctcttaaataaaagagagccacaagtatataaaaaagatatgagctattttttaaggaattatcattaatatattcccaaacattttattactattataaactataatctaatatatgtaaacattttctaaccctgatacatatatattattttattatatttaaaatattatttacattatttttcacagtaaaaattatattttcatctatttttatctttgtttcattttcatttgtttttaccatattaatggttaaattattcgcccctaattctctatactttcccgctgaaatatcaacattaaatttcttattattaactcctgttagttttaataatgtttcattttccatatcttcattaatttttatatgaattatattgtctttcttacctttacaactattaacatgattttcaggaactttagtaatttgtgctgttccagtaacagtcatccatcctccacttaaagcagattttataagtacattcaaattattttcttttgatactttttttaaaacttcacctaattcatttattgttaattctaatttcataattccatctcccgagtaactttataagctttttatactattataatacaataaccgtcttattaacaattacaacttaataatttacccacaaaagcagactgtcaaaaaggacaatctgctttttaaagctacttaaatattttctttttacatacttaagatttaatcaacattattaaatcttaaagtcagtaggatcatatgtttttgctttaggttctccaaatacagcctttacactttctgcttggggattatgacttacatgtttcttttttctttcattatcagctttcattttcttacccatgaacatcacctcatcattagattgtacacttacaaattaatttatactatttttataaactaaaattctttatttgtttctaatattgaataattttcctaaacaacaaaaattttttaaattttatattttaaccattttacaccctttaatctacaagaatacattattcctctcactgcccagtctatgaacattcctatccatattccaagaactccaaatcctaaaactattccaagtatatacccaatgcatattctaaatatccacattcctataaaagctgttatcattgtaaatcgtgtatctcctgctcctttaagtcctcctgaaagaacaaaagaaagtggccatacaaaaatagccatactattcgccttaataagtacagcagtcaaatgtattacttcttctgaattagtataaagagatgcaagccattcagatattggtacaaataaaaggcctattgttcccagacaaactgtagcaaatttaacaagatatataagagtgctttttgcacctttaacatcatctcttcctatagattgtccaactaaagtagtggctgcaatacatagtgcatttccaggtacatttattatttgagatattgacattgcaattgaatttgcagctatagatgctgttcccatggtaacaataaatacttgaactattaattttcctgcattaaaaataacttgctccattcctgctggaagtcctatattaaaaatacctctttgtatcttcaagttaaatttgaagggatatagtgattgtatcttaattattttacttcctctgtataatacgaatccaattagtatagttcctattactcttgcaatagctatagcaatagctgctccttttattccaaaagaggatatattcaaaaaatttataccatatatcaatatgtatcctaatattatatttataacattcataaatatagttatgtacattggtgtctttgtgtccccacaacctcgtaaaattccattagcaatttgttctattgctatgaatggatatgtcataagagtaaattctatatagagttttgcatcaattttaacattttcatcagcagtaccgtataaaaaattaataatatcctgtctaaaaatccataaaaatattgttataattaatgatacaatcatgcctgaaacaagagcttgtctagctatttcatttgcttctttatgttctccttttccaacttcctgagcaacaataactgttgctcctactgataatgcagcaaaaaatgatataaaaagcatattaattgtgtctaccattccaattgctgaaacagcttcttctccaatatgtcctgccatcatagtattgcatacgcctaaaagcataacaaatgtctgttcaatcattataggcaatgccagatttaatacgttctttcttatgaacattgttaaagccctcttccccattttattttcacataattttattaataaaatttgttaacgtgaaatacaacttattataccactacatttacatatattgctagtctatataaacatcttcttcaaccatatataataaaacgccataagtatgttaaatataaattaacatacttatggcatccattttaaaaatgatctttttctttatgtggtggtgctcctatttttttcccatctataacgcctaaatcagaattatcttttggctccatctttcttctttctgcgttggactttggtctatcatgcattctatttttattattatccaataatatcacctcaaaattagaatgctcatctaataattttttatactaattatttattatagttagctagttttctcattatgttctgatgtttttttaggttcaagctgaatttttataagcttatttcctgatttataaataataccttctgaataaatttgtacaaactctccttcataactaattgtttttcttgttgtaagttctgtaactactttttcatcactatcatttatatatatttttccggaataatcaatgaatatatcatccttgagaacagctttagagagtgagagtacattccattttaaagtttcattatttaatgtagtatagtatattttagtgattttaccatctatctcatctccaaaataaacataatcattaatatcagttcctaatattctaactttaccattagctggcacttctatattatcaggactatttaaaatggttacaaaatcccccatttccataacacaatttgcatttgtagttggtacgataatatctcctatattcttgttttccctaacaagagtcatctgattcattacatttaatgaatataaatcactcttttcattacgcttctttatttttatgtagaaaacattagttgcagtagaaaattcaacattctctaccttatcttcatcattatctactggaatacgtacttcattataattaaaatctacaatacttgtaacagatgactttttagcgttataagatacaggttcataatacacatcacctttttctttaatcttttgaataactatcatactattgccttctgtaagccatttataaaatacaacctgtcctttatgttcaggtgtaaaatcattttccttgttttcctttgaatcaaaaatctttagttctccattatccatatatgcaacaaatctaccgtcatgagatactgacaaattttctattccacttttaatttgaatttcttccttctcttcttgtggtttttcttctttttcttcaaccacttcagcttttatttcgtagtcagtagctaaatatacattttccaaataccaaaatgtactctgttgtataactagtgccactaatgtccaagctactattctcactaaatttttcatttaactaatcctttcatagtaattttccacttaatcatcttaagatataaatatttaaattatctatgttacttctgaaaagctatgttattcaacataaaatgctgtagcaacacttctctctccattccatgcattaggagaatttataacctctcctttgtaatacattgttgaagaatatcctccatcgagtgcacctgcgttaacagcacctctttccatcattatttcctgaacatcataaaggcttgcccctggtgcagttatctttcgcccatcaataacaaggaatattacagtaccatcttctttttgtccaacagcagttcgtggattaagaccttctgccatcttgtcttttacttgtctttctccatttattataatattaggttttctaaaacacattgcttcctgaacattaagcttttcaagttctcgcaatgaatggtctcctacaattagttttccgcttttagtaaatgcaacaacattttcaacattatctttatcaacattttcagttggatatactacttttccattagaaattacaaaacctcctggtcttgcccctgttcctgcatacacagttccatcacttgattcgtcaacaaatgcacctccatttattgccgctattgcattatgttcttctgccatatcacttgttttttgtccaagctttccaagatatttagtcatagaaaccttaatactgcatgggtttttaatttcaagtatataggcagtatatctatcagtatttatattatattgtgtaatctcagttccactagtatattttacgtttaccttatcaatgtcctgttttacttcattatcattttttacttcagccgctgtttcctttattccaagaagattatttattgtttcttgagacatgttatctgtaatccaatatgcatgtcttgtagctaaaatagtatttataagtgctcttctcgtattttcatatggaccaaatattaacacaagtggtgtagttattcctaaaaaaataactatataaatgattgacataaaaaaaactaaaggtctaaatccttttctattttcttcgtcactcttcttctttctcgtcactctatattcctccaacataaaataatagttaatttttccattttattaatctaatataaacttcaatttaatattataccataattaaaaaacatatagtattgtatttttattattcaaatatcaataaattatagcttatccataagatattgtatatagatttattaataataattaatatttttattaatatagaaatttctaaacaaattaaagctgtacttcatagtacagctttaatttgtttattttataaagtcacattaatttttaacatatcatcttaattataataagtatttttatacatgatttatacctatttctccttgaacatctggaacttcaacttctgcttctttataatcaacattaacatcactatcaatatttttaaatgcaacagaaagcatcagtttaattctgttgagttgatttacgttggatgcacctggatcataatctatagctactatattagaatcagaatatttttccttaagagtttttatcattccttttcctgtaacatgattaggtaaacatgcaaaaggttgtaaacatgcaatattcttagttccactctctataagttcaatcatttcagctgtaaggaaccatccttctcctgtttgattaccaagagacagtattggtgatgccatttttgcaagttcttttatatgtttaggacttgaaaatctattactcctatcaagatattttttcattgtacttctatatgtctccatatacattattgcgcaattatatatattcttagtaattttttttccacctaaatattttgccttaaagtcttcatccaaagctgaataaaagaaaaagtcaaggaaatcaggaactacaacttctgccccttctcgttctaatgtccctataatatcattatttgcagtaggatgaaatttaactaatatttctcctacgattcccactttaggcttctttatattaagaagttcaagttcatcaaattcttttattatactttttacatttctcgaaaactcacgcttacttccattacgtacattttcctttgcagcttcattccatttctcatatagcttgttagcggaattttcaactttttcatatggtcttgttttatataatactcgcattaacaaatccccataaacaatagccatcaatgctctatttatcatttttattcctattttaaatccaggttgatcaccaagcccaacagcatttaatgaaataaccggaacttgttcaaagcctgcttctttaagtgcaagctttaaaaagccaatataatttgttgctctacatcctccaccagtctgacttattattacagatgtattattaatatcatatcttcctgatttcaatgcttcaataatctgcccaaccacaattattgatggataacatgcgtcattatttacatatttcagaccttcctcaatagcatttctatctatagatggaagtacttcaagtttatatcctgatgctcttacagcctcctgaattatatcaaaatgaattggagacatttgaggacacaatatagtgtgattttttctcatttcttcagtaaatattctattcttatattctatcttttcttcaactggtatatagtttttacgtaatcgttcatccattgcagctttaagtgatcttattcttattcttgcagcacccaaattatttccttcatctattttaagtacagtatatatctttccttttgcagaaataatctctgatacttgatctgttgtgactgcatcaagtccacatccgaatgaatttaattgaattatatctaaatacggttcttcagcaactaatgatgctgctctatataaccttgaatgatatacccattggtcaactactcgaagtttccccttaatttcccctaaatgactgacactatcttctgtaagaacagccataccatatgagttaataattcctggtataccatgatttatttcaggatctatatgatacggtcttccacaaagcacaatacctctctcattattctgttttaagtattgtattacttcttcaccttttttcttatatcatttttataattttcctgttctgccacagcgcattctactgcatttttcgcctcttctaatgatacattgaacattttaaattcttcatgtattcttttaatcaattctcttggattatcaagagataaaaatggctgcataaagtttatatttttatctttcagttcatcaatattatttcttatggcttctggataagaaattaccattggacaattgtaattgttatctgcttctctaaattcctttttctcatagactacacatggataaaaaatattatttatccccctattaattaagtttataatatgcccatgagtcaattttgctggataacaagctgattctgatggtattgtttcaattccaagttcatatatttttttactcgaaggagctgataacattacactaaatcctagttttgtcaataaagtaaaccagaatggatagttttcatacatatttaaaactctaggaatacctattgttcccctcacagcctcatcatcttttaatggtttatatccaaaggttctcttatatttataatcatacaggttaggaagttttttactatctgttttttcaattccacttcctctttcacatctgtttccagaaataaattcttctcctgttgaaaatttatttatagttaaaagacaattatttccacacttaccacatcttctaaacatggattctattttaaagtcttcaattccatttttagaaataagagtagttttataattttcactatatctttccttggcaatcaaagaacaaccaaaagctcccataagaccagctatatcaggtcttactgcatctttccctgatattttctcaaaacttcttaaaactgcttcattgtaaaaagttccaccctgaacaataactttttctccaatatcactttcatctcgtaatttaataactttgtataaagcatttttaataactgaatatgaaagtccagcagaaatatctgaaacttcagcaccttctttttgagactgttttactcttgaattcataaaaactgtacatcttgatccaaggtcaactggtgcttttgaaaataaagcttcttttgcaaagtcttcaactttcatacttagagattttgcaaaactttcaataaatgaaccacatccagatgaacatgcttcatttaataatatactatcgattgctccattttttatttttaggcatttcatatcttggccgcctatatctaaaatgaaatcaactcctggcaaaaagaaatcagctgctttataatgcgctatcgtttcaatttcaccaatatcgatatgaagtgcagcctttatcaacgcttcaccatatcctgtcactgcactatttacaatttcaacttcttttggaagtttgttatttaagtctttaattatatttataaccttataaagtggatttccttcattactaccataataactataaagaagctcacactcatcactcataagtgtaacttttgttgtagttgaaccagcatctattcctaaaaatgcttttcctttataacttcttatatctcttcttttaacaatacttttatcatgtctaagcttaaactcatcatattcttctttattattaaatagtggttcaagtctttcagctccatcctcttttatatcagatatctttgaaactctctctactatctctttcaatgaaatttcactttctttttctgatagtaatgccgctcctattgatacaaataattgtgaattttcaggaataatcacattttcacctgtaagatttaaagtttctataaatctttgtctaagctctgacaagaaatataacggacccccaagcaatgcaacttttcctcttattggctttccacacgcaagtccacttattgtttgatttacaactgcttgaaatatagaagcagcaatatctgccttatttgcaccttcattaattaaaggctgaacatctgtttttgcgaatacgccacatcttgatgcaatattataaataattttatgctctttagcgagttcattaagaccaccagcatctgtatttaataaaacagccatctgatctataaatgcaccagtaccccctgcgcagcttccattcattctttgttctataccgcctttaaaatatgttatttttgcatcttcacctccaagttctattacaacatctgtttctggaattatttcttcaactgtctttgaacaagatataacttcctgttcaaaattaaaattcagccacttagaaacagaaagacccccagaaccggttatacaaatggtacaaccaatatcacctagggcttcatagcattcgtttattaatgttataatagtactttttatatctgaaaaatgtctttcatatttactgtaaattaatttattactatcatctaaaactgctaattttacagtagttgatcctacatctacaccaattttatactttatcatgttttaattttcacctactctgttttcattcatacttattctcacataagtttcacagtaaattttttctatattctttcaaaattataacatagcatttttgttttttctatcatttttgttatttaataggattcctatttaaaatctactatgaaattaatatgcagatatctgaatattaagtataattttcgtcaataatttaaatgatttattttaatataaaaatttacggagggaaggcttaatgaattattttaacgaaggaaataaattttataatggcaaagattatgaaaaagcaattgactgctatatgaaggcaataattcaaaacatcaacatagcatgttcttattataacataggagtttgctttattaagctaaaaaagtttgatgatgcaatcgacatgttaaagaaagctatctcccttcaaaaagaaagtaagtacttttttaatctcggttattgctacagcatgaaaaactgccttgataaagcgctatgtcattttaatcttgcatggtcaatagaccctgatgatgatgaatgtgaaaaagctgttaatctaataatatcaaaattgcaaaaagtataataataaaggggaatgcttctaccattcccctgcaatattttctatcttatgttcattaaataaattagaatcaaaataattacctgcatcataaaaagttgtatcaacattaatccaaatattttcatctttcaagtaaacctgattccatgcatgacctacatatttttctccatcaaatgcttctccacttaaaagtcttacttttaatccagatgctcttgccatagctacataaagacaagctttatcaaaacatattcctttacctgtatcaaaggcacatatggcaccacttttaggcatttcttttctatctacaccacttaaaactatttcagccttttcatcatcatattctatattgcttcctacccactcatatataatttccgctcgttctctatcactagatgcatctttagttaattgtattgcctttttattaatattatcattagattttattccttcatttattgtagtaccattatagattattatctcattaataaaaccattagatttataattaaacttatcaatcagttcctcaatactgcttttgaaggatgatgcatcaggaatagtatcaactgatatagatggtaatattaataaaaatattaatatacctacttgtgcagtacctgatattataccaattaaaataagaaaaaacttttttgcactcaattattttttcctccattaacttctaactaatatttttttatccaatagttttaatatatagatctatatattttattcaaattcatcaatagacattacatctttaacaacttcttttactacatcataagtatatccctttgatattaaaaatctataaagttttccacttattttgtatgtatcattttcacttttctgtataattctcagctttttatttgcaagaactcttgctgtatttttttcagcaattttatctattccttctagtttttcttctattttatccctaggtatacctttttttatcaagtcctgttttatacgttgacttcctttggaattgagcttatcctttataaaagcttccgcataataatcgtcatttaaaaatttatattcttttaaaaattctatactagcttcaatgtgattttgctcataacctttcatctgtagtttttctataacttctttctcagtcttatatgatctttcaatgatttttaatgctgaattcttacatctaagatatgattctttatctgctacagattttaatttttcaatatcaactacatcttttacttttagattttctttataaaccagttcagcacttattgaaaaagcatattcttcatctaaatatatattaactctttctttatttttcttttggatttctattttagttataattgccatcgtatcaccttttaactaatttcctgattttaaaatatgaatagtcggatcctttaacactttcctgcttattttattgattttatccatattcaacgtattaagtctatccatatcctttaaaaattcatatatatcttcatcttctaatgcttgatgaagcatataattacataattctgagctatcttctaatgttgaaatcactgctgttttatgaaccttcttcattatttcaagatctctttcaccaattacaattttcccctgaacaatattttctagggtttcatcaattgaatctttagcttcatttatattttcttctccaactgcagtgtatatatatagtgtttttatattgtttgttatctctaaatgtgtgtatatatcataagctagacctctcttttcacgtacttccctaaatagaagtgaattagagctttctccaagcctatgattcaatattcttaatggtagttcatcttctttattaagatcatagaaagtatataaatatacaattgtgctttgttcaatatcctttttataatttatttctgtaacttttttattcttttcttttattatttctatattttctggtttctcaccattccacataccaaaatgcttttctataagatttaaagcatcttcatgactcaatgaagataccattgtaataagagcatttttaggtgtgtaatgctttttataataatcttttatttcttttcttgtaaattcagacacatttttttcaatacctgtaacttcatatttcaacgaactcttatcaaatgctatcctatttacatttttaaagctcaaatcttcaatgtcatctttactcatctttatttctgataatataactcctctttctttttcaatttcattttcatcaaattcaggatttgttatcatatcacctaaaagatctactgcattttcaaactcttctgcaagacagcttattgtatatacagttgcatcataatcagtatatgcattgtattctccccctaatgcttctaactcctcattaagttcttcatcatttctttttttagtgcctttaaataatgcatgttcaataaaatgacttatgcccttttcattgattttttcatgtaaggctcctactttaatacctatattaattgaagctatctgtgtattcttattaattgttatcacttctagtccatttttaagaatatgtcttttaacatcaaaatttaattttatcattctatttattctcccaaatacgtttcattcttctactattaataatactttatattgagataaaaatatagtgctaaataataggttgtagtctaatatgaattaataatattcattcttttcaatgaaaatgatacaatatattatataaatttataatataattactatacattatgtaataaaactgacttatttctgtggtaagattataattaattatgatttatatttttatcattaattttatagaacgttaggagatgatatttatgaaaaaatctattttaatagttgaagatgaacttagaataagatttttacttagagattatttaaccaaggatgatttcaatgtttttgaagcctccaatggtgaggaaggattatttgtttttagtacacaaaaaatagatttagtaattttagatattatgatgcctattatggatggcatgacaatgcttgaaaaattaagagaagtttctactgtaccagtaatacttctaacagctaaaagcgaagaagatgataagctccaaggatatgattacggagctgatgattatattacaaagccattcagtccaaaagtattaattgcaaaagtaaaagcattactaaaaagaagtcgtgaagacatcgattcaagttctcaggaatttaatggtcttactataaataagctttcacatgaagtaagagtaaatggaaaagaaataacattatcacctaaagaatatgaacttcttatttatcttgtaactaatgaaggtattgcattgagcagagataatatattagataatgtatggggcttagattattatggcgatataagaaccgttgacacgaatgtaaaaagacttcgtgaaaaacttctcgatagatctaacttaattgtaactgttcgtggtagtggttataaatttgagagcaaacagtaaggatgtgttatattcgaaatgaagcatagtttatcaaaaaggctttttgctataacattatcacttatattaggcataatgattcttgtctattttactcaggcaatgttttttgaaaaattttattcttataaaaaaactctttcacttgttaatgaagtaagtaaatttcatgatttatattctctacatattgatagttattctgcaaaagataaaagtttatataaagcactaaagaagtttgaagaagataatagtgcgcaaattgcaataacttcattagatggtgatataatctatatttctagcgaatttaatggtgaaagtattgtttcagatactcttgcaaatttttgtgctgaactcataaatgatagagatttaattaatgatgttattaaaaattcaaaaattagatatacaaatttctatagctcaagtaatgacatgcaaaaaataggtgttgtaagtcctatgtcattaaaaaacaataatgatagtcttatattctgcgttgcttcaatacagcctattgaagaagcatcagaagttataaatgaatttttcttttacttatttttagctttaatagccgttgcatccatacttgcacttatttattcaaatatgatttcaaagcctcttgtaacattgacatatgttgcagataaaatggctaagatggatttttcagtagtatgttcaacagagagggaggatgaaattggaagccttgcccattcacttaatatgctgtctaataacctccataacgcattaattgatcttcaggataaaaataaaaaacttgaaaatgatatcgaacgtgagcggcagattgaaaccatgcggaaagagtttactgctaatgtaagtcatgaactaaaaactccaattggaataattgaaggctatgctgaaggattgaaagatggaatagtaaaaggtgaagatgcagctttatacctggaaaccattattgatgaatcaaagaaaatgagtgttcttgttacaaatatgcttgaactctcaaaacttgaatccggtgcttcgaaaccaaatttcgaagactttaatataaataggcttattgctaaggttattagaaaacatgaacctgaatttgaagctcataaatttaacgtaaactttaattcttcaagtccctatagttatgtttatgcagatgctttccaaatggagcaagtctttacaaatctaattactaatgcaataaaatatacacctcctggaaatgacataaatataaatattgatgaaggacttcataagtttaggctatctgttcaaaatatgggaacaagtataccagaacctgaaattgataaacttttcgaaaaattttacagaattgataaatcacgtgaaagaactcagcgtaatagcactggccttgggttatcaattgtaaaaaatattttaagacttcataatagccaatttaatataagaaatattgatggaggcgtagaattctatttttatttagaaaaaatagtaattagcgatgatgaaatctaaattaacaagagtaggtgcccatgtacgaaatacataagcacctactctttcttatcaacaaactaaagtattgtaatttatataaaaccaccatcagtccttatcacctgtccagtaatataagatgagtcatcactacataaaaatgctgtcaatctcccaacttcttctggctttccaaatcgtcctagtggaatttcttcttcaagttcaaatttttcattttctgtaagaaatgaattcataggggtatcaataacacctggtgcaatagcattcactcttatattagaaggcgcaagttcttttgcaagagaccttgtaaataagtttattccacccttagttgcagaataaagcacttcacatgaagcacctgtttctccccacattgaagatatattaactatatttccactttttctaggaatcatataattaataacatgctttgttagatatatcggtcctaataagttaacattcattatgtgatcaatattttccttgtcagaatccatgaataatccaattttacttatacctgcattattaaccagaatatcaatcttccccattgtacttataatttcatcaaccattattttagtattttcatacgaacttatatcttcttttatgagaactccataaccatttaccctttttatttcttctaaagtcttttctgctccatcatgatctttagaataatttattactatactagctccttcttttgcaagttcaattgcaatagctcttccaattcctcttgaagcacctgttacaagtgcaatctttccacttaatctccccatatctaatgtgtatatacagacacttttgtctatataatacacccaccacctttcattatttaagagtttctttaaatactctttttacgttattataaaaaactttttcaatttcactttctgtaaatccacgtttctctaaggtataacataatttattaaaattagatgaatcctctatttctacttcattaagtattccatcaaaatcacttccaatacataaaacatctattccacccacattttttatatgttctgcatgtgctccaattgcttcaagagaggcaattggatttgtattattttccaaaaaatccaaacaaaaattcaaccccatcacaccacctttattgcttaaggcttttatcatatcatcagttaaatttctgggatggtttgttactgctcttgcattagaatgagatgcaataaatggcttactgcaaatttcaatcaaatcataaaatcctttatcagataaatgagaagcatctggtaaaattccaagagactcacattcacaaacaatatttttccctttttcagtaagacctttatttttatatttaaattgaaaattagggtacccaagcttatttttataattccaagttattgtaataattcttattcccttatcataaacttcatgaagtttttttatacttccccttataacttcgccttcttcaatagataaaaaagctcctattttattctcattttctgccttatttaattcatcaatatttctcacaactgttatataatcactatttaatttgatttcctttataaaattatcatatattttttggaattcatcataaggattaaaattcaatttttgatcaacaaatattgcgaaaacctgacctaaacagtttccttttttaagcttcttcaaatctaccttgcatatattttcatttaagttgagtttttcataaaacattctaccagctgtgtcacaatgtaaatctataaatttcacttaaattttcttcctttcaattatattctaaataatcgcctattttctcaggacctgctgtaattgatttttttatataaagactattttgatcatctacttctattttccattttacaagacatatcttaccattagttatttctatagttgttattgctgatggaaaaacacaacatccatcattacaatataaaccttcagatggttttggtagtttatcattatgggtatgtccacatattatcattctattttcttttttagctagtttttctaaaactttatctattttatcacctttatcataatttgtagcaggacttgttggtgctttcattccacctaccccttctagaaatctccatacatatctcacaagaaatctactcaccttccaaaattcacaatttataatgtcaacttgatgtccatgaaatgctagtatatttttatttaacggaagataattaagaactgcacattcataaaatttcacttttgaatacagatctatcatttgagatggaaaattatctccaatattattatatacttttttttgctttaaaataaactctgggttggattttataatatcatgatttccatatagaagatacaatctttttttatgattaaatttatttaacatcttaaatacatccttatagttatacgcaatatttaaaatatttttatttttccatagttcatccccatctccaatttcaatcaacgtatatccattattataataatatcttaaagctgctttatatatgttctcattaagccttaatgaatcttcatatcctccattcccacggtgaacatcacttataaacactatcttagaagtatcatcaaagtcaataacacatccttctttctcaagccttgacagaagctctttgctctttctacacttaatatccatgttatctcctattattttaatatttcatttaattataatatgaagataatttgtctaagttgacacttctaatatgactatgaattttgttattatacaagtatttaaatttatcaatatcatatagaaaaaaactttgcatatgaataattaatatataaatttaacaatttaattacaaatggttaaatattttctttctaaagctaatgtatagaagtaggaggaattctatgaatgaaaaaaataatctttctaagaacatatcatgcgaatactatgttcccttaggaaaagctggatcacttataatacaggctcctgtagtactttcataccttaaagtaaatatcccagtttatacaaatataaacttatcaaaaaattgcttaaatgttaagacaactcaaaacaaaatctttataaagaaacccctcttagcatcagataataaacttatattaacaggacacattgaaaaatcactttcttacaaaactaatagtaataatacaagtaaattctctggtaccaaaactcttaatatggatattcaaatagaagaacatgttaatataacttttgatcaatttcctgttaaaaacgaaaaaaacactgaattttactacgagaaaagtgatgaacctattaattgcaatatggaatttatagagctaattcaagataatattcaatatacggactcaggatatgtaaataaattgatactatcacttcagttttcattaacacagcttcaatatgtatttattcctgaacctgaaggtgatgtacaattattaaaacctaattctaatactccaatacaaaccccaaaaacaaataatttttactataacataggttttgataattctgtaggtcttattgctaatagaacatttatatataattccccatgattattatatataaattattaatttaacccttaataaaaagctacaattctataaaatattctaccattatataaaagtatgttttatgtaaattatagctttttatttatatattttatctattggatatctgataattctatattagccatatatctcaattcttcactgatagtactctcatttcctgcattatcaactatagtgattggaattacaactttaaatgtactaccttttccttcttcactttccacaaaaatttttccattatgcattttcactaatgcatttactatgaataatccaagtccgtttccctcatttttgcgatttaaagtatagtcagaaccttgaaaaaatttatcgaaaatgtgcttctttacatcattactcattccagaacctgtatccttaacaaatatataaacattgtcattatcatttttacagtgaacaactatcctaccactattatttatactttttattgaattagacaataaattaagcataattctctctatacttgttttatcaatagctgtatagatttcttcattttcagtatcaaaaataacttctatattatttgatgctgcaaaatctattattgtttcagttatatcttcaacaaccttaactatattatacattttaaaatcaatgctcattattcctgcttcaattttagctacatcaatagaattatttactgccttattaagacgattagaattttttattatattgttaagtcttgtaataaagtactctttatcataattattattaatacactctctctttaaaaactttgttgaatttattattatatttaatggtgttctgaattcatgtgacattaatattatgtaatctgtctttattttttctctttcaatagcggccacagcttctagattggcttcttttatttttcttttatgataaaatgctattactgctaaataaataattagaaaaactacaatactaaatgatatgtatattaaaaacacactccatttaggcaatagaagattgtatggtttcttatttataaagctacttccttcaggaatatttaatggatttatattatattctcgaattaccttataattaaataaagatgtatttatagaattatatgatggcgtcataatgtatggaaactgttcaactgaatctccatttactactgaatttaataaaatagcacctaaacgaccagtcttttctccatcatttacaacgcctccaactgcacctgattctacataattgtataatgtagtgtatataggtgcatctgttatattctttatactttcaataacttctgacgatgaaacctttgaattggttgtttcatttatatacgctccacaaattaatattacagaatctttaaaatccttttctgcaagttcttttttcatatatcctatcttattagtttttattacttcagtttttagtttatcattattttcatgatatgcagctgaaatatttgtcattatgctctgagaatataaactgttatcacataaaacatatagcttcttcatatcaccatgcattttttctattaaatctacacactctaaacaggtctcaatattaacaactccagataaatacttcttttcttcgtcatttaaatttataatactatttactccaacaaaaaaaacgggttttttataaaaaacccgatgtttttcaaacatatgatctcttataactttaagtgcttcatcatccattgtaaaaatataatcaatattttgattctcatacttagcatctaaataatttaaaaatgattcatgatatgaaaaagtgtttttagaatacgaatcaagatactcgctttttatattatttttatcaccaagtatactttcaaaaccgcttaatacagattcttcccactcattttgaaaactatatgatcctataactaatatgttcttaccctcaaccgtagggacatatgctgatacttttgtataattgctaataagggtgaaaaatattactaaaactattaatcttatatttttaactgttaatttcatacaatatacacctgcgcatcttaaaaatactttgctagtattttcccataattcaacatactatattcatatttaacacaaatcttaaaataaaaaagtagctgcatcacattttcagttaataattgataccaaaaattttataatttatgtataactctataaatttgactgcattataacttctaaaagaataaaaaaattcagcttatgatatataatagcataagctgaattttaaattatcagtttataaaacctaataatttaagtacatcttctccaatttttctttctgttcctttatatggataacaatgaatatgaattgcaggattaaaattcaattctattatcccatactgtgtattttcatccatataatcttcaagcatcatgtcgacaccacatatttttgcatttactgcttttgcacactgaacagcaatatttttaaacttttctggtattttatctgtataatctatgctgtctccaccagtgcttatattagagttttctcttaaatatactacctcatcttttactggtacataatcaaatgtttttttctgaacttttagaaacaattctgcattttcgtcgagattaattttttcaagaggtgtaacataatgataacctcttaaaggatctttatttttgatttctgtaagttcacgtattgttttttctccatctcctaccacattagcaggtactctatgaagaattccctctactttatcatcaataacaagaaatctgtattcttttccttttatgaattcttctaataaaaccgtattatcatacttaaatgcaatcttcaatgcttcaataatacgctctttacttgtaccctcactaaatatacttattccagttccaaaattagttgatttaggtttaattacaattggtttattttcataaaacaatgctgcatttatgccttcttcaatagagcatacttctataccatcaggtacttttatattattatctcttaatacctttttagtgacacttttattttccataataagcacgcttatataagtatctttagaagttttagtagcctgtcttacatactctgtcttattatcttttttaagacatataaaattttcacttctatctataacttcagtttttatacctctttttattgactccttcataagtatctgagtagataattctaaatcttcaaatccttgaagcttaaatctatttttatatgaatcttctttatattttttagaaagttccaaatgagcgtcaatatatcctttcttttttacaacatcagcaagtttataagcatatgtaagttttgaatctttagctctttcaatcatagcatctattgttttttcttttccaagattgaggaatgtacttatgtttctaatttcatttaatatttcaagtgaccatgtttttttagatactttaattccatcttttattaaatcaatattatcaagcccatatttcgctatattattttgattctcggtagcctcactctgccaattttcataatcagattcatcttttataagaagatacaaattaaaaatttgaagaaaattaagatcctctaggcttattccacctttttcaaaaggattaatatcaatgcttctatattctaaatactgtattccatcatttaatagtgatttcataaattcatcaacatttttgggtttaagccttacagcactatataattctttatgactatctattagttcatcatttataaatgacttcaaacttcctatataattttctacactgctataatctggtataagttcaatcttgtttctataaccacagtcactatttctatatgatacggcaccttcattcgtaaaggtttctcttgctatctctttgcttatattcatacagcatctacatccataagttttatgaacaatattgcttgcacctaaaagatatactataagccatctatatcttaaataatttcttgctattttaagatatattgtattcttaaaattcttataacttacattttccttagaatctgcaacatttatttcatacttataaagttttcttatcagattttcatcaaatgaaaaattataatgaataccacaaataagctgtctttttcctccatattttttaattaaattctttctatattcataggcaatattgcctttttcattattatcatatcttgcaattcttatttcatcatcattaggtactatacttggcatagattgtggccataaatattcatttcctatttccgaaacagatatatcataaagtgcatttgtaaagtcatacacctgttgcggagtatttagtggtggtgttatcatttcaacttgacattctgcaaaatccgtagttatatatggattatcactttttgatccaaacacttctggatgaaaagtctgagaaagacttccatctttatatattcttaatgtttctctttctattccataattacctcttagtaattcataaggtgagcatatttctttaattttttctaacattttacctcctatattaacgacataatatataaaataaattactcattacaacttctttctttttacttttagtccaattatatatactattaattatatgattcctttttaaatactaaaaatcctattaatcattttgtgtatttttaatttttccacaaatattatcatcacttttagtaattattgttagtaaaaacaaaactaacttattggcatttgtaatgttcaacccataataattccaagttccttcttttctacattccacaagcccacagtcaataagaactttcatatggtgtgatagtgtgggttgggtaaaatcaaaactttttaatatctcacatgcacatttttctccacaagataataaccttattattctcagtctattagaatcactaagtgcttttaataatctggcgttttcttcgtaattcatttgttcaccccttatatagatatatatctatataaaagtatacatttcccatatattttagtcaataaaaaaatatatttcaaatatatacttttataaatatataatcgttttctctaatgttaattgatttttaacattaaatattctttaattataaacttatactaatattatttttatgttatcaaatatattatctccctatttatatatacccatacatttaaatgtatctatataaccaaattaatatatagatatattcaacttaataaaaatgaaaaggatctatcagtaaaattctttcatttacctatagatccctgttatatttactttacttaaataaatttttaaaaattaaccacctgaaaatttataaatttaccaggatgataaagatgtctttctgaaagaagcagtttataaaatacattgctcttaaatgctaatttaagccattcttctgtatctacatttattataacttgattttttaaaaatagatcctctccaatattatcacgtttcatgtaattaccactctgtattatcttcccattctcattaatcatataaactcaccctttcataaaccatctttatttttaaacaacatatattcatattataatatgccttttaattttttacaatattttactttcagagccagattttattttatgtattaattttaaaaaggaccttgttttataaaaaacaaagatccctagatattaatatactaattttatcctgacatagttaattattttattgttggttcaatataattatcaactttaccatttttaaaaaccatttttagaaatacaggtgtaatgattgtcgtaataagaaccattattatgattggtcctacaaaataatcactcataagcccaagtgccattcccttacttgcaactattaatgctacttctccctagatatcattccaatacctatctggactgattctttatttgtgtatctgcatatttttgctcctactccacatccaataattttagtgaaaatagctacaattgttaaaagtagagttaatgataaaattctcaaatccattttcggtaatgttatgcatattcctatgcttgcaaaaaacataggtgataaaagcatatatgaaacagtttcaaatctatttttaatatagtcacgctcattatttttagataaaattaagcctgctataaaagcacctgttatatctgctactccaaaaaattcttcagctgaaaatgacattagtaaacatattacaaatgcaaaaataacaaatcttctcttatctacattatacttatgagtccatttatcaaaaaggactgcaataataagaccgcttattagtgcaaaaataaaaaatcctatcacttttaatattacggtttttaaattaacttgtggatccgatatgcttgttattacagttaatgctagaattcctaatatatcatctataattgctgcacccaatattgcatttccagaacaagtagataattttccaagttcttttaaagtttcaactgtgatactcacagaagtagcagttaaaactattccaataaatatactctgcacagtactactcacatttactatttcttcatttttaaacatttcagctactgcaaatcctccaaaaaggggtattataactcctaatgaagcaattattaatgatgcttttccactttctttaagttcatcaatattgctttccaaacccgcagtgaacatgagtacaattacacctaattcagccatctgacttataaattcagtttcatttaaaatattaaacattgcaggacctagtatcaaaccagcaagcaatgctcctaccacttgtggaagattaaaccttcttgtaagtaatgataaacattttgtacttaataatataagtgctatgtctaataaatatctgtatgacataataccacccccataattaataaaggccttttatatattttatcattatactgaccagtttaaaactattttattctatttttgtaaatttatgcttaagaatcatatttcaaattgcttatatgacaattatttaataattatatgttaatattaaaattataatggtaaattttaatatatcatctaattaatctataatattttcactgattcttaataatagcatactactggtgttccttcttctatattgtaaaaaatattctttgctaatgaatggggaagatttatgcatccatgtgaaccatttgttaaataaatcttcccaccaaaattatacctccaaccagcatcatgcattcctatgtttccattaaacggcatccaaaaatcaactggagatctatatccttcaccaacaagaacggaatccttatctttatactttagactataagtcccttctggtgttattgttccatttgctatacttccagatacaacatcaccttccaccaaaataattccgtctttataaaaccataaatgctgattgctaagatctatctccacacatgttttatcaacatcatttattatagtatttattcctttttgctcatatattggttctcttttaacagtattttttcccttcaaattattaataagttcttctgtttctgccattctatttatcttaaatccataatccccacctgcaacagttacaattcttccacttgtactgttcatagttcgtgatattccaactgtatcatatttatcagcaaattcatttacaaagtccattacttcatctctatttattgtcacattataactattatcaatatttatccatttttccatagtactcatattaatttctttttctaaatttccaagatcatatattacttttgaatctttatattgatttaatatatcttttattcttaaagctttttctgaggatttagtatattcaggattttcatagcatccttctttttcaagatctaaaacttcttgtccatctagtatggatttctttattttttcaataagtatatctttatctatcttacttccataaatttcatcttctattacaaattcgttattactataaataaatttaggattttcaggcgttattatattatcttctttaaatatatctaaacactctattgcattgtttaataatttttcatcatatgttattaagatattattcccttcttgtgtatctttatcaaagaagctttttatccatgaaatctcattttgtttttcttttattgagttaatttcataattgtatcctaatgcaatgtcctttccatctattacatttataactcctccacgaccttttagaataagtttataattatctatactatcacctatatatttttctgcatcttcaatacttttaaaagaaacattaatacaatttatagtggttccagtataaaaatgatatttaaaatacatgttagaacaaatatatgtcataccagatactagtactattacagtgaaatatttactattacaattttctaataatattttttttaaaccagtttcactctttttatatcttcttccgcctttaaatctaatagatttttttctcttatttctttattttctgctaatcatgatactgccattatatttcttctcaatttcactattaatatctgtcattacctcatcatgattttcaacataatatcgcataactcaaactccatatttcgtaaataattccatttataccattaattatatcacacttatgtagcatatttatattttatataaagtgtagccatcgttttaatatataaactcaattgaaatactaaaaatcacaaatttaatgatataatattatgaaattaaattttaaaaggagatatctatttatgcagaaacttctaagcaaaatgagacaggcaataaatgattataatttaatagaagatggagataaaatcgcagttggactttcagggggaaaagatagtcttactcttcttcaccttttaaactcatataaaaaattttcaccacaaaaatttgaattaattgcaataacattaaatcctggcggagttgataatacacctttacataagttatgcaaagatcttgaaattccttttcatgaaatccagacagacatacaaaaaattgttttcgaaattagaaaagaaaataatccttgttctttatgtgcaaaacttagacgaggcgctcttcataacaacgcaaaagaactaggatgtaataaagttgctttgggccaccataaagatgatgcaattgaaacattaatgctttctttatcatacgaaggacgtattaattgtttttctccaaaaacattcatggataaggaaaatatcacattaattcgtccaatggtttatattgaagaagcatccataaagaatatagttaataaatacaattttcccgttatacataacccttgtcctgttgataaaaaaacacgaagagaggatatgaaaaatctcatttttgaactgaatggcagaatccctggattcaaaaataatttattcggtgcactaacaaattcagaacaattattcatatggaataaagatgatattaaaaatttataataagataaaaagagacttggaattcctatttatattccaagtctcgttaaataaatataatgtctaaaacaattttcatctcttatttcttactctttttcccttttatacaatctttctaactctatatgtctgcaatgtttctaatgatttagttatttctcttgttgtaatattaagtattcctaatgaagctaatctttttatctcctcttgattatcaacagtccaaactgatatataaatattattttcttttaatagccttactaaataatttgtgcataatttataattcatatttacaatatttatactattttctatgcaaaatgctactatttcccttgaaagttctttaataggaagtttcttatggttatctataaattcttcaatattaaaataaattactgctttttcttttatttctttatattttttaagattttctaaccgaacagatcctgaaaatatgattcttccttttaatcctttatatttttctaaaagcataattatttgaagttctaaatcatattctttcaaatcacagttaatttttatagaattatctttctccaatatttcaaatacatcttttaatcttattttagtaaaatcataattttcagcatctaaaatatcatggcttaaaaccaactccccatgcttatctctcctaacatcaacttcaagtgcatttgctcctgttcctatacagtaataaataaattcaagtgaattttccacagtatcatctgctccagaatgagctgtaattctagttctcatatcacacctccaaattaatatttaatcattacaaatgcattctacatttattatctctaattaactatcaaaatccagttaaaataatattaaaattttatatagaatatcttctattaaaattttaatataacattgtagttaactcacttttattatataaaagcaaataaatattaattctatgtgaaatatagagttaaactcaaaattacatttaacattagtgcattaatttctaacacattcgctgtatatttattattttttcagtatcagatacaattattgtactttttcaccaatggaatcacattccatatcaacaagatttctcaaccatttcttttgtttatatcttttgaatccaataacaaacttatatgcttcttcaaatgtaaccattgcatacacataatatattggcagatcaaatataataccacctaaaaatgctaatggtataccaacacaccaaactcctgtaagatcaagcaaaagcgctgctgtggtatctcctccacttcgtagaattccagttatattaactaaattaaacattctaaatggaagataaattataaagactattaaacattttcttatatctatagcggtagattctgtcaccataaacatattaattattgggcttcttaaaaagaagaacattaccgccattatcattgtcagtataaattgaataaaaataaaataagttgcatgcttttcagcttctttaagtttatttgcgcccaactcattacctaaaattacagctgttgctgcacttataccttgaaagaaaacaatacaaagttgctctacattttgagttattgtaattgaagcaacagcctcatctcccattcgtccataaacaagagaatacattgtaactccaagccccacataaattcatttgctataacaggagatacagttttaaagtatatttttataaagtccttattaaaatcaaacaattcctttattttagcagcagcaggattatcatgagaatacacgtatgcaatcaaacataaacattctactattcttgctattagtgttgctatagctgctcctttaacacctaattgaggtgctccaaaatgtccaaaaatcagtgtataatttaatataatattaattcctatagatacaatacttattataactggagcttttaccttatttacacctcttaaaagtgatatataacaatttgtaactgctgtcattggataacttatagccgctatccctaaatatgcagctccaatagctactgtattatcacttggggtaaatatcctcataacaccttctggtgcaaaaattcctgccaaaacaaatactatagatccaattaatgatatggcaatagacattcctaaaactttatgtatgctttttatatctttttttccccaatattgtgctgttagtattgaggaaccgcttactattccaaaaagcagaagagtaaatacaaaaaatactttattagcaagtccaacagctgcaatttctgtttgaccaagctgaccaatcatcatagtatctactagatttaaaattgtatttaacatagcctgagctgctacgggaatagtaattgctactgcttttcttaaaaatttcttatccgaagtcatttctgcaatatacgatgtcattttaaatagatctccttataaatattttataatttttatataatgtcatatgaccacattataacatctatatttttattattaaaccaatttatatgtcaaaatataaatatatgttaaaaaaatgtatacatttattatgtttttaaaaatatatatacatttttttaatgtcataatataattatctaaacaaatgtaaggaggtacgcatatcatggcattaggtcttttaggtcttttatttcttttatgtatatttttatcaattataggcattttctttgtagttttaaaaaacgggtatttattaaacaaaaaatggatatttatatcacttgttatatattgtcttttattatcctttattaactttactgcagcaccttcaaactatttaattaataaactctttggaattctttttgcactatgtgcaatttcatctatattttttaactgggtgatttagaaccactttatctgctcttcataatatcctcttttataatcattaataatatcattcatcttataagctattccatatttcttgcactcttttgtaaaaatactccaaagctttctgctattttgagatgaacattcataactattaccatatgcattcatatattgttcaactaatttcttttctggaaataacttaattagtttttcataataataatctctttgatttcctctaagtgtaagccccataccataagcaaaaataaattttgcaccattatcataggcttttctcactatatttataatattttcctcagtgtcatttataaaaggaaggataggcattaataaaattcctgcataaatgccttcatcacttaacatttttaaagcttcgaatctttttgaacttaaacttacattaggttctattttactgcaaagtttatcatcatatgttgtaattgtaatttttataattactggtgaatgagttttaattctctttaaaatatcaatgtcacgtgtaattaatgcacttttggttgcaattcctattccaaacccaaactcatcaacaagtttcagtgcctctctggtatattcatatttcctttcaaatatattatatggatcactcatagacccagttcctacaacgccttttttacgtttacttttcaaatcttttcttattactgctgttgaatttaattttgcccgtacagcatcaaattcttctattccatagcactcgcttcttgaatcacagtaaatacatccatgtggacatcccttatatatgttcatattatagttaattccaaaccaagaattattcccttgatatgatgatactatgctttttgcttctatatatttcacttttaattattccttccttaaacattttactaaccttatacttaaattaaatcataccattactgacataagtatgtcatattttaaaattactttggcttttctataactataatataaaatactgttacagaattacatgccccttctataacagtattataatttattttttaattattattgaatttttaggacatttataaacacatttctgacataatatacaatcagaatctgtaacctttccatctttatattcttttggtgatattcccataggacactgtttgctgcataaattacaacctacacaagtatctgatacatataaatttgtttttcttcctctatattttgcaatagcataagaaattgtccccatgggacagaaattgcaccatgttcgctcattataaatagcacctaaaaccatagctactattgttgttattactattattttataaaacacaaatcctattccgtataaatttccccaattcttatatacacctatagaaaaattagttattatgaataataccataaatattctaaatatagtattcttaaaaaattttggaactttccttttgggagaaattttaattagtatattatcataaaagtttccccttggacaataatttccacaccaatagcgcccttttcctattaccgcaaacaatactggtgctgccatacatattattgctgctattgcaaaacgcatatcaaatagggatattattagaaaaaataataataaaaagtatccatattttttataaaatttattcatcttacttgcctccactacatttattatcattgcataacattattataaatgtagtattaatatttttttgtgactttgtcacacatttcaaagtcacactattttttatagcaaataaaaatagatgtatacactaaaatacatacatctattttaaatcaatttctattttctctactaaaatttttgccgaatcaaaatcagaaagtttattaaactaatatttctaacaaatccttaggtgtctccacaacataggaagctcgtgcttgtgttagttccacaacatctccgtatccataaagaacaccaatagattttatgttattttctttagcccctattatgtcatgctctctgtcaccaaccattatggttcttgaaagatctgttatgcctgcattctcaagtgaatattttattacatcacctttttttactcttgtttcttcaaagtcagctccaccaataaaatcaaaatactttgctaagttaaaatgctcaagaactactttagcatgtacttctggttttgatgttgctattactagtgttttaccattttctttaaggctttttaatgtatcttctattccctcataaaccttattttcataaattcctttatcactataatattctctgaattttgttattccagtttctgctttttcatcatcaaaatcataaaagtttttatatgaatctctaagaggtggtcctacaaattttcttagttcatttaaatcttcaacttcaatgtcaaaatactttagagcatattgaactgcttttgttattccttctccagagtctgttaatgttccatctaaatcaaataatatgtattgaaaatcatttttcaaaatgtgtacctccaaattccattatagttatcattatatcatctatttaaaatgtatcaaattattgtcttttataaattcactaaattatatacaacactctacataatataaaaaagtatctgcagttagattaatgtataatcattcttaactcagatacttttttataaatatttttatttatactgcttatattttattattaattcaaactatcgtagataattcaattttcataagtttacctacatgactcttttcaagattattatattctttgcttctgataacttttttctttatcatatcctttactttatttcttgacacattaattatttcacttaaaaccttatctacacgtatttttaattcataaggattatcaataatcatgatcatttccttgtcactaacacatttccccaatttatctttgaatagtatatcatatattattttatcttcgtcaatgacagcattattccttaaaaatatttctttccttgtgccatattcaaacgcaagattaaaatcatttcttataaatttatcatattcttgtttattaatacaagacatctttactctttcatatatagtaagattatatgtgtgacgacatttttcacattgataaataagccatacatccaaagcttttccatttgcatttactctaaaattatttgtattaatataattagttttacatccacatttagggcaatttctaataatttcataagattttcgtggtaaaattttacatttattttctatatcatagctcatattgcatctcctcatattttattaacattggagctgcagaggctatatgccaatatgaacaatttattttttaattactgcatatgcctctgctatgcaatataattaggtctacacataagcacttcccctttctatttttagaatatactataatgcatatgtatacgaccttaagattttttcaaaaaaagaatgagccaatacacttatgtaaattactctaactataatataatagcgtaactcacatgtattaactcatattatttatcctactattttctttttccctataattctttgtatgcttttttctgataaaaaatacttttctgcaagctgtgaagtttttaatccatttttataatcaacataaatcttatcatttcgatcttccaactcttgtcgtatatttgttgtatttccccattctttccgctgattcttttttcttgggatatatatacattctccatctacatagttctgaattaattctattatctctagtggcagaatatgttctgcttttttatagctcattttgccctcctaaaatttatattttttaggaatagcaacagctataacaaacttctatagtaaaattgcaatagctgatgctatgcaaaaataacaggtctcttcataaaataaccctccttttttcatttaatacttttatttcaatttatacaatattataacatataattatcactttaaaataacctatattaaaacacatataaatttataactattcaatatttaaattatatacgtttaatatataaatttcttatatttaaatgtattctttaattacttcacctattatctttattccatatgctatcctatcttctggcatatttgaataatttattctaaaataattctcatgtcctccatttgggaaaaatgaaccccctggaacaaaagcaacatttctctccagacatttcttaagaagatctcttgcatcaatattttccggaagcttaatccatgtaaataatcctccatctggcttattaaattctacacatgtcggaaattcttcttccattgtatttaatgcaagttcgcctctttttttataaagttgtcttattccttcaatatgcttatctatatcatttaattcaagatattttgaaatttccatctgtgctgatgtattgcattgaaggtctgtactttgctttattactacaagtttttcaattatttctttatgagcggctacccaagcaattctataccctggacagaatatttttgaaaaagttccaaaacatacaacatttccgctttcatcaaaatattgtaatgacggtagatttctccccttaaatctgagttcaccataaggattatcctcaattataaccttattatacttattagctatatttactacagactttcttctttctaatgtccaagttactcctgttggattctgaaatgtaggaatagtatatattaattttatattttttgtattttttattattctttcgagttcttctggaatcattccttctttatctgtaggtacttctacaaatctgcattcatatgccttgaatgcacttattgcagcaagatatgtaggactttcacacaaaacaacatcatctttgtttaaaaatatttttcccatcaagtcaagaccctgttgtgatccatgagtaattaatatattctcagatttaaaatttgtattaagggtagaattcattctacttgcaatccattttctcaatggactaaatccttctgttgttgaatactgaagtgcctttctaccactttcttcaagaacaattctgttagcttccttaatctgttctattggaaaagtttcaggtgctggaagtcctcctgcaaatgaaattatttctggtctttctgtaacctttaatatttcccttatttccgaagccttaattaaagacattctatctgcgaattcaaaagtcattttatttcactcctaaccaatgttttacttattagttattttaatcttgatattgtatgagtgcaatgttaaaattgtatgcaaaacaatatttttaaggaggattattaatgcctgtaaattcttttgaaaattatccaatgtcatggaaacctgatataactagtatgatccccctttatataaatcgcttgcctctgcacttgaagaagacatacgtaacggaattttgaaacctggagataagcttccaccccaaagagagttggcagattttcttgatattaatcttagtacaataacaagggcttttaaaatatgtgaacttaaaggattaataagtggacatactggccgtgggacttatatttcttctgatgtacacatttcttcaaaacttctttgctcagactctaataatagctacatagatatgggtgctgcatatccaatatatgaacaaaataaatatataattgagttcatgaaaaaaattcttaaaaaaacaaatatagataatcttcttaaatatgccgaaccttgtggattactttctcacagaattattgctcaaaaatatctcaaaaattttaatatcaatacctgtccagaaaatattatgatttcatctggctctcaaaatgcacttgcaataatacttacatcactatttaatcctggagataaaattgcaactgatcatttaacttatccagcacttaagactcttgcaaataccttaggaatacgcttaataccacttcctcttataaaagataaaatagattttaaagcatttgattcattatgcaaaaatgaaaaacttaaaggaatatatcttattccagaattaaataatccaactactcattctatgacattaaatgaaaagaaaaacattgcacgtttaataaaggacaataatctaatttttattgaagatggcatttattcatttgtagctgaacatgattctatgcccattgcatccttgattcctgaacaaagcttatatatctgttctgtatcaaaatcactatgcgcaggacttagaataggttttatggtaattccagataaatttaaagttaaagttgaagaaggtatttataatataaatcttgttacctctccatttaatgctgaaattgtatgtcaaatgattgaaagtggacttgctcataaaatcgtaaaagaacgtaaagaaatgacattaaaaaggaacaaaatagttgatgaaatattgcgtaataatattattgttggaaataaatacagtccctttaggtggcttatactccctaaagacatagatagccaagccttcgaaaatgctgcaaaaagaaaaggtgtaaaagtatattgtgcttctagatttgctgtaggaaatagtaattttgctccagctgtaagactttctatctgttctccaaaaaatataagcgaattaaaaaaaggtcttcatattctgaatacccttctttaatatataattgcaatatcttttaaatactaaagttttatgtcatatataaaaacatactatttagaaaatcctaaatagtatgttctttgttctgtgatttattatgaataatataacttttctttgatggtatttgaactattataactgctataagcataaacatacatccatatatctcttttaaagacatactttcgcctaaaaaaactgctccaaatattactgcaaaaacagattctaatgttaatgttatagcagcaattacaggaggtacatacttttgacctacaacttgtaaagtataacatacagccacttcaatgactgaagtatatataataggtccaactgccataattatgctacctatatctatgctctcaaaagcaaacatacaaattgctgacataacccctgacgttataaattgaacaaatgataattttataacatcatatattttagaatatttatctattaacataatctgaaatccaaaaaatatactacctaaaaaaactatacaatctcccatctggactgatattccatttgtaatacacaataaatacattccactcaaagctataacaatacctaatactatatttagaaatatctttttggtaataaaaattgctgctattgcaactacgattatttccatagctgtaataaatccagcttttcctgaagttgtataaataagacctatttgctgaaaggttgctgcaaaaaacataactattccgcataaaactccacttttaattaaatctttctttccatattgaactcttaatccttcagctcttttattaaaagaaaaaatatatattataggaattagcaagcttcctccaatcatgaaacgaaatgcccccaatgtaaaaggtcctatataatccataccttttttctgaaataaaaaacagcttccccataatatagacgctaataataaaataatttcacctttaattacatttttatcaatatattttttattcatatttcaccttctaaatttatatctgttcaaattataaatcctcatataatataaaaatctcttaaaaaagtaaaactccaaattttatatttggttagttgaactttctcagtagagcttttaaaattaattgtccattgtcacatatcaattacaatatctaaatacaattatctagtaactaagaataggtttatacatctcaggtcttctatctctgtaaattccccacgactgacgtttctcccttatttcatcaagatcaaattctgctacaataaccccttctttattcctatccatttgctttacaatttctcctgtaggtcctgctataaaagaacttccgtaaaaagtcatagaagactcatcttgaacctctgttcccactctatttgacgcaacaagaggtataatattagccgctgcatgtccctgcatacatctttgccaatggggctggctatctataggaagtatcggttctgatcctattgccgttggataaaataatatttcagctcccataagtgccattattcttgcagattcaggaaaccactgatcccagcatattccaactccaattcttccataagcagtatcccatactttaaatccagtatctcctggcgtgaaataaaatttttcttcatagcaatgtccatctggaatatgtgtttttctatacgtatccattacgcttccatccgcatctattacaacaagtgaattaaaagtcgtatttacagatctctcaaaaaaacttattggaattacaatttcaagttcttttgctatttctttaaaatgattaactgctctgttatctttcacacttttagcaatatttaaatattcataagattctgtctgacaaaaataaggtgtctcaaataattcttggagaagtactatatttgccccctgtttttttgcatctcttaccatatcttcagctttttttaatgtagcctccaaatcccatgtacatgacatctgagttgctgcaacttttatctttctcataactatcaacctttcctaaaaactaatatacactttcatataaatcataaatttcatcttcagataataaaaaatcttttaaacatttatctttattctgaagctcaatcatattacgtataatgtcatttaattgatttctttctattccaaattcacttagtcttttcctataaaagattttattaagaatgttatcaagttcatcataaattttattttcattgcaatttaataaagtactcaatattctatttaacttttctgtgtttgctaatttttttgcatatcttcttaaaacagttgtaaaaatgatgtaatttgactctttaatagttaattcctcatttaagcttagattttttccaaaagaatgtataataccatgtccagtattaccaagagatattcctgcatagttacttgcaaaaagaaaatctctggataataaattaatgcaatcttcttcatctaaaattatttttttataaccatttaaaaatatttttattgccctttctgaaaataactgtgtatactcagttgctttaggcgatatatatgaatctactgcatttatgaaagcatttattgaattttccagaaaaatattcagtgggagtgattttaataattcaggaataagaactgcactatctgcatatagctcatcagcatttaattctttttttcttttttcattttgaaattttaaggtacatatatttgttatttcgcttccagttccacaaattgtctgaacgagtacaagttccttttctttaactatatctaacttatgattaaacaacttatttactggtgaaatattctttaaagaaaatattttccctatttctaaaatagaatttccaccaatagctataacccgttcatatgttatcttttttacactttcatatattgattccactatattatcagtaggatatccttttccatagttatcaataagaattacagccgattcttttatatgatatttcaaatactcatcatataatttctggtttgatatgattaagtcatcctttccaattctaaatactttaaaaaaatccctacatccatcatactcataaataactggttctatctttaattgtctcatctctcatacccccgaattaacacttcttttttaaataatttatttagaatatatcgataattaatcttaattttaaaaatttctataagtttttacatataaaaagatgctgtcctacactttatacgtataacagcatctttgcattaactatgtttcataaaaataatatccaaaccaattatttatattataaattaaactctttttttgtatcactaagtgcagcatccattctctctataacatcgtccatatcttccttagaaattactcctgttggttcaaatcttacacattttgcatttacaagagttccagcagtcattacccctctttggaataacccctttgctacactatatccaacatcactttcacagaattcaacagctaacataagacctattcccctaacctcatcaatcactgttggatatttcttcccaagttgttcaagaccagcttttaaatattctcctttttccctacattgtcctgggatgtcctgttctagcatatattttattgtagcaattgctgctgaacaacatactggattgccaccaaatgttggtgatcctaataaccatggattatctattaaatcttgtgtccacattttaggcttgcatattattcctgtaataggcattattccaccaccaaatgctttaccatatgtcattatatctggagttactccttcagcttcacatctccacatagttcctgttcttcccataccagtctgtatttcatcaaatattaatgctactccatattcatcacaaatatcacgaacttcttgtaagtatccttttggtggtactattactccagcttctccctgaattggctcaataattactgctgcaactttttctccaacagtatgaagatttctaatagcttttctcatatcttccgcattaccatattcaacatgttgaacctgctgtaccattggtgtgtatggtgttctgtatgtgctcttaccaccacaagatatagctcccattgatttaccatggaatgcacctactgttgaaatgtaccatcttcctcctgttgctattcttgcaagctttaatgccatttctactgcttctgcaccaccattagtaaagaaacaatattcaagatctccaggagtaatatcagctactgcttttgcaagatatcctcttaatgggtctaacaattcttgtgaatgtaatgcctgatgatcaagctgtgcttttacaacatcaagtatttcatcatttctgtgtccacatgtataaataccaaatccacctaaacaatcaatgaatttttcaccatataatccactacaataagctcctttatcgctccattctacaactgctgcattagttgaaactgactttctatatttaagccatcctggacttacataattattaaaataatttattgtatcatcagtgattttcttttttgcctcatctgctaaatcatcacttttaatatatccaattacttcttctaaatccttaattacctgttctctcttttccataatactacttcctctctttttcagattcaataaaaaaacggcgtatactgactctaaatcacatatacaccgttgtatcttacttgcttatttatttgttaatactattataaaaaatattgtccataaaaacaattctcttaatgtatgcttcttgcattattttaagagtatatgtactacttttagagtagcatatatataaaatctactcatataatcaatataacaccattcccaatattttatttatataaaattgataattcatttgatgcaggtgactgacaacaccttatatggtaaaatattcataagctatattaaaattattttgttaaaactagattgggggcgttctaaatgcaaaataatgaatttcttttaattaataatataatatatcaaatttacagcatttcagattttaatacaatgaaagtaacttttttgaatctattaaaaatgctcattccaaatactgcttcaagtatactaatggcggataatagtgattcaaacaacctgctttgtgatccaatatgtgtacctgacatatattctgaaactgaaaataaatatctatcacttgaagatcaagacttcagccgctggataatgctcagtaaacaatgtatcttgattcgtgaaagtgaattaatgtctgaagatgaacttataaaaacagaaatttatcaaaagtgttataaaccattcggagttcactactctatgcagcttacaattgtttataataatatatttcttggcgttatttcactttatagaagaaaagaagatggtgattttacaaatgatgaaatgtttattatgaaagcatttagcgatcatttaaacttaagattttatcagtctttatcattacattcatcacagaattctaataatacatattcaatggtgaatcttgcttcaacatatcacttaacaaatcgtgaagctgaaatactacaactgatttttgaagacatggacaatcaagatattgctgaaaaattatgcataagtggatatacattaaaaaagcaccttcaaaacttatatagaaaatttgatgtttcaaataaatggggcttattaaaatatagaaattaaaatttttatactttaatttaaacatagataaaactcatcctttcagtaaaagaatgagttttatctatgtttaattatttaattaaataaaaatatgcaattacaattatacctaaaataattctataccacccaaatgctttaaagtcattattcttaatatatgacattaagaatttgattgctaggattgaaacaataaaagctacaatcattcctacaagcaatatagaaagttcatttcctgtcattgtgaaaccagtcgctaatccaaacttaagaagttttagtgcacttgcaccaaacattactggaattgcaaggaaaaaagtaaattctgctgcaacagttcttgatactccaataagaagtgcccctactattgtagctcctgaacgtgatgttcctggaaatactgctgcaataagctgaaataatcctatcatgatcgccacattataagtaatttcagataaagaattaattttagatctttttcctttattataattttctattactataaataaaataccaaacagtataagcattactgctacagttgtgggattgtagaataattcattaagctgatcatcaaacaaaagacctattactgctgctggtatacatgcaattactatctttacccacattatcattgtatctttttctatttttattccattactaaatttaaaaggaaatattttttcccaatataatactataactgctaaaatagctccaagctgaataacaactaaaaacatatccataaaatcttttgatacatttaattttaaaaattgatctaccaaaatcatatgtcctgtactgctgattggaagccattctgtaattccttcaactataccaagaattattgcctttataatttctaaaaactccatctaatcctcctaattttaactttaattattagtatttaatttttattttacattttaccatgtatagtaaaattataatccgcatctattataacataattaaagataaatttaactaaaaaacaaacaatatgttccattgtgatttcatcttaatttatatttaatataaatttaaagtaaagttaatatataaatagctccagcaacaaactttgctagagctatttattatcttctaattttcataccagccaattggtcctggattaagatttatatttatttgttttatttcttgatattcttcaagtccatgtaccccaagttctcttccatatccactcattttatatcctccccaaggagcttcattaaaggttggattatagcagttaatccaagttatacctgcacgaatttcttttataactctaatagctcttgaaatatcagatgtaaatactgcacctgcaagtccatatattgtatcattagccagcataactgcttcatcttctgttttaaatgtctgaattgttacaactggtccaaatatctcttcttttactatagtcatatcagatgtacagttatcaaatattgtaggtctcacaaaatagcccttttcacactcaccttctgtatatctttctccaccacatactaacgtcgcaccctcttttttacctatttcaacatattccagtactttttccatatgggattttgatactaatggtcccatatcaggattatttataggatttcctattgtcatagcttctgccttttctttcaatctggctacaaacttatccttgattgattcttcaataattatacgtgatccagctgaacacacttccccttgattaaagaaaatgccaatcattgcccattctactgcaccttcaaaatcactatcagcaaatattacatttggcgatttcccgccaagttctaaacccgttttctttaaatttactgctgctgcttttgcaatcccttgacctacttctgtacttcctgtgaaagtaaccatgtcaacatccttgctttctgctatttcttggccaactgttgccccagatcctaaaacaagatttgcagttccttttggaagccctatttcatcaaatacttcaaatagagctattgaagaaagaggtgtatttgaacttggcttgaatactatactattcccagctgctaaagcaggtgcaattttccatattgccattaaaaatggatagttccatggagtaatctgtccacacacacctactggttcatgaactgtatatgagtgcatctgaccaaaattgtcatttacatcatagacacctccataaggttttgttataagacctgcataatatttaaagcagtgtattccatcatcaacatcaccttctgcttcacgtaatggcttcccattatctatagtatcaagataagcaaattctgattttttctcttctattttatctgcaattttcaaaagaatatctgcacgtgcctgtgcattcattcttctccattctccttttccataaaaactttctttggctgcttttatggcaagctgtgtatcttcaactgtaccttcagttgttatcgcaataacttctccatctgctggattaattacatttcttgtttttttagattttgattcaacccattcaccatttatatacattttctttatttccattttaaacactccttcttatttgcacacatctataacttaatttattttagaacctatcataaacgattatttaattttaataaatttcaacccttttctcatttaaattaatatttccacacttggcatttacttcgaattaactttcctggtttaacattaaaaacttccttgccattcactgtcataactccatttacaaaaacatattcaataccttccggtggtgtatctgtacttccaaagcaaggataatctgctttatcctcaattgtatttaaattaaaaattaaaatatcagcatctgctcctatttcaatgatacctttgttttttaagccaagcctttgagcaggcatataagtacatttatttatagcatctataagtgatattctattttgttccttaaccatagttttaaaaaattttggatatgttccggcatcttgtggatgacctggaactcccttttcatataaagttccagcatcagtacataccatgacatatggtttttcaagaatttcatacacctcatcttctcttcctaccataccaatacctgtctctttaggataattacttcttaattcttcatatatttctttactaagccttaatcctctatacttacctgttcctgctattaagctactataatcacaattccacttatcaatacatccttcatcaaaaacggcacttcctatttcagttgcaaatccactatacaacccactatctactgatatatcaagtccttctctcaaagcatcttctattatattaagagcctctgttgccattcccattccaaattgataagttaaatgagatatatttaaagatgcacctgttattcgtgtaatatcaattgcttctcttagcgttgttaaaccttcatagcaatcacttcttgtatgaatagatatgagcttaccatatttagctgcaacttttgataattcaataacttcttcttttgaacttcctggaacatattcaagaccaaatgataatccaaatacccccatattaaaagcttcttctgcaagttccttcattttttcaatctgaattaaatcagcttctctatatctatcaaaaagtcctacactttctctcaatgttgtatgtccaacttgttcaatctgatttattaaaaatccctgtttatcttgcttatctaaaaattcttttagattttctggagacattccacaattaccattgtaaaccgtagttactcccatagcattcattaacctagcacaatcttcactaccttctacgtgagtatgaatatctataattcctggacatactattttacctgtagcatttaatatatttttaccatcaatattttctcttgtaattacacttatttttccatcacttattcctatatttgccacagtacttcttttatttttagaatctatgattgttccattttttattacataatcatatttcaattattatcccacctttttaagcctttaaagcttttagctttttaacctgcattcctgtattaatacttataaatattattgtaataagcataataacagctgataaagcatctacttcaggtgttacgccagtttttaccatagaaaatatttttagtggaagtgttgtactttgtggtccacaagtgaaaaagcttataacaacatcatctaatgacaatgaaaatgcaagcattgctcctgataatacccctggcattatcagtggaagtgttacttttctaaatgttaaaattctatttgctccaagatccatacacgcttcttctaaggatttatcaaatcctgcaagtcttgccctcactgttattactacaaaaggaatagaaaacgtgatatgtgataaaataatacttgttaatcctaaaggaatatttagtatagaataaactgaaagaagagctatcccaagtacaatctctggaattacaactggaatatatagtaacttatctagaatctgcttacctttaaaattatatctattaagacctacagctcctattgttccaattactgtagatactgctgtacttactatcccaattattaatgtgtttaatagtgcctccataagacttctgtttttaaaaaacgttccataccatttgaatgtaaaatcctgaaatacaatattcatctttgaagtattaaaggaaaataatattacaacaaaaattggaaggtataaaaataaaaacacaagtgcaatatatgaatttttccatactttatttaatttttccttacttgctttattcatctaaaaccctcctaattcgtccatatctccaccagatttctgatacagccatactaaaattaatgttattactattaagaatattgataatgctgcacctaaaggccagtttctagctgtaataaactggtctcttattatattaccaatcacttgagtgttgcttcccctagaagatctgttacaaaaaataaccctagagctggaataaacaccattattgttcctgcaaatataccaggcatagttaatggaagtgtaactttcaaaaatgcctttgctggttttgcccctaaatcacaacatgcttcaagaagagatttatcaagcttttctatagaactatataaaggcaatatcataaatggaagaagcatatatacaagccctattattgcccctgtcgtgttgtagactaattgcaaaggttcatgtattactcctattttcattagaaaggaatttattattccatctttacgaagtagtgtaatccagctaaataaccttattaaggaactaactaaaaatggcactgtaaccattgacataaaaacagtttttgttatggttgttttctgtgccacataatatgtaaatggatatgcaatcaatatacatattattgttgtaactgctgatagaactattgatactccaaaaacctttaaatacataggattaaatacttgcataaaattgttcaatgtaaatccaaaattaacaccaccataagttccctttttcataaaacttattacaaaaacatatataaaaggtaatgcaacaaataatatcatccaaagagccacaggccctaccattgtaataaggggaagatttaatttcttttttaatttcataattcatcactccctatttaacaatctgattttctttactaaatactgggttatctacaacctggaatacttcctggctttgtgactttattacaactgcatcttctttatcccaataaatacatacttctgttcctatttccataagattagatttggtagatgcattcatttttatttccattccttctggaagagatactattgttttatttacatttcctatatagacatgctccttaatttttcctacaagagaaaatccttcaattgactttgtagacaactttatattttctggtcttacaagaacataaactatttcattttcacttacttctgatgccattacactaatatcaccattttcaattttcaccttaactgaatctccttttttatttcctgctattccataaaaaatattagattctcctataaaatctccaacaaatctagatgctggtttttcatatatttcttttggggttcctatctgttcgagatttcctccatacattattgcaattctatcactcatggttaaagcttcttcctgatcatgagtaacataaataaatgttattccaagctttctttgaaggcgttttaattcaaactgcatctgctttcttaattttagatccaaagcccccaatggttcatcaagcaaaagaactttaggcctatttataagtgcccttgcaattgcaactctttgtttttgaccacctgatagctggcttggttttctattttcataacctgaaagctgaacaagttcaagcatttttgtaactctttccttaatttcatccttattaatcttttttattgataaaccaaatgcaacattttcatagattgtcatatgaggaaataaggcatagttttgaaatactgtatttacttcacgatcataaggttcagtattttgtattttctgaccttcaacaaaaatatcaccatctgttggtgtttcaaaacctgcaatcattcttaatgttgtagtttttccacatcctgaaggaccaagcatagttaaaaattcaccttcatgaactaccatgttaagatttcttacaacatgattatcaccatataatttatttactttatctatttttacaataacatcactcatttatcattcctccttggaatccactttatatttttgaaaataattttattttagaagaagatattaatccatatcttttattattaaaattcttaaaataccttcttctaagtgtttaatttacatctatttttcttttaactatttattacctttaaattttgtccacaaatcaactatctttgatgaatcatctccaagatcttttaaaggcttagccttatcaagctgttccttgggaacattctttaactcattatttaaataatcttcatctaaatattcttttgcagccttattaggattaatatatggaaatacctttgaaatttcagcacttacttttgcatctaaaatataattcataagaagttctgcattttctgaattttttccaccttttgtttccatcattacatctgaatcaaaataagtcccttcctttggataaataccctttattgctggattttcctcttgagcaagtgcacattctgctccatacacaagacctaatggacattcaccatttataagaagtgtcttaggactatctccattaaatgcatggatattaggttttaatgctgttaaatattcacctgctgcatttaatgcttgatcactacaatcattaacatcatatccttttgcaattaaagccattccagtaactgctctagaatcctcaattattaccatagaatccttatacttaggatttaataaatcttcataacttgtaatattatcttttattacatctgtatttacagcaattactacacttgctgatagatatggaattgaatattcattattaggatcatttatatttccaagataacttggatcaacattcttataattctctatttttcctgtatctagcttgtctattattccttgcgattttaatgctggaacatcttttacaggcccgataatcatatcatatgttccttctgctgatgactgaagttttgcaagcatttcatcaggtgaagagaatgttgtcatatttatgcttacatcatattctttctcgaatgattcaataacatcatctggtagatattctgaccagcatattaaatttaattccttgcttttaccgtcagctgaagttgatgaacttccacaccctgaaaagctcatcatcataatactcgttgcaattgctgctataattctttttatattttttttcatataaatcactctccacatttaatttttcaaataataattccaagtctataaaataaaaaggcacataaagaatttattttcttcatgcacctttgcatacctaaatattaaagtgttatttcagcattaaattaatcctataatgctttagttcctctttctccagttcttatacgaacagcatcttctatattacgtataaatattttaccatctccaacatttcctgtggcaactttgtctctgatctgcaagatgatctcttcaaggttactttcatcaattactgcctcaactcttattttaggaagcagatttatatttgtttttaatcccttaatttcattgactccatttgaagaacctctttgagtaccgcatcccattacacttgatattgtcattccaccacaatgaacaccatctaaaatttcttttactatttctaatttttctggtcttattataagtactaattctttcataatttaattccccctctatgttattaacaattagttttctttattaatgagttatttctttaatgataatttaattcttgatattcctttatatcactaaaaaataaaagaagcacatgtatttagtttttactaatagtacatatgcttctttgcacatctcattttcacttttctttaatttataaactaattttatattctaatcataaaaattacaattacactatataactattttttttaacattatactactttacgagtagtttataattcttttatactactcctactcagaaatcatcctaaaatcatatagtaataactaatcttagaggttttattatgctaactaaaccctaaaattattttcttttttagtgattctctataagcttcttcatagctatatacatttacatattcaaatttatttttcttcaaaaattcttttatacattgaaccttctctttttgaaaatttggacctaaaattatattctcaattattttttcagtttcaaacttattaaattcaagattataatacgatcgttccttattgcctttttcgaaaaaatgtttttctccaagaagttttttttctgatggaacataaaatattcttatttctttttcatctttccattctttagttttatacatacatgaaatttttaataattctaaagtagcttcttctattgttatttgttcttttatataataattaataacttctaatgcataatgacttgaatcataaggatcatataccactggaacataatagatttccttatgatcatttacaatataaattcctattccaaaatatgatgaatgaaaattgattcctatcccttgcccatcttctgcatatcttttaaatattgttttattaaccatattagtaaaagatgcaacgtatggattaaactctggtatacactctttaaacgtctcttttaataaaagatattttttattatttgtctttttgtattcatcatctattaagtttattatgtattttcctgctgcaataacttccataggatcattgctgtttctcatatcacacaatcttatagacttattttttattatgcttttaaaaacattaagtgagcagcaatgacatgtagttgaatttattatctttatgtttgagtttaatcccataagtattttcctttctcaataatctatgtattctttaattatattatttctaatagcttaacttattatttattaacctgcatatgctccttacttatcaatacatacttttaatttttcatctgtattatttttatgattattatgttaatataaacataatatactaaagaaaaatttgaaggagtaaactatgaaaattttatttgaaactttttttaagcttattattggatttataatagcttctattggcgttgttatgactataaattctaatttaggccttagtccatgggatgttcttcatcagggattgtctaaaataacgcctttatctattggaggcgcatgtattgttgtaggtcttacagttgttcttttcagtatgttccttggtgtaaatcttggtattggtacaattttaaatacaattctaatgggtgtatttatagactggatatcatacttaaatattattcctttatgcagtaatttctttactggaacaataatgatgattttaggaatgtttctacttggtattggaacttatctctatatgagctgtggacttggatgtggtccaagagatggacttatggttgccttaacaaaaatcacaaaaaaacccgtaaaaatgatacgagctgtaatagaactcagtgctatgactgctggatactttttaggcggttttgttggtattggtacaatcataacagccttaggtgttggatattgcatacagataatttttacaatttttaatttcaatgctaattctattcatcataaatctataaaagaaacttttctttggattaaaaactgtatatctagtacttcaaccacatatgacaatatatccatataatttgttatcaaagcaaaagaattcagagtgtatacttactgccctgaattctttatatcttctaataaatattttaaatataaatttcaataatcttcattgataattgctcacaatgaagatccaccattaacacctaatgttaacggcaatatacaactaaaattttactataaaccttactccattttctatgttttcagcgtaaacaactccatcatgtttatttataactgattttactatagataatcctatgccatgttttcctttatttcctttataaaatctttcaaaaatattcgtaagatctttttcatttatattttcaccatcattttcaatagatataaatttatttttttcttcatttctacacgttaatgttattgttttatcagcatacctaatactattatttattatatttgaaaaagctctatatactgacttttcgtcacatactaataatacaggattttcatcaaatttaaatttaaattctaatcctctattaactgcaattgctttttgttttagtgcacagtcagaaagaatttctctcagatccctttctacaagtacataatctttagttatattatccatttttgatacatacaacaactcttctattaattcaccaagacgattaccttcttcaagaattatatcacttgcactatttttatccataagaccatattttattccttctgcataccctttaatagacataagaggtgtccttagttcgtgtgaaacattctgaaaaaaaatcttctgttctttatcatattcatctaaatattttgctgcagtattcatagtatcaagaagctcattaagttctttgtctgaaaaatcataatcacactgcttaaaatctccttctccaattctatgtgcaaataatgataatttctgaattggttctgctatctttctcgataatattatagatgttgcaattgcaaatactccagctacacacataattgcgcataaaagtatatctatctttactgctaaattcattaacatagatatatcaataaagaaaataagatattcattggttttcttcccataatcaattatgttcatagcgcatacataataatatccattttcagtttgaattttcactattttgttggaatctaaatcaaattcatcttcttttaattcataagatatattattgtatttatcaatatcttctaacatatcatcattttcttttggaaagagtgtcttgtactgagaatctataatcatcatttctatatctgaaaatgatcctatttgtttagactgttcttgtacacgctttataatatgaatgtattttttatcttcagtattcatttccttatcgggaaatttttcttttatagaaacatcttcattatcttgagatataaatttaatattttcaagtttatattttgcacttttttctatgtacctattaaccaaaagattaaataatatgactataataaaaaatatcactgcaattaaatttattaaactcttaaggatacgacatcttatactatgtttttttgattttctagccatcttacttatcctttaacctaaacccaaatccccataccgtttcaatagatacatctgtatgtgaaatcttttttcttaatctttttaccgtatcatctgcagctcttgtttctacttcactatcatatccccatattttgtctaataattcctctcttgacactgctctttcacaattttcaaaaagatattttaataaattatattcatttggtgttaaatcaagattttcatctttaaatgttacaattttattgtgaagatttatagttatattaccaaattttaattctgatattggtatatttttctcaatattaatgttatgttcaaattctattcttctaaatattgcttttaccctcataactaatgacattgggctaaatggttttgtaaaataatcatcacttccaagagttattcctgttatataatcaatatctgtgtctcttgctgttaacattataataggcactatactttcttctcttatctttttacatatttcaaatccatcactacctggcatcataacatcaagaattaccatatcacatggctttatttgaaatttttcaagcagcaattctccattattaaaatcctctacttcatatcctgtattttcaagaaaagttttcacaagatatcttatattatcttcatcatctgctatataaataagttttgacattttactcacccctaaaactgacttaatcaactattaaaatgctaagacttcataatccttaaatagcttaaagttcttaagcaaatcttttgtaattataattttatcatcatcagtgaccataataccactaatttgttttgatttcataaattcataagctttatatttccccataataaatagaggtgtagataatgcatctgcatgaacagaatctttacatactactgttatgctctttaaatcagtttctgctggatatccagtaataggattaattatatgatgatacatctttccattatataaaaaagctctttcatatgcacctgatgttacaacagacatatcttctacagatactacagcaatattctcatttgcatgcttttctggttttataattccaatattccacattaagtcatctgctttttttccaagaaccttgacatttccacctaagtttattattccacttttaattccattttctttatataattctattattttatctgctatatatcccttagctattccacctaaatctatctcttgatcttttcttgcaagcataacacttttattatcttcacacaaaagtatatctttataatcaactaaagattttactgtgttcacttcctcaatacttaaaacttttggagaagatgaatttacactccattttttcactaatggagcaattgtagcatcaaaaactccattagtaagttctgaacaaaattttgcactcttaattacattgaaagtatcctctgatactttcacaaattttattccactatttctattaattaatgaaatttcactattttcatcatagaaatttaattttttttctaagtttctcatataatttgaagctttttctaaaaccatcttttcatcttcaagattaattgatatattcatataaattttagtattaaaaatatattcactactttctgcaaaactattcatacaattcaccatcttttcaaatttactattaactaagctttagattcagcaagtgcattatttactgcatttataataccaacgctactataagttgctcctgatgcggtatctacatttgtgctttgattttcaattatttcagctggtaccaactcaaatgctttttcataaaatcctggtgtctcattatggcttgtaatttcaatatcagatatttttccatctgaaatttcaacttgtacacttaaattcttagcatacccatctgcggttcccttatatactccatcattataatttcctgttgatacatctatgctttcagttgagtcaagtgatgcttcacctttatggtgacctccttttcctccaggccccttttctcctctttcagaattttcatttaaagtatctgcagcatcactgtttttatctgaagtactgcttttaatttcatttgaagctgtatatatttcattatccttttttccttgaaaattacctacaacacttgttcctactgaccctaaaaccataccacatattaccgctgctactattttatttttgctatttttcatttttattctctccttattattaatattttttcgtatattattttataattatttcattatctataatcttaatcttattattctcaaaatcatcacttgaacatgaaattgtattatcttttggacaaactttataatcaacacattcaaaacacgatatacatccaagttctcttacttcatctgatgaatgtacttctatcttcataggacactgtcttgaacactttttacatcctacgcatgttgatttttgtcttacaattctaaagactttaattttattgaataaccctaaaaatgctccatatggacataaatatttacaccatggtctttgttcaaatagtgatactccaataattattgccaatatggctaatccagtaaaattaattgttcctttaaatattgataagaaaccatgatatggatttatcttttctaataacattactcccccagacattcctgttaaaataattgctaatatgagcattacatatcttaaatattttaacttatcatgtagtttctttgatataaaattgttatatcttcttttaaatattctttttcctagctttgctgtaaaatcttgaattgctccaaatggacatataaacccacatattattggtccaaataaaacacttgccataataacaagtcctataattattcctaatgtactttttagtttcacaacaaacaatgtagatgaagttaaaaattgatatatactggtaacaccacatattggacagatataatgaaatgttgattctgaaatccaaggtattgccttatctattgaacttaagtaatgatttaatgctgcaacaataacaacaatgagcattacaagttgaactgttaatcttaatgtgcttttttttatatttttcataaccgcttcctcctacaaatatttctgtattcattataagttattattaggagtctattctccgaaaattagtggcatatttgtggcatatttgtggcacaaaaaaacttaagccatatatgatcataataaaaatttatagctataaatttatctcaagtattttatatatgttttttcacctcttaattcatttatttcacctcttacataattctcatttacttctatttaattccagatataatgatattaaatcaaatttaagaaaagaggactaaatatgaaattattcaataaagattttatactagtattaataggacaaatcatttcattgtttggtaattcaatattacgttttgctctaccactttatatgcttaacattacaaaatctgcttcactttttggaatagtatctgcaagttcatttttcatgatgatgttagcttcatttttcagtatacagcttatgtcatgcttacagattctcacaccaaatgaactgcttggaaaagtaatttactgtgcaatgtgcattgtaatgtgtgcaactccattaggtcaagcaatatatggaatagcttttcaacatttttcaaaaatccctcaaattattttcttaatagctatgatatttactataattattggtcttggaaccactagaatatttagagatgttgataaattaacaaaaactattcagcgaggaatttaggtgtttaatatgaaagtacaaattgatataaatgaagatttgaatgacttagaaatcataataaaatgtgctgccataaacgatactgttttgacacttcaaaaatatttattagaaatttctaaggaaaaaaaacatcttatattttttcaaaatgagaaagaattctatttttcaattaatcagattttattttttgaaacatcagaaaatggaatttcagctcatactaaaaatgatatttaccaggtgcatcataaactatatgaacttgaagaaatgcttcccgcatattttatgagagtttctaagtcaacaattttaaatactcatgaaatatatagcataactaaaaacattacttcatcgagtaaagttgaatttcataatacacataaagttgtttatgtatctagaaattattataaagcattgaaaaataatctgcatgacagcagattataaatgaaaggatgaaactttatgaaatataataaaaataatagaatattcacaggtcttctgtttattattgctgccattatactaataattagtaaactaggttactttggagattttaatctatggtcattagcattaactattttcttcgttattattataataaaaagcatttatcctataaaattcgctggaatattatttccacttgctttcttatgcataatttacagtaaagaacttggaatagaacaacttacaccatggactgtgcttatagttgctactcttggaacaattggattgtctataatatttcagaacaaagttaatataaacaataaagtaggtaaagattatgaatttattgctattgatgaagaagacaaaagcaatattgttcaaaaaacatcctttagcggaataactaaatatattaattcagatgattttaaacaagctgatttacactgcatctgtggcgctatggaaatatatttcgatagagctaaaattaaagataaaacagcagtagtacaaatcaatgcaacttgttctgtaatagaattatttcttcctaaagaatggactatagaaaatcatatttcaacaacattaagtggaattgatgaaaaaaatcgtaatacaccagatggttctgcaacactgctcttaattggtgaaataactttaagtggtataacaataacttttgtataattttataaagaaagaagctgcaatttagtagcttctttctttataaaatacttcttcccattataatttcatcacgatatgttccatctttaagtttgaatgcattctttgtatttccccaaacttcaaatccattctttgtattataactttcttttctttgaatatcatcggacatcaacactccattcttaaatttaatataatacttcataaaggctttttacttcttttaaatttttacatataataactttacctttatacttattacaaatttctaaatatctttgcttatactttttgcttctacctgtaaataaaatccacttaataaattctaaatcaaacttttcttcacaaccctcagccatactttctcttactttatttttaaaatttaaatatctgctatatgcctgtttaaaacactttctccttgggaaattcataaagattatcttatcagcttctttcattcttctctcttgatgaaaatccttataattaccatctataacccaagattcattgttcataaaatcctttaccatagctttagcttcttctctatctctttctttccagtggctttcaaaatttatagtatctaagtaaagcactggaatcttgaatcgttcacttaacttctttgcaagtgttgattttcccgatccactataacctattattgctattttcattgttcctccatattaaaatcaagatatttttttataacaacctgacacaatagaaagttcttcaaacaaattattaaatctatctatatactttcaaattatctttttatttcaaagaactttttccatttattttattttatgataattacttactcctatcaagttttttaattttattgactactaatatttttttttaaaaaggtaatactaaaatcaaggttgttttacctggaaatattattttacggaggaattattaatgaaaagatttatttgtacagtgtgtggatatattcatgaaggtgatagaccacctgaaatttgtcctatctgtaaagtaggttcggataaatttaaagaaatgtctgatgaattgcagtttgctgacgaacatcgtattggtatagctgatggtcttgatgatgaaatattagaagctttaagagctaatttcattggtgaatgtactgaagttggtatgtatattgctatgtctcgtcaagctgatcgtgaaggatatcctgaagttggtgaagcttataaaaggattgcctgggaagaagcagagcatgcttcaaagttcgctgaaattttaggtgaagtagtagttccatgtactaaatctaatcttagtgctagagttgaggctgaattcggagcttgtcaaggtaagaaggatcttgcaactttagctaagaaaaacaatttagatgctatacacgatactgtacatgaaatgtgcaaggatgaagctagacacggtagagcatttaaaggtttgttggatagatactttagtaaataaatatattagattaagggagtgttttttgtgcaaaaaattaattgtgatgtaaacaactgttcacataataaaagtggtgtctgctactctaatgtagttgatattggtggaatgaatgcatgtagcgatagtggcacatgttgtggttcatttttaaataaagctttatacagcgacttaacatccaacagcaatagtgatagtcaatgtgattgtcttgtttgtaaagttgaaagctgtactcataactgcaacagctgctgtgatttacaatctataaatgtttgtggtaataattctcaaatttatgcagaaacaaaatgtgaaagctttgaatcaaaaaaataatcttaattcttgctataatacatgattttttattttacaaaaaaacaactcacattacctttaaaagtgatgtgagttgttttttgctactatttaagtacattcattaaattagccatttcaattgcagatacagcacattcatatcctttatttcctgcttttgtaccagctctttctatagcttgttcaatattatttgtagttaatactccaaacattacaggtttttcacattctaatgatacgcttgcaattccctttgatacttcgctacatacataatcatagtgagaagttgatcctttaattactgcacctaaacatattattccatcatacttatcatttttagccatcttttttgctataagaggtatttcaaacgctcctggaacccacgctatatctatatcttcttcttttaccccatgtctttttaatccatctaaagctccatctaaaagctttcctccaataaactcattaaatcttcctataattataccaaactttaatccttctgcaactaattttccttcaaatgtattcatctttcttcctcctaaaattaaaatatttattattaaattaagaatctaaattcataattattcttaattgcacagctttatttatccctaaattttcacatttaactttttgaataatttattagttaatttctaatatatgattcattcttgattttttagtttttagataacctatatcatatttattggcatttacttctacaggtactctttctgaaacttcaattccatactttacaagtccctctattttttctggattattcgttattagtcttactctgtttacaccaagttctttgagcatatctccactagctttataatcccttaagtcatcttcaaatccaagttctctatttgcatctactgtatcaaatcctgcatcctgcaatgcataagctttaagcttatttaaaagtcctattcctcttccttcctgtttcatataaagaagaataccacatccttcttcagctatcattttcattgatgcatcatactgctcaccacagtcacattttctagaacctaatgcatcacctgttaaacattcagaatgaactcttacaagcacattatcacatttatctatatttcctttaatcaatgcaagatgacatttatctgtatttttttcactaaaagctaaaactttaaatttaccatattttgtaggaagatttgcctctgtttcttttataacactactttcattttcaagtctgtattctataagatcttcaatagtaactatctttaagtcatgctccttagcaaactcaaataaatcatctcttcttgccattgttccatcatctttcactatttcacatataacagctgctcctttaaagcctgaaagctttgcaagatctacaccagcttctgtatgtccagttctttctaacactcctctttttttcgctataagaggaaagatatgacctggtcttcgaaattctaaaggttcattacttataacgagttttcttattgtatgtgccctttcaaaagcagatattcctgtttccgtatcaacatgatcaatagaaactgtgaatgctgtttcatgattatccgtgttcttttcaaccataggattcagttctagtttttctgctagctcttgttcaatgggaacacatacaagtccttttgcgtatttaatcataaaatttatgttttctcctgttacagtttctgctggaataacaagatcaccctcattttctctgccttcatcatctacaactataatcatttttccactttttaaatcttcaattgcatcttttatgctgctgaaattcatttttattcctcttttctacataaatattttttattctataatgcaatgttaaaatccattttctctaaggaaatctaatgtgattttacttttttcattttcactttctgtctttgaaaatatcataaatttttctatatatttacccataatgtcattttcaagatttacatatgaaccatgaattttctgtgccaatattgtattctttaatgtgtgtggtattatagatactttaaatacttcattatctacataagcaacagtaagacttataccatcaattgttatggagccttttaaaattatatattttaaaatttctttatctgcacttatagtaaaccatgtcccatcctctttgttgtcaattgaaagtatctgtccctttccatcaacatgtccgcttacaatatgccctccaaatctgtcactaaccttcaaagctctttctaaattgaccttattgccatcttttaatcttccaagatttgttctatctaaagtttcacccataatatcagcaacaaaagaattactgtttattttatttacagtcagacatacaccattaacagctatactatcacctattttagtttcttctaaaactttgttacattctatttcaatattccccaaaccacttcctatagatagttctttaagacttcctatttcctctactattcctgtaaacatcaaagtgcctcctttttagatgtatccttctactactatttcatttcccatctgttcatatgacatatctttaagatttacacagtcatcaatattatagaatccttgtccactcacactatttttactattttgtccacctattattttaggtgctatataaaatcttactttatcaacaattccttcctttaaagctgaaaaattaagagttcctcctccttctaatagtattgaatcaattttatcttttccaagcttttcgactacttcttgtaaatctacttttccttttttagacttagtttctattacctttacacccattttttctaacttctctttttttattaaatcagcattttcaacacaagcaactattgtattattattgttatatttaataaccttactttcaaatggaacttttaaagtgctgtctataataattcttagtggatttttacctttatgctctcctctatatgtaagagatggatcatcacttaaaacagtatttattccaaccataattccagacattctgtttctaagttcatgactatgcaatcttgatctttcacttgtaatccattttgattcgccaccacttgtagctatctttccatcaatggaaattccagctttcataattacaaatggctttttagttgttatatattttataaatacttcatttaattttctgcattctttttctttaaccccaaccttaacttcaatgttgttttctttaagttttttaatgctttttcctgccaccaaaggattaggatcaagcattcctattactacttttctaactttcttttctataagcagatctacacatggaggtgtttttccatagtgagcacatggttctaatgtaacatataccgttgccccttcaatatcttccactgcattttttactgcatttctttcagcatgagcatgcccgtatttctcatgaaagccttcacctataaccttattatcttttacaataactgcaccaaccattggattcggatttaccataccaacacctttaatagctagctctaatgctcttttcatataaaactcgtccatagtatcccctcttatctaaacttgatatatataatataattaaaaagtccctgaagattaatttcttcagggacatgcttatttttacattttttcaattatacaccatactaaatttaataaaatcataccactgttatatctaccttttaataaatagcaattctacagcagctaaacattatataaaattcacaaaatatactgacttatatttttaattaaaataaaaaaatcctgaacaaaagttcaggacataaatacaaatcaaatagtcatcttatgaaaacacaaaatgcataattaatactcttcttttatccagactatactgttggcctcggaatttaaccgaatctgctaataataagctcgcgggctataccgccagtagggaattacaccctgccctgaagattaatatttaattttatgtttttatattaacactttatacaacatctgtaaagatatttatattaaaaatttaatatttcaaaatccattttcattgattttaaccatttaatcatttccaaatcactccatacttctaaacctaatttagcgtacttcattgcttcttctggacttcctggttttactgcaccttttatctctttaatagtcttagactttaataaataatcaataactaatggatttcttttatatgctcttcttaatgctctttctgcttctttaagttttccagtcttaaacaaacatgctactctgttataattagtatctagtaaatagtcatgctcacatcttgccaatatttcttctgcttctttaagctttccttcaataataagccagcttgtaagaattcctctgcacactagattatcctttttattataggttaatacatcatttaaatttctaattgcttcttctctttcgtttatattccataaatgaagagcaagagtatattttgcaccaaaaaatggttctgcaattggtaatttaaataatcttaaatctgtatcttttaaatctgttattttcaatacattttgtgctgctttaacagctttttctaataacatcttcttttcttcattatttaagctggaattctttgataaaattatatatgcatccggacaatcctcatatatagttaaagcttctttagcatactttgccttattgttaaagtttttttctctccatgctctatctacaattttttgagctactacaaagtttttgtttacagcaaatctgaaagtatttgcttcattattttcagatatattttcttcagttactgctactgctgcttctttttctgcatctgcagatgaatcagctatcttaattgtccacttttcactgttttcatctaaatttaataaatttcttacttcctttgacttacttgatccagtactactacttactcccagttccttatataaatcaagagcctttatatatggattatttttggcatcaaacaaattatttacagttcccatggcgtgtacaactccagcagcccatgaagaagcctttccttttttaacttgttcttcattgtttaaaaataatacttttgtagcttctatgcaaatatttttatattcatcatttagatattcatttgaaaagctagttatcttttcaactatctcctcatacttaccagctaatacgttagataattcctgcattgcttttgatagctcctttttttaaatctttatgtatttgattttttaataataaatcaaatatacttttattcataatatagtattttgtaaaacactatttgtttatacgattttttaccaccttgcaattataacatattatttataattatatctacttattaattgtttttattaattgtatcttcaaaatgtactatattgttattatttcattacatgattattaatattatatattactaatctgaacaaaaccttaacaaataatatatttttaatctaacatagtatgtatacaaacttcttcttataaatatatataattataataatttgtagaagtggtcttgttttgttaagaaaaaacctatatgatttatgtagttttttatgttctccatacacacatttaaatatcattcccaaaatttctctttttacacatgaaaatattttcaatcaattacaatcaaagatagattttaaatttcagtggaataaaagaaacaattttattataaatgattttaaattctctttcaaatatgaaatacttgaacaaacttccatattaataaaagtaaaattatctattataaattcttttatattgaatccatccataaataaaaatagatcttcaatgattgatgattacattattatcgcagaatatactcctaataataatataaaattatataacctaatttctaaagaagaaaatcctcttctttaccattcattaattaataaaaaactagatttcattaatacttttcttccattaaaaatagataatatttggaatatagattttaaaactttaaattctatgtatgataaaatacaaactctatcttatcatttttccactagaaaagtaaagagaaattctaaattcaatatagaaactgcatgtaattatgcagaaacatttgcccttacacctaatcccgaatatatatcttatgaaaactttggtggagactgtacaaattttatatctcaaatactttattcaggaggattaaagaaaacatattcgtggactccttattctaatacatggctaagagttgaagagctctactattatcttataaataatgcccttgcttataaacttacagatgatgactctttatcaaaaggtaccttaatacaatttaagacaccaaggctaggtcgtttttttcattctggatttataactcacaggcttcctgatggtgaatgcctttattgttgtcacagctataataaattaaattatccattaagtcagatatatccagtactttatcctgaactgcgcagtctttatttctattgatttatagatattatattcattcatattataatacattaattgcaaatttaaatacaggtatcttatactaacactttctaagatacctgtattataaatcttaattaataattttcaaattgaaaattaaactgttatttcacttgttatttttaatgcttctttattttcttctataattggatttatgtattcgtctatgaattctacaacttgacttggcgctcttccaacgaatttagccggatctattacacctaatatttcatctcttgtaaggccaaaagaatcatcatttataattctttctattaaatcattgtctaatccttcacctttaactctttgagctgctgccattgagtgaactcttatattttcatgtaattcttgtctgtccttacctctcttaacagcttccatcattatgttttctgtagccatgaatggtaactctctttgaacgtgagatgcaattaccttgtcatatacaagcatattctcagcaatattcatgtatagatttaaaacaccatctaatgctaagaatccttcagctactgataatctcttattcgctgaatcatctaatgttctttcaaaccattgtgttcctgcagttatagctggatttaaagcatctacaattacatatcttgctaaagcactaattctttcacttctcataggatttctcttataagccatagctgaagatcctatttgatgtttttcaaatggttcttccatttctttcatattttgaagtaatcttaaatcattactaaacttatatgcactttgtgcaacttctgataaagtatttaaaactattgaatcaagttttctaggatatgtctgtcctgtaactccaaaacttttttcaaatcccattttttctgctactattttatctaaagcttttaccttactttcatctccatcaaaaagttccataaaacttgcttgagttcctgttgttcctttaactcctctaagctttaattgtgatattaaaaaatctatgttttcaacatccataactaaatcctgcatccaaagtgtagctcttttacctactgtagttaattgtgcaggttggaagtgtgtaaaacctaatgtaggcatatccttatattctattgcaaaattctttaaatgatttaatacagtaactattttgttcttaattaaatttaaggcatctctcataattattacatctgtattatctccaacgtaacatgatgttgcccctaaatgaattatccccttagcatttggacattgaagaccatatgcataaacatgactcataacatcatgtcttacttctttttctcttttagctgcttcatcataatttatatcatttatatgctcttttaattctttaatctgctcatcagttatatttaaacctaattctttttcgccttctgctaaagcaacccataattttctccaagttgaaaacttcatgtcatctgaaaaaatataactcatttctttagatgcatatcttgaatttaaaggtgtactatataaatttctcattcaaaaacctccacacgaatatattttatacttttcgtttcatcattcgtattatatcatactttataaagttttgtgtactattttataattttttgtatagttttttcatattttagctgatatattaatccttcatttatttgtatttataaatgactctcatacttcaatatttatttaaaattttcataaataaaattcattatataaacttaactttttgttattattgtatttttcaaacatataatatataaataatattttacagaaaggaagttatataatatgtgcaaattaaacatatttgataaattatcttttttactagtattaatcggttctcttaattggggaacaatcggcttattagactttaacatagtcaattttttctgtatgggaattcctatacttgaaagaattatatatgttatagtatgtgccgcagctcttaatttagtttctcttctttttagatgtaatataataagttttgataattaaaataatatattaatctttttatatatacagaaaaggttccatatttataatatggaacctttgaaactatatattagtcttctaagctttcaactaattttgcaatttcttctactgctaaagcttcgtcatcaccagaagctacaacttttatagtagcatctttagttactgctaaagataaaactcctattaagctttttacgtttgctttcttaccattgtattctatgctaacgtcagacttaaatgatgaagccttcttaactaataatgtagctggtctagcgtgaagacctgaaccgttcttaacaacaacttctttttctatcattacatacacctctttacaaaaaaattaataaatatagcatttaactcttatagtataaacgtttttactaataatttcaactcaaaatttatccaatttcattaaaattaataactatctaggttgtactattaattttatggctgttctttcctctccatctatttgtatatcagtaaacgccggaatacagactacatcttttccgcttggtgcaataaaacctcttgctattgctatagccttaacagcttgatttatagcccctgctcctactgcttgaatttctgctacattctgctcttttattatagccgctaaagctcctgctactgagtttggatttgattttgttgatacttttaatacttccatttttattattcctcccagaatcatattaatcgtttacattatttatattctatacatctattaaaaatcctttatttttatatttttttttaattttaccttaaaaatttttaaattattaattttttgttaaataattaggtttaaatttagtatttattcaactaacttttacttaagaatggatactaaaaaaagtaaagcacattttgaaaatcaaaacatactttacttctatcttctactttgcaaaatctactgctctagtttctctaataacattaattttaatttgtcctggatactcaagttgttcttcgacactcttaactagattatgtgctaattcaattgtaccgacatcgtcaactttttctggtttaaccataattctaatctctctaccagcttgaatggcatatgacttttctacaccttcataagaatttgcaatttcttctaatttctctaacctcttaatgtatgcttccaatgtttctcttctagcacctggtctagctgctgatattgcatcagctgcctgaactaatactgcttcaagagactgcatttctacatctgaatgatgggctgctattgcattgactactaatggtgattcatgatatttcttagcaagatctccacctattaatgcatgtggaccttcttgttcctgatctacggctttacctatatcatgcaacaatcctgcccttttagctagagtaacatctaaacctagctctgaagccatcaagccagctaaatatgaaacttctatggaatgttttaaaacattctgaccataactagttctatattttaatctaccaagaagtctaataatttcaggatgtaaaccgtgtacactagtttcaagggccgcttgttccccttcttcttttatactattttcaacatccttagttgctctttcaaccatctcttcgattcttgctggatgtattctgccatccactattaacttttctagtgccattctagcaacttctcttctaattggatcgaaacttgataaaatgactgcttccggagtatcatctataattaagtctactcctgttaatgtttctaaggttcttatgtttcttccttctctacctattattctacctttcatctcatcattcggtagggcaacaacgtgtacagttgtctctgacacatgatctgctgcacatctttgaatggcagtagttataatctctcttgacttcttatctgcctcttcttttgctctgctttcaatgtctttaatcattaacgcagcatcatgtgtaatttcttttctaatttcatctaaaagaatttcacgagcttcttcgcctgaaagggctgcaactctttcaagttctgctcttctttcattataaagttcctgtacctttgcttctacttgatctaattcaagcattttttcattaattgtttgttctttgctttctagaagttcacttttcttatcaagtgcttcttctctttgaattactcttctctcaagcctttgaatctcattccttctgtcacgagattctttatcaaaatcatttcttaatctgtgaagttcttctttagcttcaagtattgcttctttctttttagcttcagcatctctttctgctctctttaaaacttcttctgcttctttttcaagtgattctactttactttttgtagtattttgaaccgacttataaaccactattcctaatattgctaatataacgatatcagcaattatcattaccgctagttgcacatcaacacctcctaatttaatatttctcatttatcttaataagaaagtaagtaggtgtcatactcttctcactgcattcggaatatgataaaccagtattcctttttattctatattaaaaataaaaatatgtcaagtttgcccatatactgcttatttactccattatcctatcttatccttgataactgtgaaaatagctgcatatacgactcatcatacatacagctattttttgaataatttacaaaaatcatattaaactttttgtaaaaatattttatttttctttagtcttatcttctttagaaacagtatctactgcgctttcacttttagcttcagctggtgctgcttcagctaatggtaaattatatttagctctaatttgattttctatgtcaagagctacatctggattatcttttaaatatacttttgaattttctctaccttggcctaatcgtacatcaccatatgagaaccaagctccgctcttttgaactatttcttctttaactcctacatcaagtacattaccagttcttgatattccttcattatacataatatcaaattctgcctgtctaaatggaggtgcaaccttattcttcattactttaactctagttctgttacctattattgaatcaccttgttttattgaatctattctacgtatgtcaagtcttactgatgcatagaattttaacgctctaccaccagttgttgtttcaggtgaaccgaacattactccaactttttctcttaattggtttataaatatcgcaacacaattagttttatttattgtacctgcaagctttcttaatgcttgagacattaatctcgcttgaagacctatatgagaatctcccatttccccttctatttcagcttttggaactaaagctgcaacagagtcaacaactaatacatcaatagctccagaacgcactaatgcttctgctatttcaagaccttgttctcctgtatctggctgagaaattattaagctttcaacatctacacctatcttttgtgcataactaggatctaatgcatgctctgcatcaatatatccaacagctccaccttttttttgtgcttctgctgctatactaagggctactgttgttttacctgaactttcaggtccataaatttcaattattcttccctttggaactccacctattccaagagctatatctaaatccaagcatccagttgatatagcatccatagtcgtcacattatgatctcccaatttcatgactgaccctttaccaaactgcttttctatattactcatagcactttcaattgcttttagcttttctgcatctatatttgccataatcctaccatcctctcatcgaacttatgttctatgtattaattatagaataattctcatacttagtcaataattattctaagaaaaattccctctttatgtatatataaaagaaggaattcattttaattatatccagttataacagtttctaaacaatgacatcagttttatttatcagtatctaaagcttctctgttatgcttaaagtattcatatccagaaattattgtaattattactgctgccataagcataattgatggtacaatttcaaaaaattgtgaccatatattattatttctaacaagcttagttaaatattgaaaatctccaatattcacttttaatagtaataaaattatcgctattatctgtattactgtttttatctttccccaccagcttgcagcaattacttttccttgggaagctgcaattgatcttaaacctgaaactgcaaattcacgtgcaattataattacggcagcccatgcaggaacaacatgtaattcaaccaatgatataagagccgcagttacaagcaatttatcagctaagggatccataaacttaccgaaattcgttatctggttcctgcttcttgcaatataaccatcaagcttatctgttatagatgctaaaataaatattacggttgcaatagtgctaccataaggtatattcttagctgcaataaatactaagaatacaggaactaatactattctgattaaagtcaatttatttgcaagattcatcaaccacaactcctaataaatcataatccatactctttgttatctttactttaacaaatgtacctatttcaagattatcgttacacttaaaaaatacctctgcgtctatttcaggagccatctcatagcttcttccacggtaatcttctccatcatatccttcaacaagaatatcatatattttgccaattttcaattcatttattttttctgaaatacctttttgtaaaagcatcagatctttttctctttgctttttaacttcttcatctatttgtccatccattcttgcagcaggtgtattttcctcctgtgaatatgtaaacactcctactttttcaagtttataatcttgtaaaaaatcttttatttcattaaagtcttcttctgtttcttgtggaaatcctactataaatgtagttcttattatcattccaggtattctttctcttaatgtatcaatttttttaagtattgcttctttagtagtctttcttcccataagttttaaaacatgattacttatatgttgtatcggaagatctaaatatttaacaactttattattttgagccatttcatcgataagttcatcatatatttcttctggatagcaataaagaactcttatccactctattccttctattttagataattcatttaatagttcatgaagatttttctttccatatatatcacttccatacatagttgtatcttgagctataagaattaattctttaattccttgagatgcaagttcttctgcttcctttaatatattctccatttttctacttctgaatttccctcttattttaggaattatacagtatgtacagaagttattacatccttcagctattcttatgtatgcacttcccttttgtgtagtaagaattctgcttccttcgtttataccttcatctgtatagtttacaagtccttcttttttctcattgccgtttataaaattagttataacactattaattttatcataatcattaactccaagcataagatctaattctggaataagttctccaagttcttcactgtatctttgaataaggcatccagttgcaataagaagcttacatttataattaactttataatcagccatttctaatattgtatcaatagattcctgcttagcactttctataaatccacatgtatttactattaatatatctgcttctttaggattatttgttattgtataatccctgctcatgtttccaaggattatttcagagtctactctgtttttatcacaccctaaacttattattccaactttatacatgtttgttttgtcttttattctaattggatcttttacaatctttaaattattatcactcaaaatttgtatcctcctgcgttttgataggtttaattatagcaaattagaactgttttttacaagtcactattattatacacctatttttatacattaaaattaaataatcattaaatttgccaattaaataaaaataatgctatctactttttatttaattggcttaactcttaaaacttaattttcattgttttgttcattcaataattgttcttttgtaactagtacctgccttggtctgcttccatccttttcagatattatatttctttcctccagttcatccattattcttgatgccctgttaaaacctactcttaatttcctctgtataaaagatgttgatgcctgttgaaattcaacaacaatatttatagcatcatttaaaagttcatcaacatcatcattaccatcatgacttcctgatgcgcttgagtcagctgcagaatttatatgttcaataatatcttcttcataagatgtatcctctccctgttcactcttaataaatgaaattacctgttccacttcttcttctgaaatgaagcacccttgaactcttaaaggcttactttcacctacaggatagtagagcatatcaccttttcctaataatttttcagctcctgaactatcaagtatggttctagaatctatctgagaagaaactgcaaatgatattcttgatggtatattagcctttattactcctgtaattacatcaacagaaggcctttgagttgcaataacaagatgcattccagccgctcttgccatctgagccaatcttcctatataatcttcaacatcatttggacataccatcattaaatctgcaagctcatctacaataattactatataaggaatcttttgctctattattcctttattataaagttcattatatgattccatatttctaacacccatgtcagcaaacaacttatatctctttgtcatttcattaactgcccaatttaatgctgctgctgcttttttaggatctgttacaactggtatcaatagatgaggtattccattgtatacattaagttcaacaactttaggatccaccattagaagttttacttcatttggattatatttatataaaatacttattataagtgaatttatacatacactcttacctgaccctgttgcacctgcaattaatgtatgaggcattttacttaaatcgccaacaacacacttacctgatatatccttaccaagagcaaatgccaacttctttttagattcaatgaattcttcattttctaatacttccctaaggaatactgccgtttgttttctatttggtacttctattccaacagctgcttttcctggtataggagcttctattcttatccctgaagccgcaagccctaatgctatatcatctgataaatttactattttactaactttaactccaggacttggctgaagttcaaatcttgttacagatggacctttggtaacttgagtaactttagcatctacaccaaaattagataatatttcttcaagtttatttgcactttcaataagttctttcttatcactgctatttaattttgtacttgaatttgtttttaataactcaagacttggatgaacatattctttttcttctctttgcccttccattacatcttgtatttctttacttacaacatctttaacattttcatcaagtttttctttcttctgcttatttgtttcttttgttataactttctcaggataactttgtttttcatcctgtttatcaagaaaactatcaatttgaatatccgatgaaacttcttcttttattggttctgttgcaatgtcatcttcctgtgcatttttcataaaatctaaaattttaatctttttatcaaccttagatagtaactctctactgcttttttcaccatcatcagattcagttttatcaacaatattaataaaactgtctctattcctggttttttcaattttacttgtgttatttattttttctcttctgctcgtcttaattttctcttttgtattataggccttaattcctaaatcatataaagttatatcaaaaatcaaagtaaccgaaatcacagaaaaagtaaataaaattacataagctcctaagaaccctaataatctgtataaaggataacatacaagatatgatataattccaccatgtataaattccgtatcaccgtataaaatttctttaaaactttctataaaattatcaggtgtatatgaaccttgtatatttaaagttccacataccatcataataacaataaccattattgttattccaaagaaacacttgtctagctgtatatttccccttgtttttatatactgaaatccaaaatatataagatatatgggtaatgcatacattccaacgccgatagctgcacatacaatagtctgagctatagttgaaagtgcaccagcaagatctgtataaattgctatagcaaatatcactccagtggccatatatattatacccgtaatatctggattgctatcacttttaacaggagcctttttgcttttgctgcccttccctttcgttttagttctcgccaactttaatcacctcttcctttttattatttctacaaaatataattattccctttaataagataacattaaaaataaaatacgactatagttttttctatagtcgtataaatttaaatatacattacttctcttatttaagaagtcaaatttaataatataacttacaacgtattttcttttatcattaatttcatattatatatcattcttctataagctctcttaacttttttatagcttcgcttattccgccaacttcatcaataagaccacaatccacagcttgctttccaatcagcattgttccaacatcatttaataaatcatcagtttgaagcataaatttttctaaagtttctgattttatattagatgtccttacaataaaatcattaattctttcctgcatctttttaaagtattcaaatgtttgcgctattccaataacaaaaccattcattcttacaggatgaacaatcattgttgctgaaggtgttataaacgaaaaatcagatgatgttgcaagaggaacccctattgaatgacctcctccaattactatagatacagtaggttttgacatactatttatcatttctgctatggcaagccctgcttcaacatctcctccaacagtattgagaactataagaactcctttaacactatcattttgttctatctcaataagttgtggtattatatgttcatattttgttgcttttgtctgtggtggcaaaactgaatgtccttcaatctgtcctattactgataatactacaatatctctattgggattcgctacagctgtatttccaaattcttttatatccttcattttgtcaacagcttctgaagttttttcactattattatcatttccatcttcttcatttttcaaaccattatttaaaatatctttttccataaaaacgtcctcctatgtactctgctttttttattctgcacatatggtttagtttttattcacctttattttttagaattaatattttcttaccacttatcagctcctttatactcttcctcaatatatttaagagccattgttattgtatttatttactttattccccttattctaattgttctaaaactaagctttattatttctttgactaaatagccaatctatcgcctcttcattattataagcaggaacccatgcaaaatgattatatatagcattttcatctactcgtacaccggcttttaacatatcttcctctgaaaattctgtaaatttaatattgcttcctaattcttttaatctatatacaatagtcttagttcctataatattattgttatatttatattgatctttttgtccatacataggaactacaggatcatttgtagcatgaaaagcccatataggcatttctttaatattttccattaatgatatatccccttgtccacaaactggcattgctgctgcaaacatatctggatatgaagttatcattccccatgttcccatggccccatagagcatccagtaatataaattcttgatttatcaatacatggatattcactttctaaatcatttaacgtatctaataatgcttgttttattttaggttcattccacccaatctttcctgttgtatcaacattaaccttgagttctgctggaagctgtggtgctaatacatatgatttatacttagattggattctatctgaagcaaatcctgttatcatatcatttgcagtaagctgaatactattatcactacctacttcaccaccaccatgaagcactaaaactaatggaaccttttcatcactggtaacttgtggagtatacaacctatattgaagcatttcgctatcttctgtagccttatgaatccctgatttaaatttatcactatctcccaaatcaaacttaatatcatttttagaaatatttaaatcatcagttttagtacatgttatattaaaattagtattatatgatattgcttcaaagtgcagctctacataatcttctcccaattgaattttgtcaactttttcttttaaggtattatcaccatctatatattcaatttcaaaatcatctgatgataaattaaaccttgataaattatctccatataattttattgactctaccttatttccaaaatcgcttgtaggtgcatatcctttagctttaaatgtatatgaatgagcgactgaactattagtcagtatacttacacatactactgataaaataaacacatttcttataaatttactcattactatttcctcctgaaccatatatttttagcatttaatcttatattaatctaatgtttatacatatttttattttctatcatattttatcaatagcactacaaaatattaatttcatagtgctctattttaacttttaaacaattactgtcaataaatcttcattaaaattgatatttttcttatcttcttcaacaacatctaaataattatctgaatttgtaacaattactggtgttattagcgaatatccttcttttcttattttatccatatcaaactccaacaaaacctgtcccttacttactttatctccctgttttgcttttggagtaaaatatttgccatctaattttactgtatccattcccacatgtatcaatacttctactccattatcagttgttatccccattgcatggaatgttggaaaaaatgttgtaagaactccattagctggtgaaactattttcccttctaaaggttctatggcaattccttttcctaatgctccacaagcaaatgcttcatcttctacatttgataattcttttatatttccttttaatggactagctaaaacttcttgcttcactaatgtattttcattatttgaagaatcatatttttttgaagcactccctgtcatatcattatcatccaattttacaaataacatggctaaaaatcctaatactatcccagctattgatgcaattatcattccaaagaacgccatattaaatccactttcccccataaaggctgggattgcaaatattcccattcctccaacaacatataatcttgaaccacagaatcccaatattccaccagttacagcacctataacacaacttaaaacaaatggtttctttcttggtaatgttattccgtatattgctggttcagtaacaccaaaaattcccgaaattattgctggaatacatagtgattttaactttttattttttgcttttagcgctatagccataactacacctgtttgagcaaaacatactgcacaagaaactgcaactattgtatcgtatccaagaactgatatattgttcattgctattggtactaacccccagtgtaaaccaaacataacaaatacttgccagaatccacctataaatactccagctaaaactggacttaaattgtaaatagacattgtaacatttccaagtccattactcgcgtaagttgcaactggacctatagctaaaaatgttattggaattactaataacaaagtaaataatggaactataaaagtttttataacatctggaattattttcttccataacttttcaacataagatgcaaaataaattgaaagtattataggaataactgatgaagtatatccacttgcaggcattactactggaatccccataaactcaagagttttgcctgctgttccaactattgtaggataaactagcgaagcacctatagccatagctgtatattgattaacattaaattttttagctgctgtgaatcctaagaatattgggaagaagtaaaataaactatctcctattgcatgtaatattgtataagtaccactctgatcacttaaccaccctaaagcaattgccattgatagtaaaccttttatcatacctactgcacataacactccaagtacaggttgaaatactcctgatacaatatctatgaatttatcaaatgctcccattttttcatttgaatcacttcctttattttctgccaatcctccaactgccataacatctgtatatacatctggaacatgattgcctataacaacctgatactgtcctccactcttcactacagtaactacgccatccatattcttcaaaacatctgtattagctttactttcatcttttaacttaaaacgtaatcttgttacacagtgagttaaactattgatattttctttgccaccaacattttttattatgtcttttgcaagtttttcatatttcatttctaacctctcctttaatatctgaaatttaattatttttatataaaaaaacaagaccagaattccttaacaataacagaaataaattctatatattgttaacaattggtcttgcctgatttaacagtaacaatctttatttaattatcgacttgtaacacgctgtatatgaagagtgagatagagctgttcttcctcacttaaattaatttttaagtatttttctatcttaagcatacacctataagcctttgtatattttttctttacttgacttaatataaaatcttctgattcatcttcataaaattctttattataaactctcttaaagaaaaatctcaaatgtgttacaaatctttcataatttaatgatttttcatccaattcaatgtcataagtgtatttcacaatatttagaatatcattaattttctttgtcatcctataaatatcatgatttctgcttgtctcatcattaaactgagctgttattagatgaagcgctatatttcctgcttcttcttcattaagcttttttcctgtttcactttcaataaattctaaagctttaattccaatattgaattccttaggatatagcttttttatctcccagatgagtacattgggcctttctattccttcatcaaacaattttaatgtataacttatatggtctgtaagtgttacatatatataatcatttatattgcatttaagattatttttagcgtattctataatatcgtagcataaggatatttgttctgtcggtatatcttccaaaagcattttaaacttttcaaatgtatctttttcttttaacgtaaaagtcttttcaattaatgcttcatctatttcatctccaacctttttcttaaatgcaagtccacatccaattaatactatttctctattattattatcttttgccataactgcattattgttgaaaattttacctatcttcactcatataacctcacttcctaatatactaagtgcgctttaaataaaaaaaccttaattaatcaaaaggaacgaatgctctccattatttaggagaaataattcatacaattccttctcattaattaaggtatcgcctaatctaatagtaacaatctaaaattaatgtaaacgtttatttcatttttattataaatctattatatgactttgtcaatatattttttctaaattttctaagcaataccataattaagattaacatgctaattttaattacttaaaaataataggatactgaacataaaatctatacagtatcctactatctattcttattctatatcaataattctatctttgtaataatatattttgtctctttcactaatctcacgcattaccctacatggattaccaactgccacaacatttgctggaatatctttagtaacaacacttcctgctccaattacagaattatcaccaatatttactcctggcataattatcgcacctgcaccaatccatacattgttgccaatattaacaggtatattaaattgtgcaacttttgcacgaagttctggatcaataggatgtccagctgttgctattgttacattgggtccaaacataacactatttccaacaaaaatatccgtatcatctacaagtgtaaggttaaagttagcataaacattatttccaaaatgagtattcttgccccaatttgcatgtaaaggaggttctacataacaattatcccctacttcagctagaagcatttttaaaatttcatttcttttttccatttgagatggacgtgtatggttaaaatcatacaatatttcaagacactgttcttgttcctttgctatttcctcatcagtgcagaaatatactttaccattattcattctttctcttgttgtcatgttattatcccttctttcaattatattttatataccttaatgtattatagcattatattattgctagacatcttttacttttctatccggcagctgtgccaatattattgcaataaacacaagacagcatcctataaattctttaaaagataaaacttcaccaagtattatccatcctgatattactgcaaaaactgattctaagctcattattaatgtagcaagtacaggtgttgtatacttttgtcccattatttgcagtgtatatgcaactcctgatgacattattccagcatacaaaattggattataagcactcaatatgtctgttatgcttggattttcaaagagaaacatcagtataacacctaaaaatcctgctacaaaaaattgtatgcatgacattctcacaccatcaacaatagatgaatatttatcaattataagtatatgtattgaaaaacaaaaagcacaaataagtattaagaaatcacctttacttattgaaaaaccttccttcatacacaacagatataatcccacaagtgaaatcacaacgcttatccatacttttactggaacctttttcttaaatagaattccaagtattggcacaataactatgtacaatgatgtaataaaacctgattttccaacagttgtgtactgtattcctatctgttgaaaacagctggctgtaaaaagcgctacgccgcataatactcctgcaacaaatagtgtctttttatctttatgactgctttcctttactgttttttttccgatcttatctaaaagataaatacaaggtattaagaaaaccccgccaacaatatatcttgctgtaataaatgtaaatggtcctacataatccattccaacactctgtgctacaaatgctgtcccccatataagtgctgtaatcataaggattacatttccttttatattgcttttattcatattgccctcctataataaaatgttgtacaacttattataacatctaaccaagatttttcctctaaaaattaagaagatgattcttattcatataaaaatcaccttcttaaataaattattaaatttattaatctataatctaatgtacatttataaagtataaccaaccgaaaatgctttatgaagtatgtttatagcattaactgcatccttggaatttacaagacaccaaatagtcatatgagaatccgcagtttgaagaacttcaatgttattttcatttagtgattttattattctcgccataacaccaggtgttcccttcattcctgaacctacaacagcaaccttactgcattcttcaataatactatatttaaaattgtccttacttaacaatgtttcaactatttctttatcagtcttattaatagtaaatatctgcttatccgggaatatgttaattaaatcaaggcttattttatttgctgcaagaagttcaagtatatcattatactttttattgccttcattttcacttctatttatagaaacttgaattctatctccctgactagttattcctgacattattcttctatgttttctatctccgaagttatttataagagttcccctacagtcattcattgtattcttaattagaagaggtatatttccttccattgctatctctacagcttttggatgaataacctttgctccctgatctgcaagctggaatacttcattatagcttattacatctattaaatctgcatctttaactattctaggatcagctgtcataattccatcaacatctgtgtatatttctatcatagaagcatttaatgctactcctaaaagagatgctgatgtatcacttccccctctaccaagtgttgttaaatatccatcttcagttgccccttgaaagccagtaatcacaggaaccctaccttgatttattatgtccaaaactctttctggattaactgttaaacatttagcatctgtaaaatttttatctgtaacaacaccagcttgccatcctgtaagaggaacagcatttactcctgcctcatataaatcattactcataactactgaacttatagtttctccgcaacacataagtaaatcctgagctaatctgtttgcatttttaaaatcttcttttacaaggatagtaaagtatctgtagcatatggtgctccttttcttcccattgcagatacaacaacaacaggactatatccatcttttattgctctctttactttttcaacaactttttgtctgttatcttcacttgaaactgaagtccccccaaacttttgtacaattattctcattattgttcctcccaaaatattgattattcaattattaagcttttgtttattagtactacaatgaatattatattacttcttatagtttttttaaatttttatataatattttaaaaattcctattcattaaaccataaaaccatgccatttatcaacattttttatacataattataacttaactctctttatattttcatcatctgcatctaaaattattgttttagaaccaatttttttcacacattcccagggaatctctaaaaaatccttgctactgaaaaaattaaattttccgccattcaagtttactatcaagtatttaaaatttccatcttcatcaattatcaaatcattattaattaaataatcatacttctcaccatcattaatgtttataagttcatatttttctatatcactaagatattttatattactttcttccttcataaaaatacctccttatctcataacataatatgaaataagaaggtattttattactgtattatacttctttatttagagtatttagttttaaagtaacaccaacatacgtatatagtttaatataaaaaactttcttattaaatttttcataagtaaatatactatttactcaccatagcaaaaaatttaataactaaaatataactcttacttaaatctcaattttactgtcagtatttgaattatcataagccttttcatttttcaatattatagaatccagtttatcatattctacatcctgacctacataggcagcatttaatataccatttttaaagcatttatctaatacatactgaacgtcttccttattaattttatcaatagtttcaataacaaattcctgagtttttaccttatttctaaaaagatagctttttgcattagcaaacattcttgaacttgtgctttcaagtcctaatatataattggctttaatcttttctttatttatctctaattgtctatctgttattccatcctttgcaaacaaagaaacttctctatctatcacttctaaagctttttcaccataattcttgtttaatccagcataaatattcactgttccaacaccttgaaacggttgtagatatgaacctattgaataacataaacctaactcttctcttactttctggaacagtatagaagatgctcctccacccaatatattgtttaatataacaagaggatagttatattcatctccatatggtaatccttcaagacctaaagatacatgaagctgttctatttccttcttagcatacttagaatcagaattaattacaacgtttccgtaagtaggcttatatacaacttcacttttccattcaccaaaattcttttctattaagtctttcaactcattatcatcaaattttccacaaactgaaatcactgaattatatggggtatatttttcttttataaatttaataatcttttctctcgtaaaagaacgtactaattctgctgttcctaatataggatttccaagagagctatttccaaagcatgctcttgaatgtgcatcatcaagaacatcttctggagagtcttgactcatgttaatttcttcaacaacaacacccttttctttttctatttcatcagggtcaaactttgcatttaacaatatatctgaaagtatatctaatgataagtctaaatgagtattaagtgctttaatatagtagcatgttgcttctttgcttgtaaaagcattaatctgtccacctacattttctatttcttccattacttcttttgatgttcttttttctgttcctttaaaaaacatatgctcaataaaatgagagattccatttacatcatcactttcatttctagatccattttggaccataacgcctacgctgattgaatttaaatgttctattttttcagttacaactcttaatccatttttgagggtatacatattaaacatgtctttgtgcctccttattctataacatactaataagcttcaatattaatgacgctttttattttttaattatctcatatctaattatttattttttaattaataatcacatatcagataaaaaaaaggcaatttaaattgccctttatttatcttccttttcatcctgttctgcaattgcatcttttcttgaaagatttattcttccttgattatctatttcagtaaccttaactaagatttcatctccagcagaaacaacatcttctaccttttcaactctttccttagctaactttgaaatatgaactaatccttctttgtttggaagaatctctacaaaagctccaaaagtagttatcttagtaactttacctaaataaacttcacctgctacaacttcttttgttaatccttcaattatcttcttagctgcatttacaccttcatgatcactagaacttacaaatactgttccatcttctttaatgtctatcttaacgccagtatcagctattattttattaataactttaccacctgctccgattacatctctgatcttatctggatttatagtcataacttcagtttttggtgcatataaagaaacatcttttcttggttcaggcatgcattcatttattttatctataatttttaatctagcttttctagcatctcttatagcattttcaacaacgttgaagctgaaaccttgaagcttagtatcaacttgtatagatgttataccttctgttgtacctgcaactttaaagtccatatcaccaaagaaatcttctataccttggatatctgttataacttgttcttgactcaaatcttcagaagttattaatcccatagcaatacctgctgctggtctttttattggaacacctgcatctaataatgctaatgttgatccacatacagatgcctgtgatgttgaaccgtttgaacttaaaacttctgatactaatcttattgtataagggaattcttcttcagatgggattaatggttcaagggctctttctgctaaagctccatgaccaatttctcttcttcctggacctcttaaaggttttacttcaccaacactatatcctgggaaattatagtgatgcatatatcttttagattgtgtttcatcaataccatataaaatttgaatttcacttattgaacctaatgttgcaactgtcattacttgagttaatcctcttgtaaataatccagttccatgagttcttggaagtattccaacttcacaacctaaaggtcttacttcatcaaaagctcttccatcaggtcttctcttttcatttagaagcatatttcttacaatcttcttttgagtagtgtataaaacttcctttatatcacctaagttatctggatatttttctgcaaattcagccttaactttttcgttaactgcatcaattgctgcatttctttcatctttatccataatatacatagcttctttaaccatatcaaaagcaaaatcttttacttctttttctaaagtttcatctatagtataaagtaaaggttcatcttttttcttaccaaatttagccatagcttcttcttggaaagaaattattttttgacattcgtcaaatccatattcaatagcttcgatcatcttatcttctggtatttcattaccacctgcttcgatcatcattactctttcttttgtagcacatacagttaaatgaagaatactttcttctcttcctttactgtctggattagtaacaagttttccatcaattagtccaacttgaactgctgctactggaattgtgtatggaatacttgataagcataacgcaagtgatgctgcattgatagctaatatttctggaatattatccttctcaactgatactactgtagtaacaacctgaacatcatttctatatccctttggaaataaaggtctgatagttctatcaacggctctaccatttaaaatagccttttctgatggtctaccttctctttttataaatccacctgggattttacctactgcatatagtctttcttcgtattcaacgcttaatgggaagaaatcaattccttctcttggttcttctgatgcattaacatttgtcataataactgtgtcaccataactagtaaatgttgctgcatttgataacatacctacttttccgaattcaactttaagttctcttccagcgatttcggtgcttagaacgttattcataaattgtgtgacctcccttcaggttcatcaaaatattttatttttagtatttcttttgaatatctttaaaataatagagcggaaaaactccgctctaaaaattatcttcttaaacctaattctttgattaaagttctgtatctttcaatatcttgatcagataaatagtttaaaagacctcttctttgaccaaccatcattaataatcctcttcttgagtggtgatcttttttgtgaacttttaagtgttcagttaaagattttattctttctgtaagtaatgctacttgaacttctggagaaccagtatctccttcgcttctaccatactttttgattatttctaattttgttgccttatccattataagcgcacctccgtgtaacttttattatcccctagttccaagtaaaaagacggcacctttaaacttaggattaggttcatgagtaattatatcaaaagtaatgattattgtaaactatattcttaaactcgacacataattctcatgagctgcaaaagatttatctttttcaagctgatttttcaattgttctacaccattgaactttttctcattacgaatctttttaataaaaaatacttcaatattttcaccatatatatctttattaaaatctaatatataagtttcaattgtgagagttttaccttcaactgtaggattgtttcctacagatgttattcccttatatatactattattaaccttaacattagtgtaatatacacctactgctggtaaaataaaatttttatcgtattttaagtttgctgtaggaaatccaattgttcttccaatttttcttccatgcataacttctccagaaagtctgaatggatgaccaagcatcttatatgcttcatatatcttcccatcttcaacagaatttcttattcttgtactgcttattactttaccatcatatttgcatggctccataataaacaacttgaagttatattctttttggagttcttttagaagttcagtatcgcccatattcttatatccaaatttataattaaatccaactatcaaacctttaatattaaatctatttattaaaaactctatgaattcttttggtgtcatttccataaattctttattaaattcctgaaaatataatatatcaacaccacatttttctagaaattccgctttttcattattatccataagaagttttggagcatcatctttattaagtaaagctcttggatgatttttaaaagtatacactatacttcttccaccatttttttgtgcttcttcatgaactttatgtattagtgaaagatgaccaagatgtaaaccatcaaaacttccaagagctatataattatcagaagtcagtatatcttttccatatatatctttaatgatcattttcttactcctaaattaaagcaataatttttcaattttgaagcctctgtcctcttgtttaccaagacctataaaaagaccttcattatcataaactctatataaaacaccttgtgttcttttttcattggttaatcttttatcaaatacattaactccatttaccaatagtttcgtaaatgaactttctacagtaagctttggaaaatttctcaatgcttcttctattgtaattaaatgattttctatattttcttctgttaaatcttctatattaatactatcttcctgtctaaaaactgatgtggcagatctatttaacattgtcattgtagctcccacattaagtttttcaccaatatcataacataaacttcttatatatgttccttttgaacaacagacagtcatagaaatgtatggaagttctatttttatatcagttatatcatgtatggttattcttcttgcttctctttcaacttctattccctgccttgcaaggtcatataatcttacaccattttttttaagtgcagagtacattggaggaatctgatcaatttcacctataaatgataaaacaacatccattgcttcttcttcttttatatgagaaacatctttttcagatacaacttcaccttcaagatcataagttgttgtcttttttccaagtataagtttaacttcatatgcttttgaagaattcataatataatctattattttagtagcttttcctaatgctacaggaagaactcctgtagcttcaggatctaaagtacctgtatgtccaacttttttttcatgagctaaaaattttattttacggaccacatcaaaagaagacatacctctatttttataaacatttaatattccattcatatgtccacttcccattttatacgccaagttctttctttagttcttgtaataaattttctttagcagtctctaaatcaatatttttctgcataaggccggcagcttttacatgaccgccaccaccaaaaacttcagcaacttttctaacatcaacatcatttttagatcttaagctacttttggtaccttcttctacttctttcaacatcatagaaacctctacgccttttattcctaggccaatagaaataatatctgaagtatcagcattaggtaaattaaaactttcaagcattccttttggtattgaaaggattgctaccttgttatctaaagcaagttctatatttgataatactgcgcccattaatttaactttttcaaatggtttattatcaaaaaggctactatggattttactgttttcaattcctgcatctataagttctgcagctatagtatgtgttctcttagtcacatttgaatgtctaaatgaacctgtatcagttacaaggcccgtatatacagcacttcctatagctatagtttcactatttttctccttaaaatctacaccaagctctttaattagtaaatatgataattcacatgtagctgctgctttagagtctacaaaattaatgtgtccataattttcatttgatacatgatgatctaaatcaattatcattcctttgtaatcacttaaatcagcgcttattctttctacatttccacagtccaatattattactaaatcagtatttttatcaggcttagttgtttcgccatcaatttcttcactaaaagaaaggcaagagaagttatcagggataacatctcttgatattacatatgcatccttccctatatatcttagtgcattaagaagagataatgtacttcctatagcatcaccatcaggtgatgtatgaaatgataaaccaatcctcttagcttttaatatttcatctttaatcttgcttaaactcattagtttttactgcttatcttgtgaattagttcatccatgtgcataccataatttatagagtcatctaattcaattaatatttctggtgtgtgtcttaagtttattctttggcctacattctttctaatgaatccacttgcacctcttaatgccgcaagattgcttttcttttcttcttcatcattacagaatatacttacataaactttagcatatcttaaatctttagtaactttaacatcagtaactgatatcatagcagttaatcttggatcttttatttcattttgaatcaaattactaatttctcttttaaattcttcattgattcttccacctctataatttgccactttatatcacctcttaaagttcttttctttgaatagcttccatcataaagcattcaaggatatctccttcttttatatcattgaacttttcaactgttaaaccacattcgtatcctgctgcaacttctttagcatcatctttaaatctctttaatgaagataagcttgattcaaatattactattccatctctaataactcttgtttctgcatttctcttaagtttaccctttaatacataacatccagctattgttccaacatttgaaattttataagtttctcttacttcagcagttcctaagataacttctttatattctggttcaagcataccaatcattgctgatttaatatcttcaattgcatcatagataattctataagttttaatgtctactccatctttatcagcttgtgctgctgcattattatcaggtcttacattaaatcctataaccaaagcattagatgctgtagctagagttatatctgtttcagttatagctccaacaccaccatgaataactcttacctttacatcatcagtagaaagtttcgctaatgattgcttaatcgcttcaacagaaccttgaacgtctgctttaactattatagcaagttcttttactttaccttcttgtatttgattgtataaatcttctaaagaaactctgtggtttgcaagtaaagtttcagcttttaaatcatcttttttgctttctgccatatttctagcagtcttttcatctttaacttgattgaatctatctccagcttctggtacttctgaaagtcctaagatttctactggaattgatggtcctgcagatttaatctttttaccagtatcatcaaacattgctcttattctaccatatgttgaaccaactagaattgagtcaccaacatgcaaagttccgttttgaactaataaactagctacagctcctctacctttatcaagtttagcttctataacagttcctacagcttttctatttggattagctttaagttcaagcatttcagcacttaaaagtaccatttctaataatttatcaatgtttaagttttgctttgcagatacttcttctgatattacatctccaccccaagactctactaataatccatgatcagctaattcttgtttaactctgtctggattagcacctggcttatcaattttattaattgctactaccataggtactccagcagctttacagtgatctatagcttctttagtttgtggcattattccatcatctgctgcaacaactaatataactatatctgtaacttgtgctcctctagctctcatagctgtgaaagcttcatgtcctggagtatctaagaatgtaatttcttctccatttaaagttatagtgtaagcaccaatatgttgtgtaataccacctgcttctgaatctgtaactttagcttttcttatacaatcaagtaaagatgtcttaccatggtcaacgtgacccataactgttacaattggtggtctcttttgaagattttcttcatcgtcttcttcaatttctaatacttctaattcttgactctcttcttttctttcaaccattacttcgtattcagcacatactttttcagctgttgcaaaatctatttcttggtttattgcagccataactcctgacattattaaagttcttataacatcatttgaaggtttattcaacttttctgctaattcttttactgttatacttgcgcctatttctattatttgagtttcttccatactattatttccctcatcattcaaagattcttcttggtgttttccgttttttttctttttctttttgcctttatttaattcatcagctaactgctcttcatactcatcaactaaactatttgactttttatcattaccttctactccagcttcagcctttgcttctgaatttccagctagcagttcttttattaaagcagcttcttcatcttctattgtgctcatgtgatttttaacttccacattaaattcatccattaataaagttgttaattcttttgagcttatattaagctcctttgctaattcatgtactcttatttttgacatacagtcacccccgtattattctctacccatatatttttcctcctcgtatattgcaattaatttttgcgctattcctgcatctaatattccaagcagcataacttctttacgtccaagaggacttcccaattcacttttggaaaaatcttcaatatatggtatattcttattttcacaatgctttttaaatttacttttagatttatcagataaatcattagatattacaaataaatatatatctgtactatttctataatcatcacatttactatatccttctagtaaattttttgattttttggctatacttaaaaagttaaaaaacctattcattaataatttcttcctttagtttttcgtaaatctcttcacttataggtgtatcaagatttctgcttaatctttttgctttaaatgatttttcaaggcattctatacatttgcatatataagcacctcttcctgattttttaccagtcaaatcaacacaaacttcaccctctggtgtcttaactattcttattaattctttctttggtttcatttccatgcagcctgtgcacattcttaaaggaattttcttgactttcatagaaaaatcacctctctattcttctacatcaatagtagaaatatctaaatcacttaaatcagtagtatcctcattatcaatttctacttcagtattaactaatttttcttcttctgcatctaaagtagctttttgtgatttgctctttatatcaatcttccagttagtaagtttagctgcaagtcttacattttgaccttccttaccaattgcaagtgaaagctgattatcgtcaacaactacttttgctgttttattttcttcatcaacttctacagataaaacttttgctggactcaatgagtttgctataaactctgctggatccttactccattttattatatctattttttcatttttaagttcattaactatattttgaactcttacacccttaggtccaacacatgcacccatagcatctacttcttcatcattagaatatacagctatcttacttcttgaacctgcttctcttgaaatactcttaacttcaacaacaccttcaaatatttctggaacttcaagttcaaataatcttttaacaagacctggatgagttcttgaaacatgaatttgaggtcctttgcttccatttttaacttcaactatatatagttttaacttttcgttgaatttgtattcttctcctggaatttgttcattaggtcctataacaccttctagtttgcctaaatttacaaataccattcctttatcttttcttaaaatagttcctgtaattatatcaaattcttgttctttgtattcatcatatataatatttctttcagcttccttaattctttgagtaacaacttgtttagctaactgagcagcaactcttccaaaattctttggtgtcacttctaaatcaacaatatcatcaacttcatatttaggactaacaaccttagcttcctcaattgaaatttctgttacatcgtcatatacttcatcaacaactactttttgagcatatactcttatttcgcctgtttctctatcaatattaactttaacattttgagcatttgtattgacattcgcataattctttttgtaagcagcaactaatgcatcctgtatagttgtgaaaattaaatcttcgcaaattcctttctctttaactagttctctaagagcacctacaaactcttcattcatcttaaaaaccctccttgttatatttccccttcaagatttgcactttttatcttatcatttggaatcttaatagttttttcgccttcaactataatatagtcttcgccaacttcctttaatattcctttaatatttttaacaccttcaattgttccattgaatcttaccataacttctttatctaaaacactttcaaaatgacttttagtatgaagacttctgttaagccctggtgaagaaacttctaagtaataagctccttctattggatcttcaacatctaatatctcacttactcttcttgaaacagcttcacaatcatttaaagatattctgccttcttctttatctatatatattcttaaataaaaatctccattttcttttatgtattcaacataataaagcttatatgacagttcttcagtaataggtcttactatattttcgattttttcaactaacatatttttattcatatctttcttaccctcgctttcatccttataaaaccatatagatatatattatcttatgcagttttaaaatttgtaatcaaaaacgcaactatgtgtagtagttgcgttacaaacagaaagagcgggtaaaacttcccactcctttttactattagaattaaattctatttatattttatcatactttttttattaacacaagagggatattttagttaacggttatcagttctctgttaaatgtttcgatttatagtctatgttaactgacaactaaaaaagtgacagttgatttgtttcagacattccttcaagacatccatgacttgtaagtccttcaattgctgtcttagaaactcctgctcgtattctcaagtcctcttttgaaataaactctccattctttctcgcttcaacaattccttttgctgcattatcagctattcctggtattgcatttaatggtggtcttagatttccatcttcaattataaatttaactgcatctgatttatataaatctaccctaagaaaattcacgcctctcttataagcttcaaaacataattcaagaactgtaatcattcctttatcttttactgaagcattatttccaagagcatataattcctgtaatttcgcatgaactgctccctcaccaagacatattaagtttgcatcaaaatcatccgctcttacagtgaagtacgttgcataataagcttgtggataatatactttaaaatatgctattctcactgccatcataacataagcaacggcatgacctttagggaacatatatttaatttttttacaagatccaatataccattctggaacattatgttttttcattaaagtttcatcatcttccgataatccttttccttttcttaccttttccattattgtaaaggctgttttaggcggaatatccttatacataagataaaccattatatcatctcttgttgctatacattctctaagtgtagtaaaaccttcttttatatagtactgagcattattaagccaaacatctgtaccatgagaaagacctgatattctaacaaggtctgaaaatgtttttggctgtgtatccacaagcatctgtctaacaaatttagtcccgaattcaggaagaccataacttccaacttcacattcaagttcttcttttgtaactccaagagcttctggcgaagtaaaaagacttaaaacctttttatcatttaaaggtattgtcttaggatcaaggcctgtaatatcttgaagcattctaagaacagtaggatcgtcatgtccaagtatatcgagcttaagtaatcttcccgatattgaatgataatcaaaatgtgttgttatgacatctgtatcattgtcatctgctggatgttgtattggacaaaaattatatatttcattatctgccggtacaaccattattccaccgggatgctgtcctgttgttcttttaattccagtacatccaattgtcaatctatctacttctgcctgtggaactacaatacctctttcatccaaatatttttttacatatccgtaagcagtcttttctgcaacagtacctattgttccagccttaaatgtatgtccttttccaaataacacctcacaatatctatgaacaactccttgatattcacctgagaagttaagatctatatctggttccttatctccttcaaagcctaagaatgtttcaaaaggtatatcatgaccgtcctttttatatggcgttccacattcaggacaatctttatcatcaaggtcagcaccagaacttactgatccatccataaaaaattcagattttttacaatttggacatacataatgtggtggaagtccattaacttctgtaatatctgacatggtagcaacaaaagatgaacctacagatcctctagaaccaacaaggtacccatcatcatttgactttgcaacaagtttttgtgcaataagataaagaactgcataaccattatttattatagaattaagttccttatcaagtctcttttgaacaacctcaggaagattttctccatatatgctatggactttgttcatagtcatatttcttatatcctcttctgctccttcaattttaggaggaaaagtctcatcaggtattggttttataatatctattgaatctgctattttattggtattttctattacaacttcatttgctatctcagaacccaaatatgcaaattccttaagcatttcctctgttgtcctaaaatataacggtggctgtttatctgcatccttaaacccctgacctgccataagtattcttctaaaagcctcatccttaggatccataaagtgaacatcacatgtagctacggtcattttgtcacattccttgccaatatcataaattttcttatttattgtcttaagttcattttcatcttttaccatccctttttcaattaggaataaattatttgctataggctgaatttcaagataatcataaaattccattatggcttttaattcttcatcacttttgccatcaagaactgccttatatacttcaccagcttcacatgcagaccctatgataagtccttctctcatttctgcaataagacttttaggagttctaggtctcctctggaaattatcaatatgagcagttgaaatcatcttatacaggtttttaagaccagcctgagtctttgcaagaattatagcatgatatgtaggttgtttttttatatcaaaattagaaacaaataaatcatttaattgcttcaaagtatttatgctatgatcttctttaagcattgtaaagaactttaataaaatctctgccgtacatttagcatcatctacagccctatgatgattatctagcgaaattccaagatgttttgctacaagattaagcttaaccttcttaagatctggacacaaaaatctagcaagaggtacagtatccattattgaataattaaagtcaatccctaaatctctgcagtttttctttataaaaccagtatcaaatgcagcattatgtgctacaagaacagaatcagcgcagaattccatgaacttaggaagaagtatttctatagtttcagcatctcttaccatatcattatttatgcttgtaagttcagtaattacatacggaatactcctttctggattaacaaaatgactaaaattatctataacttcaccattcttaatctttactgcacctatttctattatcttatcattaactggtgaaaatcctgttgtttcaatatcgaatacaacataagtatcatctaatgaatcacccttttcatttaatacaataggtacaccatcatcaacaaggtacgcttcaactccatataatacctttattccatgtttctttgcagcactctgagcttccggataagcctgaaccccccatgatctgttatagctatagcaggatgtccccaagatgcagctcttccaataagctttcctggggctgtcatcccatccatactgctcatagttgtgtgaagatgaagttcaactctctttttaggagctccatccatcttctctatctttttcattctattaatatctcttcccataattactacttctcttgaataagtatcatatacagcctcacctctaaccttgcagtagaaaccttttttcacttcatcaagaactgcttctgtatcctgaggacgtaagaagcatttaacagatatggaacttgtataatccgtaatacaaaaagtaaatataatcttcccagtttttgtttcaattatttcagttttaaacacatctccaattatagctacataaccacttctttcatcaatatcacaaatgttagtagtttccattttaatagctccacccataattgtattttcatcctttggagctctcttatatgtctgaaactctcttttcttttctggttgttttgattccgaaatatcttttttactttcacttttacctgaagattgactaagcgatcctggtgtaacaagcctcccactcataacatcatttataatctttttgttttcctcaagttttgctgcttcataattatgtatactcgccagtttttcatcaaatttaaattcaactcgtgcacctacaccaaaaatatcttttatagcaccttcaatcaatactcctgcctttttattatttgcatgatttacaagtgcaggtgttccagaatatataaatattgttttatctttcacttctctattttcagaatataaaagtgcccttattaatggaaattttcttgctgtttcttcaaccgcacttgaccaatgttctcctgcaatattttcaatggtacagtttgttacatctctataacatataatttcaacttcaacatgaaaacccaaattttttaatactaattttctaaattcttcttcttctacattattcaatatgtcacagcacttaactattatttttagagtctgactttttttgaagaattgaaatcttaatattacaatatccttttcgcctaacatttcattattaagaatgtctttcttaagcattttcataaattcctgactcaaaagcacacctctcttttcttttgtgtttattaaattatatttttaatttacagagggatttacttatgtactgtagtaaatccctctaaccaataatattatcaaaatataagttcttcctttttaacgtatgtattcaagaactcaaaggtttaatatttaatctcttttctacttaaagtgtacttacaatttcaaaaactgtacatctttatattcttgaagttaattattttcaatggaaattactccaatatttttatagactataacttattaacttcttccataagagcatctataagttcttcttcttttacctttttaataacctcaccttttttaaatattattccttcgcctcttccacctgcaattccaatatctgattcccttgcttctccaggaccattaacaacgcatcccataactgcaaccttaatatctttatcacaattttcaagtctcttttcaacttcttctgcaatctttattaggttaatctgagttcttccacatgtaggacacgaaacaaattctacgccaccttttctaagtccaagagatttaagtatttccttagcaactttaatttcttctactggattacttgttaatgaaactcttatagtatcacctattccttcagcaagaagtgttcctataccaatacttgatttaattgttcctctttgcactgttcctgcttctgtaactcccaaatgaagaggataatcacatttttgtgcaacaagtctataacattctatcatcattggtacgttagatgattttatcgaaattactatatcataaaaacctagctcttctaaaatttttacatgtcttaatgcactttcaactaatccttgtgcattaaccattccatgtttttctaagatatctttttcaagagatcctgaattaacgcctattcttataggaatctgtttacttttacagcattcagcaactgcttttattctttctacacttccaatattccctgggtttattctaagagccgaaactccattttcaatagccttaagtgctaatctataatcaaaatgtatatcagctactacaggaataggtgacttttcagtaacttccttaagcttttcagcatcctccatatcaagaactgcacatcttattatctgacagcctgcattatataattcatttatctgatttaatactgcttctacgtcttttgtaggagctgtagtcatagattgaatagaaacattagcatctcctccaacatatacatttccaactttaacttttcttgaaattcttctttccatactgcaccacctatttcataaattttatatattttaactttagttatcttctaatagttactttagatattatatatcttaaaatgtaatattgtaaactatcttatattttagtacatagtattatacttgaaacaatataaaaaaacagccttctaaatcaaatattttgacttaaaagactgctttattatatatattctttaaaaactaactgggaatataatatccttcaatgttacaagaatcatcaatccaattaaaatcataaacccaacataatttaaaccttccacaatcttatttggtacttttcttcgtgttataagctctattaacaagattactgtccatccgccatcaagagctggaaatggaagaagattgaatacagctaagtttacacttaaaaatgctgtaaagtataataatggccatatacctgcttttgctgttgcagctgacattttaacaattgtaataggaccaccaacatctgtctttaaatttgcctgacctgtaaatatcattccaagacctttaaatgtctgagatactaatgatgcagtctgtttaaagctctgtgtaaaactcttacctataccttgatcatttactctcgtaaattctactccaatagcatatcttccagtttcttcagaaacattaggagttattgtaaagtccttcttttcaccatttctatcaacaactatatctatcggattaccatatgataataatacacctgctgaaatatcatcatatgtaaaaactttcattccattaacttttacaaaagtatcaccttcttgaagtcctgcttcgtatgctggcgaatcagactttatgctatttgcaaaagtatttgtgtatccaaagtgatttatatatccagtaaatatacaaattgcaagtatataattcatgcatacccctgcaactattattgtaattcgtcttaaaggcgatttagctgaaaagcttctttcatcatccacagcctgttcttcgcccatcatacttacatatcctccaataggaaataatcctattgaatactttgtttccttgccctgttttgaaaaaatcttaggtcccattccaattgaaaattcttcaactcttacaccattgatcttagctaatgtgaaatgtccaagctcatgaacaaatatcaatactccaaaagctaaaatagctaaaattatatacatatattaaaatatcctccttaaactgagatctctcttacatattttttaactctcttatctaaatcaataactttttcaagactcacttctttgcagccctcctctttaaatgcttccattgctctttctatgtaatctgcaatatctaaaaactctatttttttattcaaaaataactcaactgcagcttcattcgctccatttagaatagtaggcattaaccctccaatttttcctgctttaaatgcaagcttaagggccttaaatgtatccatatctggtttttcaaaggtaagtttatttatttcataaaaatctatagtatctgcaattaaatctttacgttcttcatagttcaatgcatattgtataggaagcctcatatcctgtgctccaagctgtgctattatacttccatctgtgtattcaaccattgaatgtattatactctgcggatgcactaatacttgtatattatcataatcacaatcaaaaagccaatgagcctctataacttcaaggcctttattcataagcgttgcagaatctattgatatttttcttcccatattccattttggatgttttaaggcatcttcaacttttacttttttcaattcttctgtagccttacctctaaaaggtcctccagaagctgttaaaattatttttctaagagttttaatattatttcccctaagactttgatctattgcactatgctcagaatcaaccggaagaattttaacattattttcttttgctgctttcataactaactctcctgcaacaacaagagtttctttgtttgcaagagcaatatcttttttagcttcaatagcctttaaagtaggctctaatcctatcataccaacaacagatgtcactactatgtcaatttcatctaatgacgctattttactaagaccatctatcccttcaaacacttttatatctttgctatattccatgcagtaacttcttatttcatctgccgaggatgagttcatcatagcaacataagatggattaaactcatctattatttctatgacattttttactgatgtattagccgttattccaataagttttaagtcacctttagactttcttattacatccaaagtctgtgttcctatagaacctgtagcacctaagatggaaagtttcttcatttttgtttcctcctaattgtaacactctcatttaatctcaccgtatattatttcttttgcaataatactatacataggacctacaagtattccaagtattccaaatacctttgctcctatatatatagaaataaatataacaagtggatgtatatcaagtttatttcctataaattttgcttctagtatttctcttacaatctgaactaatatataaagacatattaatccaaaagatactagataattcttcattataatattgtatattattataggaataaatacaattattgttcccacatagggaaggacatccaaaagaccacatacaagtccaagcattaaggatttaggaattctaagtataaaaaatccaaatattatttctattgtagatattaatataagaatgccttgaatactaatcatattcacaaaattattcttctgtcttctaaattttttaataatttcttctggaaacagtctatatacaacatctagcatactttttttatctacaagaataaaaaaagtgcatatattagctataaaataagccaatatactctcgcctgtactaacagcactttgccttagcttagtgtcattaattatagagaaaacacttttccctatttttaagttatttaagtcaatattaacagcacttgatatattctgaataatattatttataatttctatattagacgaatacacttttcttaatatactatatatttcccctcccatatacacaataattaaaactaataaaacattaacagttattaaggtaacagctcctgcaagtttttccggtaccttaagctttattataaatttataaaccggcatacatattatagacataataagtataaccataaatggtttaaaataatattttataaggaaagtaactatgacggtaaaaactaatagcagtattagtgaaaaaatttttttataactttctaaaataatcctcacactcccctcttaacttttaattaatgcttttatattatatgctttaacttacataataaattacaaagaacttttttttaaatacaaaaatcatgtatctgatataatatcaaacacatgattttcattaaatatttattataaaagtaaggtaataaaaaattactgttgccgaaaaaattatactgtcaaatctgtctaatatgccgccatgtcctggtatgagattgctataatctttaattccaacatatcttttaacagatgaagccactaaatctccaaactgtccaaatatgccacataatgcacctattataaaataatgataaataggcattatgtatatatatttatttactataagtccaaatattccacaaaatatagtagctcctaaaagccctccaatagaaccctctactgtttttttaggagaaactttaggacacaacttatgtttccctaaaaatcttccactataataagctgctgtatcagaaagccatgaacttataaagataagccatactaaatacatgccatttgcttttgaattaactaaatatactgtactaaacaatatacctgcataaataaatcctaaaagtgttaaagacacatcaacaaatgtatattccaagtcaattacaggaactatgagaagtaaaaatgttgatgcaaccaaaatatacatcatggtttcaaaattattattgattaagtagtatacaataagtaaaatatatgcagctatatctagcggcttaaatttattctgccttaatgcattaaagaattcccataaggccatcaatgataatgcaaacacaaatcctttaaggtatattcctccaagcaaaacaaatattataaatggagcaatcataactgcacctaaatatctactattagatttcaaaataacaactcctttattttactttaccaaaacgacggtctctgttttgataatcagatatggcacgtcttaaatcttcttccttaaaatcgggccaatttatatcagagtaccagaattccgaataagcacattgccataataagaaattgcttaatctttgttcacctgatggtcttattattaaatcaggatctggaattccttttgtatataaatagttttctattaattctgaattaatatcctcttcttttataatattcttatttatatctgaatacataagctttattgctcttataatttcatctcttccaccataattcaatgcaaaattcaagtttattctagtattattcttagttgtttctaatgcatcatctagagcttcttgacattcttttggtagctgtgtagtatcaccaaacacattcattcttactccatttttatgacactcatctaattcttttcttaaataagttactaaaagtttcattaatgctccaacctcatctttaggtcttccccagttttctgttgaaaatgcatataatgttaagtttttaactcccagtcttgttgcttcttttaatattcttcttattgtctcaacaccagctttatgtcccatacttcttggaagcattcgttctttagcccaacgtccattcccatccataattatagcaatatgattaggtatattattcatatctaattctaattcattagattgttcatctttttttgttttaaacatgtctaacattgttttctccccctgtattaggaaaatattgtatgtttcaattaaacatttaatttatattaagaaaaaaacctgcattaagcaggcttttattattaaactgataaaacctctttttctttagctgctattatagcatcaatttgctttacaactgcatctgttttcttttgaacgtcatcttcaccttttttaatttggtcttctgatatgtccccatctttctttaaggtttttatcttatcatttgcagcttttcttatagatcttactgcaacttttgcttcttcaccagttttctttacattcttaacaagagcttttcttgtttctgctgttaattctggtactaccaatcttataacagatccatcatttgaaggattcaaacctaagtctgattttaagattgctctttctatatctttaagcattggtttttcccaaggagttatcattaatactcttggttctggagctgatatgtttgccacttggctaagtgggcacatacttccataatactctacttgaattctgtcaagcattgtagggttagctctaccagctttcattgttgataaatctgactctaatacagatattgtttttttcattttttcttctgcatttttaatgatatccttaatcataataaacctcctatttttttgatactaatgtacctatgttttctccacacgcagcctttttaatattacctggctcatctaatccaaatacaagaattgggatttcattatccatacataatgaagttgctgttgaatccataacttgtaatccttgttctaatacttctatatatgataatgtatcatatttcttagcatcactatatttatgtggatctttgtcataaactccatctacttttttagctaaaagaattacatcagcttcaatttcagcagctctaagtgcagctgttgtatcagttgagaaatatggatttcctgttcctgcagcgaaaataacaactctacctttttcaagatgtctcattgctcttcttcttatgaatggttctgcaacctctttcatttctatagcagtttgaactcttgtcataactccaacttgttctaatgaatcttgaagtgctaatgcatttatgcatgttgccatcattcccatataatcagcagtagttctgtccataccttctccacttctgcctctccatatgtttccgccaccaacaactgcaccaacttcaatacccatatctactaattctttaatttctaatgctattctttgcgctacattaaaatcaagaccgaaaccacttgctccagctaaagcttctcctgaaagctttaatattactctcttgtatttacattgtgacatattaaattacctcctgaatattaataggctgattttatcctagtctagtcaatattatattatcagaacacacttaaaatgtatagttttaaccacctaaaagttaaatttccacactactgttctctaactagccaagctgtattttacataatatatagataaaatccgctaattcgttttacttatctctttaaaaaaagagaacacaaagtgttctctcttaaggttaaaactatttgcctatttgtgcagcaacttctgcagcaaagtctaccttttcaacttcgattccttctcctctttcgtatctaacgaatctagttatagttattggagaaccaacctctttagatttttcagctacaaatttagctattgtcttatcgttatctttaacccataattggtctaataagcaaacttctttgtagtatttcttaattctaccttctaccattttttcaacgatattttctggtttaccttcatttaaagcttgaactctgtagatttctttttctttttcaattgaagcagcatctacttgatcttcgcttaagaataatgggttagcagctgcgatttgcatacatacatctttagcaacttcatcaagaatgtcgctagcagtatcacatgcaagttcaactaaaactccaattcttccaccaccgtggatgtagctcttaactaatccattttcaataccaaacttagtgaatcttcttatagtcatgttttcacctaatttagctattaatgcttttaaagcatctgaaactgtagtttcagcatcgaacttttcgtttaataaagcttcaacattttcagctccagtttcaacaaccatttctgctaatctatcagcgaaagccataaattcatcattagcagcaacgaagtcagtttcacagttgaattcaacaactgaaccattcttcttatcttctgaaatatatgttttaactataccttcagcagcaactcttcctgatttcttagctgcatctgcaagtcctttttctcttaagaattccacagctttttcgatgtttccttcagtttctactagagcttttttacaatccatcattttagctccagtcatttctcttagttctttaactaattgtgcacttatatttgccattattaaatcctccttaaatcattgaaagtaatccttaccatatgggcaatttaggaaaagggtaactgaactctactccactcacccttttatatctaaattattcagctaattgttcgccttgtcttccttcgataatagcatcagccattttagcagttattaatttaacagctctgatagcatcatcattacctggaattacgtaatcaacttcttctggatcacagtttgtatctacgatagcaactactggaattcctaaaatcttagcttctaagatagcattcttttcttttcttgggtcaactatgaacatagctccaacgtttgatgcatctaagtttctgataccgccaaggttcttttgtaacttttctaattcaccttttaatttgataacttctttcttaggaagaacttcaaaagttccatcttcttgcattctttcgatatcttctaactttctgattctgctcttgatagttgtgaagtttgttaacataccacctaaccatctgttgtttacgaagtgcatgttacttctgatagcttcttcttcgatagcttcttgagcttgcttcttagttcctacgaataatatgtccttaccttcagtagcaacttcttttataaagttgtaagcttcttcagctttctttactgttttttgtaagtctattatatatattccatttctttctgtgaatatataaggagccattttagggttccatcttcttgtttggtgtccgaaatgtacacctgcttctaataattgtttcattgatattactgacattttcttacctcctggtttttacctccattattgttttcttataaagataccaaaagttggcaccgtctttataaacgcaataatgtgtgtattttgttacccttgatagtatatcacaaggtatatttcctatcaacaaaaattttttattttctttaaattatttcttatgttctattaactttctacatttatcgtctttttttcatttcctctatatactatgtaatcatatccacattaactttaactcatacatattttttaaagttataagtataatattataactcttcccctcccacattggatttctcttttaaatattcattataagcaatttcataagtatataaaatcctacatgagttttcaacttatctttaaaatatttattaggaaatatttactttgcattaatacaaaaaagctgtagtataaaatttattttttcctacagcttcttataatatactattttatttttcttaactcttccactagcttttcatttaatattcttatataagtacctttcattccaagagaccttgattcaattacaccagcactttcgaattttcttagagcgtttactataacacttctagttattccaactttatcagctattttagatgcaactaaaagtccctcatttccattaagttcatcaaaaatatgttcaactgcttcaagttcagaatatgataaagttccaattgcaagctgtacaactgcttttttccttgtttcttcagcaatttcatcttgcattgctctaagcatttccattcctacaattgtagcactatattctactaagactaaatcatcatcagtaaaactagttccaaaccttgcaagaataagagttcctaatctttcacgacttcccattataggtacaattgttgatagcttatctacctttttacattttccaatttcttcgaatacacatcttccctcatttggaacatttgctatagtttcattggtatttaataatgttttattatagtcttctgggaatttcttatcttctattactttctttttcatggcttcacattcaaaatcatgtccaaaagcataacctaagacttttcctttctgactgataatgtaagcattacattctaaaacatcgcttaataatctacatatatcctgaaatgcaactggatccttacccgatttttgtaagatcttattaagcattctagttttttttaatagtgatgacatatttatcctcctcagaactttatataaacgcatattactcattattaatataattattagaaaattcttaatttattgaatttttttacaacttaatattaatttaagtttaacatatacacctgctgttttcaacagtatttttatacaattcgacaaaatataataatataaattatgccatcactattttatatactactattcttcttctttcttttcttccttcactggttctttataatcacattcactattagaacattgtatataatttccttttgtttttgaatattttaaaaccatatatgaattacattttggacacttttctttaacaggttcattccagcttacaaaagtacattctggatatccagaacacccaaaaaactttttaccttttttactttttttagccacaataggttttccacactcaggacacggaacatccaattcttctacaatcggtttagcatttttacattctggatatcctggacatgctaaaaattctccataacgtcctcttttaataaccatcatacggccacatttttcacatttaacatcactaaccttatcttcaattactacttttgatatttctttttctgctttatcaatagcttcttgaagcggactaaagaattctgatacaatttctctccaattttcatttcctacttcaacatcatcaagctttctttccatatctgccgtaaaatccgcatctactatttgtctaaaatattcacttaaaatattatttactatttctcctagctcagtaggaattaatgtcttcttttcacgtacaacatagttccttcctaatatagtcgctattgttggcacataagtactaggtcttcctattcctttttcttcaagaagtttaacaaatgatgcttctgtatatcttggtgctggctgagtaaaatgctgacttccttcaagacttgctgttttaagttcttcattttcttctaaacttggcaaagtcacagaattttcatcatcttcattagtgtattcataaattttcataaaaccatcaaaatcaatcacagatccggatgctttaaatttataatcaccattcaagatatcaattgaatttgtatttaaagtgcatgaagccatctgacttgctacaaatctcttccatattagtgaatataatttatgctgttcaggagttaaattttctttggctatttccggtgttatttctatatatgttggtcttattgcttcatgagcatcttggatatttttctttcctttatatatccttgtagtttctggaagatattcttttccaaaactttcttctataaattcctttgctttaccttgagcttcttctgatattcttacagaatcagttctcatatatgttattaatcctacagtaccatgccctttaacttcaacaccttcataaagaacttgcgctacagacattgttctttttgtattaaaattcaattttttattggcatcctgctgaagtgtacttgttgtaaatggtggaaggggatttcttgtcttttttcccttctttatactcttaactacaaaagttccattattgagatcttctattactttattgcaatcctcttcattcgtaagctcaacctttttatttttgtaagttgaaagtcttataggaaatttctttctttctttttttaatacacagtcaaccgaccagtattctttaggtataaattcttttatttccttttctctatcacatattaatttcaacgcagcagactgaactcttccagcacttagtccccacttaacattcttccataatataggacttatttcataaccaacaagtctatccaaaactcttctcgcctgctgagcatcaacaagatcaagatttatttttcttgcttcctttatagatgccttaacagcactttttgttacctcattaaaaactattctacatgtttcatcttctgatatctttaaaatatttgcaagatgccacgaaatcgcttccccttctctatcggggtcggttgcaagataaactttatctgactttttagcagcttttcttaatttatcgattaattcgcctttccctcttattgtaatgtatttaggctcataattattttctatatctacgcctaatttactctttggcaaatctctaacgtgtcccatcgatgcttctacaatataatttttaccaagatatttgccaatagtctttgcttttgctggcgattctacaattacaagtttttgacccatagtataacttcataataatatgaagtattcaccccctataatttttaaattattttaacatagtaatttccgggtaaacaaataatttcatctttaatctgcatttcaaacaatagcgcatataaagcacctctctcaaagtttgtttttctgaatacatcatctatatgcataggtacatcagtaagacaatttaatattcttctcttatctggagattttatcataggtcttatttcaatattatgatctaatgataataacattctaaaatcttctacacttgagcatatatcgaccccatattctctaataaattcattagatccttgagatccactataaaacatagatccaggcacaactattacttttttcttttgagctaaagcaagtcttgccgttataagcgagccactttttctcgatgcttctgttactattattccaccactcataccgcttatgattctattccttctaggaaagttcatttttagcggcggagtatctagcataaattcagaaattactactcccttttcttctatttgtgaaaatagctttttattttctgctggatatacccgatcaataccgcatcccaaaacagatatatttattccactattttccaacgcagttttatgcgcaatggaatccactcctcttgcacctccgcttataagcgtaatattattagtaataagctcctttgtcaagacttttgttgcggacaaaccataatttgagcattttcttgcccctacaataccaatagaattattgttaatcacttcaatatttcccttataaaacaagaaatatggtgggtctaaaatccccttcaacttctctttatataaggcatcagcgtatgttataaatcctattcccttttggtataatttttcttcagttttataaacttcttcaaataaatcttttttgttaatttttttatttctttgttaaaatttttttcattattttgaagatattcaaaatcattatatatattttctgcgctttcatatctatttattagatttatttttaaactcgcctctatcccaagcagtatcaaccataaatcataattcataaatttattctcctatataacttctccattaatattttttctataactaaatgcttctaataaattttcttcggaaatatcttttttaccatcgatatctgcaattgtcctagcaagcttaagaacttttccaaatccacgcacagacatattacaattattataataatgttcaagtatcactttacatttattattaactctacaaatttcaaaaatatctttacctttaatttctgaattgtacctatatattgtttgcttaaatctttctttttgtacaaaacgcgcctttagtacattttccttcattactttagaatcatatgaatcttttaaactttgtatctcatggtattttattctcggaacataatttaaaatatctattctatctaataaagcactagagaacttttttatatatttattagtgtaactatttaattcataaaaatcattatcattatatatgtttgcatttcttctttctacaggattaaatgctccaacaagcaaaaaatcagcaggcattaagtaatttccagaaactcttgtaatattaacattcttctcttctagtggttctctcaaacattctaaaacttcttttttgaactctaagatttcatctaaaaataaaactccattatgtgctaaagttatttctcccggctttatttcctttcctccacctattaatgatgcttttgtacttgtatgatgaggagctctaaacggccttgtgattatggagttatcttttattaatccacaagtgctataaatttttgctatctcaactaattcttcatgagaaagctttggaagtattgaactcaaagcctttgctaacatggttttaccacatcccggttctccatacagtataatattatgttttccagctgctgcaatctccattgccctttttgatgagtactgacctattatttcaccaaaatccacaaattcatttttttcgtcacacttcgattcttgttctgtccatttataaggtaatatatccttatatgtcaaaaacgaaataacttctttaagatttcttaagggataataatcctcacctctcaaatagaaactttcctctaaattttcataaggaaaaataaatttatgcttatttttactatttccttcaagtattataggaatcattccttttatggagttaagttctccaagcaatgaaagttctccgaatattatataatcttcaatatcgcaaacttttatctgttttgactccataagtatgccaattgctattggaagatcaagcaaggaacctatctttcttacatctgcaggagctagattaatagttattcttccaagaggaaattcatatccgcagttaataattgcagctctaactcgttcctttgcttctttaaccgatgcatctggaagccccactatagaaaattgagggagccccttagatatatccacttcaacatgtattaaaattccttcaagattattataagttgcacttattatttttattgccatatatacatcacccttaagaattatagacatagattttaatattaattcaaattattaaaaatgattattattgaattttcttgttaataattatatttataaaaattttaaattaaatatagtttttattattaaataaactatgtacgttacactatgaattttgcaactataatctagaaatcacatagtgatttctaagtcacttatcatatatcaattatccattggaatccactttaaaagcttagaataatatataactgcttttattccatagaatctttaatgtctattactttccattgagaggagcagaatatgaaaaatttcaataaatttatcggcaattatggcgaaaaacttgcttcaaattatctaatagctaataactataaaatacttgaaaataatttcagaaattttttaggagaaattgatataatctcaataaaacataatattctagttataactgaagtcaaaagtcgctacaatataaattacggctaccctcaagaggctgtaacatactcaaaacaaaaatcaatagctaaaattacttcttcttatataaatttaagaaaactcaactatctaaacgtacgttttgatgtaatcgaagttttctttaatactgataactctctatataaaattaatcatataaaagatgcttttagattataaaaagacaggtaataattctcatatcaataaaaattattacctgtctttaatattttaattattttctaataaatttttaagaaagctatttctatgtatttcacatttaccatattcccttatagcattcatgtgttttgcagttccatatccagcattattttcaaaatcataacacgaatacttctttgcatattctttcataagattatctctatatactttagctattattgatgctgcagcaatacaagcacttttagtatctccttttataaccgatttattttctatttcgattcctttcacgagataaccatcagataacacaagatctggtttaatactaagtgaattacaactttctagaaacaccttattattagccacacctatccctatttcatctatctcataatttgaacactctgaaattttaaaacacactgctttttcttttattatttctgcaagctcttctctcttgctttcttttaattttttagaatcatttaaatataaaataagttcatcatctaaaacatttaaatcaagcataacacagcatgcaacaataggtcctgcaagaggccctcttccaacttcatccacgcctgcaatatgtttataatcaccaaaagatttatcaaatgcatacatagacttaactctttcaatttcttttaaatatgcattaatttctttttttaatttagaagcaagtgctaaaacattctttcgcttatcgcattcaagccagtgaattatgctttcataattattatttttatattcattaattattgaaatttttgacatttcatcttttatttttgcaaatgataaagattttatatcctcattaattatcttcattgctttcttcttcactttcttcttcaattggacgttctaaagatatgttaccaattttcccacatctaaattcatcaagaagtataaccgcaattctattataatcaatctgacctccagaaattaatgccctctctttttacctattaaatctaatgtatctaatggattttcacaaatttctgaaagtttatatctttcttttaatttagtctcatagtttttctgtaatctttctactaacttgagcgccaattcctctatatccataatttcatcttttatagcacctgtaaatgccaaattcaacgctgttgtatcatcttcgaacttaggccataatactcctggagtatctaaaagctcaattccaattgctgtctttatccactgtttactcttagtaacaccaggtctatcacctgttttagctatattatttcttgccattttattaataaatgtagattttccaacattaggtataccaactaccataactcttgttataattttagccatacctttagctttaagtctatcatgcttttcctttaaaagatttaataaagcaggttttatagcctttaatccttccccttttaaacaattaacttcaagtacttttacattatcattagtaagataatcaatccattcttttgtaaccttactatcagttaaatcacttttatttaatagtattattcttggctttccttctaataatttatcaatatcaggattagcagaacttctaggtattcttgcatctcttatttcaataacagcatcaactaattttaaattttccttaatttctctttgagtttttctcatatgtcctggaaaccagtttatagccatatgaatccctcccttttcagttaataatttataattgataattgaagttataatttacgtcttcataataccaattatccttaatttattttttattaaaacaaaaaataaattttaaaaattctaaaaaacacaatgtacatttcacaatatatataataatgattatacccagtttacatggatttagtaatttattgtgtcctgcccattgtgcattattccttacatattataaacagatttattatctaactctaaactcatttaataacaataaaaaaaggactgaaacagtcccctttttatattatctagttaataattctttaaccttagcagccttaccaactctatctcttaagtagtaaagtttagctcttcttactttaccttttcttactacttcaatcttatcgatgattggcgcattcattgggaatgttctttcaacaccagttccataagcaactcttcttactgtgaaagtttctcttaaaccaccgttttgtttcttaagtactgttccttcgaacatttggattctttctttgttaccttcttgaatctttacgtatacctttatagtatctccaattgcaaatgtaggtaagtctgttctgatttgttcagcttcaatagctcttattatttcgttcattgtgcattccctccttaacgataatttgacgttcttaacacagtttctcatgtagacagaggaacgcccgtactagcacaaaattaataataacacatattattttttatttcaacaaataaattatgtttttttacttttcattatctttttttaaaatttttatatcttcctttgttaagcttatcttgctatacatatcaggtctgcgttcttttgtaagtttaagggactgtaaccttctccacttacggatattctcatgatgacctgataaaagtatatcaggaaccttatcaccttcaaaatcttccggtcttgtatattgtggatattctaaaagcccattataaaaagattcttccataaagctttcttcttttccaagtactccaggaataagtctcaaaacagaatcaataactggtattgctgccatttctccacctgtcagtacaaaatcaccaagcgatatttccatatcaatatgtttgtatactctttcatcaattccctcataatgaccacatataaatgtaagattttgttctttagaaagttcattagccatctcttgattgaaagttttccctcttgggcctaagaaaataaccttgccactattattttcttttacatgtcttattgcatcaacaagaggttgtggagccataaccatcccagctcctccaccataaggggcatcatcaactttcttatgtttattcaatgtaaaatcccttatatttaggacatcaatatcaataattttattttcacgagcccttcctattatgctatgttcaaaaatagaaaacatttcaggaaatagtgttaaaatattaatcttcatcctgccactcacctactggtcttataactattttcttttcatttatatcaatacttaaaacaatgtctctaagtacaggtattaaaagttcctttggctcttttatccaataaacgtcattattacgagtacttattacatcaaatatcttacctaattcctttccatcagtatcatatactatacattcttttaaatccgaaacataataagtatcctctggaagttccggctctttttctctaggtatttcaatatatttttgcttataagtctcagcgtcattcattgtatctataccctcaattttaagaataactctgtctttttgaaatttaacacctaatatattcatttcaacgccaccaactaaaacagtttttaaacgcttaaatttatttacgtcttctgttaaaggataaacctttacttcacctttgataccatgagtgtttattatctgacctattttaaataattttttttccaataaattcacctctgatttttattcagtcaatatgaccattattttgtctaattcttttaaaatcacaatatataatgatatttctacaatattatatattataattatacaaaagaaaatattgaatttgtttgaatatatcataatttaaacataactcaaatgtcaaattcattttaataaaaaaaagagttaggttaaacctaactcttaatttagatgatttctactataacgcgtttatgttgtttaactgctgctgcttttactactgtacgtatagcttttgcaattctgccttgcttaccgataaccttacccatatcttcaggagccacctttaattcaagaataatagattgctctttattcacttcattaacgctgacatattcaggattatccacaagagatttagccatatattcaactaattctttcataaacgtctataatcaacacatgttgattatagaattcacctccaaaaattacttagtaagacctgcattgttgaaaagtctcttaacaacttctgttggttgtgcaccgttagctaaccattcattaactttttcttcgtttactttgaattcaactggttcagttaatggattgtagtatccaatttcttcgatgaatttaccatctcttggagatcttgaatctgcaacaactactctatagaaaggagctttatgagcacccattcttcttaatctgatttttactgccattttaatttcacctccttttaaggttaattatttattttcaatctagaaaggtaatttgcctccgaaaagaccgcctttcttgctaaattgcttttggaatgatttcatctgcttcatctgcttcttcatcatttcgtaactcttcataagcttattgacttcttgaactgatgttcctgaccccttagctattcttatttttctcgaattagattttgctataagagttggattacgtctttctttaagagtcatagaatagattatggctttagtaacattcattgccacttcacctttttctaaatctagcccttgaagttcctttgagttcatccctggcatcatttctaaaattttattaaggggaccaagctttttcatctgctccattgccattagataatcttcaaagttaaattcttgatttaacattcttttacctaaatctgcagcctctttttcatcaattgcttcctgagccttttcaataagtgataatacatcacccatcccaagaattcttgatgccattctatctggatggaacacttcaaaatcattcattttttcaccaagtccaacatattttatcggcttgtttattatactctttatagaaagagctgctccacctctagtatcgccatcaagctttgttaatataactccacttaaatctaaatcattgttaaagttttctgccacattaactgcatcttgacctgtcattgagtctactactaaaagtatctctgatggttttacattttcttttatatcttttaattcttgcattaaatcttcatcaatatgaagtctacctgcagtatcaatgataactatgttatttccattatccctagcatgtgctataccagcttttgctatatctacaggacttactttatcacccatagagaatactggaatttcaatttgttttcctacaacttctaactgttttatagctgctggtctataaatatcacaagctaccaataaaggtttcttgttatcttttctaaggttcaatgcaagtttaccacacattgtagttttaccagcaccttgaagaccgacaagcattatcactgtaggaccactgctattgtagctaagtttactttcacttccacccataagattagtaagttcttcgttaactatcttaattacttgctgccctggcgttaagctttctaaaacttcacttccaacacactttgaactaacatttgatacaaatgttttaacaactttgtagttaacgtctgcttctaataaggcaagctttacttctctcatggcttctttaatatctttttcagttaactttcctttaccttttagtttacggaacgtctcctgtaatttttctcctaaaccttcaaaagccatgtttacctcctccttataaattttctagcttttctttatattgtataatatcctcatcatcaatggaatatttactttttaattcttctaaaaaacttataatttcatgttctctgtttatactcttttgaagtaagttcagcttactttcataggatagaagttgcttataacatcttttgattaaatcgtgaatagcctgacgacttgttttattaacttcagcaatttctgccaaagacaaatcatcgttgtaataccattccattatgtctctttgtttatctgttaataatgaaccataataatccatcaataacgaaacctcaactctatctaccatctaatcaccttacccacaaaagagattctaacaggatttaatacaagtgtcaagtacttttacttaacacttataaatattttttatttttttaatattttttatttttttgtgtcaatttattttttaaaatttcacttttttatctaaatatcaacacaaaattgatacattattgaaatgtcaactgtaaattgttcactgttaactatataagtgcctctgcaaatccttcagcatcaaacttttgaaggtcatcaataccttcacctactcctatatatcttacaggtatatttaaactctgtttaattgaaataacaactccaccttttgctgttccatctaattttgtcagtattattccgtcaataggacaggcttccatgaattgtttagcttgaatgacagcattttgtcctgttgttgcatcaagaacaagtaaagtttcttttttataatcacttaattccctatctattattctatttatcttttcaagttcattcataagatttttcttattatgaagtcttcctgcagtatcacaaataagaagatcaacctttcttgcctttgtagcttcaatagcatcaaaaactacagctgccggatctgaaccttcctgatgttttaccaaatcaacctcagctcttttactccacacttcaagctgatctatagcagctgctctgaatgtatcagctgctgcaagaagtaccttttttccatcagccttatttttagcagctattttacctattgatgtagtcttaccaactccattaactcctattataagcataacttttttatcttcatcattatcttcatatgaaccttccaaaagtatatctcttataacctcttttaatgctggcttaacttcctgaggatcatttattttctctttacgaatcttatttcttagtctttcaattatatctattgttgtatccattccaatatcagatgttattagaatttcctctaattcttcataaagatcttcatctatagtgatagcaatctttaatacttcattgatcttatctgttaatccatctcttgtctttgttaaccctgtttttaatttgttaaataaatttccaaacaaacttttttcctccatatctaaatttattatatctatttataattttatattaataataaatactattttacatctttatcatatatcgcactagtaaatttacaattatactctagaaatcgtgtagtgttctctaaacaaattgtgatatattaatattcttattatcaccttttaatcatacattatttaaaattttctttatcaataatagtattactcatcatctttagataaatctactgataccactttagaaatacctttttcctccattgtaacaccataaataatatcactcgcttccatagtaccctttctatgagttattactataaactgagttctattagaaaatctcaataaaaattctgcatatctatagacatttgcatcatcaagagcagcttcaatttcatcaagtatgcaaaaaggtgtaggtttcatctttaatattgcaaaaagtagtgctatagcagatagaactttttctccacctgacataagatttatattttgtagtttctttcctggcggttcaacatttatatctatgttagcactaagctcatcaccttcaccaagtataagttctgcacttccaccctggaataaatccttaaatgtttcgttgaaattatgatttaatattttaaaattttctttaaataatattctcatttcaccagtcatttcatctataaccctgataagctcttctttagctttttccaaatcctctgcctgatttgacataaattcaaacttttctttaagttcctcatattcttcaattgcagctaaatttacaatacccagttttgtgattttagattttatagatgaaatattactttttaaatcttcttcattttccacaggttcacatatatcaagagcctcagcataagtaagttcaagctcttcattaagttttttgtatatatgctcctcttcgctttcctttttcgcctttattacttctctcttatttacttccatctcttcacggcttatttcatccatcactgcacttattaagttgtctttctgtttaaattcttctttcaatttttctttttctatttcatcatctttaaagttaagttctaaaacattaattttagtattgttttcctcaatatttttttgtctctcttttattgaaaaatttagttctattatgcttttttcattttctttactctctctaacaagattatctctttttccacttaaatcatatgattctttttcgattcttgaaaagtcgtttttctttccttcaataccttcatctaatgctgctttagcaattttcatctccgtcaacttagattcatctttgctaacttctaaagttttcacaccaatcaattcttccagctctacactctgatttttttttgtaacattctcatcttcaagaattcttatttcgttttctttaacatttaatttttcagatatttcttgcttatcttcctttattctttccaaatcaattcttgtattttccaaagtttttttaagcttattagtgtcattttgaaggccttctatttcactttgctttcttgtaaggtctatatttttagaatgtattaaatctgtattattaagaatctcttcatctatttcttttaattctagtgaaagtttctgtccttccttcataatatcagcatatacttttttcttttcatcaatcttatgagcaatttcttctatttctctttttcttcctagaagattagtatttctaccttttatgctccctccagtaagagctccccctggattaacaacttcaccttcaagagtaactattttatatctatactgactaatctttgaaatctttaatgcacaatccatatctctgcatattatagttctacctagagtataattcattatattttcatatattgaatcatatgatattatgtcactacctatacctatatatccttcagatttagttatagaatcatctaaatcaagctttttacctttaattatattaatgggtaaaaaagtagctcttcctaaattatttttctttaaatatataataagcttttttgcaacctgttcagtgcttgttataacattggaaatagctgctcctaaggctatttctacagcagtttcatactgtttatccacactaaaaacttcacctaaaacttttgtttcttctgcaccttcaatattttcgtcctttatggattccataagtgatttaactgatctattatatccctcatagtgcttttcaagattttcaagcatagttttattagcatctaacttagttaaaactctattcaattcttttacatcattttctttctttgtaatgtttccttttagtgtagcaattctcttttttaactctgctgtagaattacgaacatcttctatttcttttttcttattttcaatatctctactcaatcctttgtatgtagccatattgataactatgttattttcaagataagatatggatgaatcaagagactgtcttttttcttctctaagttccaattccctctttaatatatttatttcatttttaacatctgaattgcttctcaaaaagtcaagttcgctttcttgaagtactttaagctcagccttcatcttctctagttcaagctgctttatcttattagtttgctccaatttttcaattatttcctttttatcagcctgttcttcaaaacgtttagctaattcttgttctagcaataacttattattttcaatatcttccattcttttagagatatcttcaacttcgtaactatttctctttatcttctcttcacaatttttaattctttcatgataaagttctatagcttttccatcatcattaataatatcttttaaagtatagtactgctctttctctcctaatgtttttttctcaatattttctattctttcttctagattgcttaatatttccctatctttagctatgctttctctctttttattaattccctcaattcttttatttaattcttccttaaacactctcaattcctgatccataatctgaattgtatgtactattagagatacttcttttcttttcagattatcagataattctttgaattcaatagccttttctctttctattctcaaaggttcaattcgctcttcgtaagtagataatatatcatttattctcacaaggttatcatcagtgttacttagttttttttcagcttcttcttttctatttttaaatttaacaataccagcagcttcctctaaaagcgctcttcgttcttctggcttaccatttaaaattgcttcaatcttaccttgtccaataagagaatatccttccttacctatacctgtatccataaataaattagtaacgtcttttaatctgcatttattgttattaattaaatattcagattcaccagacctaaaaatccttctagatacagtcacttcattatattctgttgcaagctgttcatcactattatcaagagtcaatgaaacctgagcaaggcctacaggctttctaaactgtgttcctgcaaagattacatcttccatctttccgcctcttaaaacctttatactctgttctccgagaacccatcttactgcatcagatatattactttttccacttccatttggacctacaacagcagtaactccttttttaaattttaattctgtcttatccgcaaaggatttaaatcctcttatctccagagattttaaaaacaatctttccactcctcatttaaaaaaatatagtaggtaaaagtcccacaataaatattattataataaaaatagcaaaagcaatttttaatttttctctagtctttcttttcaatacaaacacttccaatcataattagtttatagcaaacattaataaatatcaattaatatatcaaaagcgagagtttcccctcgctaatatattatatccacttttttattttctaggtagagtataattttacctctttcaatatcattattttgctctacctttatattctttttattatctttcaatcgattaaaatacatctttttgttagcatataatttacttatctctttaggattaatatgaatttctgctttttcttgttctttcatattttctagtatgagttcaatcataagactactctcaacaagttctctaaatgccggatgaaaaggtcctgccacaacatcatttttttcatttattgtttcagtaggttgaagacctattcttataacattaacagagttatgtctatacatcttatacatttccttgcttatttcaacagcttcttctaaagtataaggtacataatctcctcttttatacataatctccatggcagttccccttattgttaacgccggataaattctgcatatatctggtttcatttctatcgatgcttttgttgtctctatgtcagtcttaaaatcatctcctggaagaccaggcattatttgatgtccaagtataaatccatattcttttatcagctttgatgctttagaaacctcctctacatcatggcctcttcctgcttttaaaagaatttcttcattaagtgattgaacaccaagttcaattatatcaactctgtattcctttaaataggataatatatattgatttatatagtctggtcttgtagataatcttattttatctataaaacctttatccttaaactctcttgcaacttgtagaagttctttttgcttttcttcttttattccagtaaatgttcctccaaagaatgatatttcaacaactgcattactatggtcaatagtttcaaggtattcataaacagtctttctaacactttctgcagtaacttcttcattttcatcattactagaagaaatatctcttttctctgtgtctttaacaattcttaatgaatctttttttaccccagttattttatcttgattgcaaaatacacaatcatgtgggcaaccttcgtgtggtacaaatattggtattatataataacttttactcatttttattatccagtttcattaaggcctgtttagctgcattttgttcagcttcttttttactatatccacatccttctcccataatattgttttctataacaacattagtgaaaaacttacgtctatgtggtggaccttcatgctttatcaattcataatgaattgacacttctccatccttttgtaaaaattcttgaagcttagttttaaaatctaatatgatttcattgtttatagccttctttattatttcttcaaaatgcaataagataaaatctcttacaaatcctatgcctttatctaaataaacagcagctataactgcttctacagcatcagcctgtatagaaatcctttctcttcctcctgttaattcttcacctttgctcattcttatatattcccaagatgaagctttttagcaatctcataaagagaattctcacatacaataaggctacgtgtctttgtcaattctccttctgacttgctcttgaaattattaaatagatattcagtgatacaaagttgtaatactgcatctccaagaaactcaagtctctcattatattccgcatctttaaactgatttgcaaacgaactatgcgtaagcgcagtttttaataatgtgggattattaaaacaaactcctaaattttcttcaatttctttaagtgtatacttattcatttttccactccttagaagtttattcttcaacttgctaatataacaaattcaagaataaactaattaataaagataaaatcccgcaaacgcgggattatgctattcttcgtgatgagctttaacgtaattgacaacatctccaactgtcttaaagttttcaacgtcttcatctggtatttccatgtctagttcatcttctaaagccatgataagctcaacaatatctaatgaatcagcgtttaaatcatcaataaaagatgcttccattgttacgcttccctcgtcgatacttaatttatcagcaattattgcttggattctttcaaacatttgtttcacctcccaagttctacatttagataatattatataatatttaaatcgtcaatatttatttaattttgttttgaaaattcttttttcatattctcaagaactttattatcatagaaaatcttagtctgtcttattgcattcttaaatgcttttccatcagaacttccatgcgcttttatacatattccatcaacacctaaaaatggtgctccaccatattctttgtagtcaacttttttcatcaagctttttaaaactggttttaacagcactactccaaattttgaaatgatagatgcctgcattacttcatctttgatcatccctaaaattgtcgatgctgatccttcatacattttcaaagcagtatttcctacaaaaccatcactaactaaaatgttagtttcaccttttggaatatctcttggttcaacgtttcccttaaaatttaattctccttcatttttaagcaactggtatgtagcttttgaaagttcatttcccttttcttcttcttcaccaatgttaataagacctatacttggatttttcacattaaaaacatgctcataatatattttacccattttagcaaattgtacaagaaaagcaggcttgcaatcaacattggctccaacgtctactatcataaactgaccttttctaccaggcattataggtgctaaagctggtctttcaacaccctttattcttccaacaacaagtgtacatcctgcaaggaatgctcctgtgcttcctccagatattattgcatcacaagttttatccttaactaaatttaaagccttaactatacttgaatctttctttcttcttactgccattacaggatgttcatttgtggagataacttcctctgcatgaattactgtaatcttatctttaggatagtcatatttagctaattccgcctttattttatcttcaggacctgtaatataaaattctatatcactatattctttaattgcattaattacgccctcaattacagcaactggtgcattatctccacccattccatctatagctattttcatatttattctcacctctgctatatatttaccgtatttttcatataataacgtgtaatataattaattataccgtattattaatcatattacacctatatttacataataaatttatatatctacttttcttaataattagcatatattatattgattttctatttgttataaaattaacataatattttataacattctttttatttcctaatattcatataatacaacctaattattaattgtttaccatcattgatattaaaattaatatgtaaaataaaatccgatgaaaaactattttaatctcgtttctcatcggatataaaaaaagaaaagaaagtcatatgactttcttttagttttcagaagctactacttccttacctttgtaaaaaccacagtttttacatactctatgagcaagtttcatttcgtggcattgtggacattctacaatacctggtaaactagctttaaaagtttgagctcttctcttcttagttctagcactacattgctttctagctggacaacccattcattacacctccttattatcaaacaaacctcttaagacttcgaaacgtatatctacatcttctttgttgcagtcacatgccttaacatttaagttacagccacatttctgacatagtcccttgcagtcgtctttacatactctcttgattggtaaagttgaaattatacttgtttcaactaattcagtgatgtctaaaacatcatctattacaacaacagcttcttcgtcttcactttcactgtttgttgtaaacctttcttctatatcaatatctattggatagataaaggtatctaagcatcttgaacataccatttctaaatcagtctttatattagctctaataactaatatatctccgtctgaattcataactccactaaccttgcaaggagttatagacttgataatgtcaccttcaaattcaaatgactcaatttcaaaaatttcgtcaatttttttacttctgtctttacctgaaataatatctgaaatttgtatcttcatacttatcagagtatattgtatatttgacgcaatgtcaataatccaataatctccttatcactccttagcaattaatttataaatcaaacacaacttattatataaaggagtagtctaaaagtcaagatatttatcgtaatttactacttaattagtcctaaagtttcttcagcaatcattaattcttcattagtaggaattacatataacttaacctttgaatctggtgtagaaatttccataccatctccaatattttgattgtcattcttagctgaatctatatcaattcctaagaattccatattagttaatgctcttattcttacttctggagcatgttctccaataccagctgtaaatacaacagcatctaatccacccattgctgctgcatatgcaccaatttgtttctttatttggtatccatagatatccatagttaatagagctctctcattattcttttctgctgctgctcttatatctctgaaatctgttccaattcctgatacacctaaaacaccactctttttgtttaagatgtcatttacttcatctgcactataacctttttctttttgtaagaatgtaactatagcaggatctatgcttccacttcttgatcccattattataccatcaagtggtgtaaatcccattgttgtatctatagatttaccaccattaacagcagtaacacttacaccatttcctaagtggcaagttattatcttaagatcactaatgtctttattcatccatttagcaacttcacctgaaacatatttatgagaagttccgtggaatccatatcttcttatatgatcttcttcataatattcatatggcactggatacataaatgctttttgtggcatagtttgatggaatgctgtatcaaatactgcaaccattggtgtatttggcataagttcctgacaagcctttattcctataatattagcagggttgtgaagtggcgcaagcttaattaattcttgaagactttctaaaacttcatcagtaactaatacagattcagaatatttttctccaccatgaacaactctgtgtcctactgctgagatttcatccattgacttaattacaccttgtttttcatcaattaaagtctttaaaactaaatcaatagctatttgatggtctttaagatctgtttcaacaacgtatttttctcttccatcaactttttgagttaatatcccatcaattcctattctttcaactaacccttgagctaaaactccgttatttgacatatctataagttgatattttaatgaagaacttccacagtttataactaatattttcatctttctaactccttacttgaacatctaatcttttttaattatttaatcccttgtgcttgaacagctgttaatgctacaacattaactatatcttctgaactacatcctcttgataaatcattaattggcttagcaaatccttgacaaactggtcctatagcttctgcgtttgcaaatctttgaactaacttatatcctatatttcctgcttgtaaatcagggaatactaaaatatttgcatttcctgcaactttactttctggagccttttgttttgcaaccttaggtactattgcagcatctaactgtaattcaccatctatatctaaatctggtcttaattcttttgcttttattgtagcatttctcactttatctactacttcatgatctgcacttcccattgtagagaacgataacattgcaacttttggatcaattttagataatagtcttgcattatcagcagttgcaattgcaattgaagctaacatgtcttcatttggcattggattaaccgcacagtctgcaaagaacaataatccattatctccataaggcgagtttggtacttccattatgaagaagctcgatacacacgatactcctggagcagtttttattatttgaagacctggtcttaataaatctcctgttgtatggacagcacctgataccataccatctgcatcgtctaattttaccatcattgtagcaaaatataatgggtctctaactattttttcagctttttccatagttacgccttttgcttttctcaattcgtaaaatgcatttatatacttttgtaaattttctgcttcatttgggtttattatttcaacatgtgataaatccacatctaattcttttgcttttgcaaggatttcattggtgtcaccaacaagtataggatgagctaatcctaaatcatatattttttgggccgcagcaatagttctttcttcattaccttctggaagaactatttttttcttatttgattttgcagcttcccatatttttttcataagttccatagactgtttctcctttcaacatctaaatctctataattaatatactcctataagcctagatatttcaacctctaaaatagaattcgatagattggcaataatctaaattgtcagacaattaaaccgtaaaatacctatacactaaaagtatattttttaacaatcaaatttcaaaaaaattttttttgacatcatgtatttttatattttttccacacataattaatgttaatccatgcttttttatactataataatctttaaataacataataattttgatattcggaggcgatttttataattacaggtataattactgaatacaatcctttccacaaaggacataaatatcatttacaaagtgcattaaaagacaccaaagcatccagcatagtttgcgtaatgagcggtaactttatgcaacgtggtattcctgccatggtagataaatggacgcgaactgaaatggcattaaaaaatggagtggatttagttttagaacttccactagtctactctgtatcatcagctgagcatttcgcttttggaagtgtttcattgctaaattctttaggcattattgataatttatatttcggaagtgaagaaggacatattgaacctctaaaaaagatagctcatgttttatgcgatgaacctgatgaatttaaagaacttttaaaaacaaatataaattcaggactgccatttcactcaagcagatctattgcactaaataaatatttagattgtgataatgttgaaaaagtactatcaaattcaaataatattttaggaattgaatatttaaaagctttgaacatattaaaaagtaatatttgtccatatacattaaaaagagaaggatccagttataatgatgaaactgtagataaaattttttcttctgctacctcaatacgtaaacacttaaaaacaggatctcttgataaaatttctgaaattctaccatttgaaacctacaagattttagaaaatataaatttatctcaatatccatttatatttgaagagaatatgtttaaatatataaaatttaaactccttacagaaaaagatacattaaaaaatcttcctgatgcatcagaggggctagacaataaaatatacaaagaaatactatgttccaattctttaaatgaacttatattaaaatcaaaaagcaagcgatatacctatacacgaataaacagaattttagcacagtattttttaggattagagaaatatgatctgctatctcttgcaaaaactcccgctccatatgcacgtattcttggttttaattccaaaggacgtgatatattaaaaagaatgaaaaaaacatctagcatagatattattacaaagatacctaaaaatatctcttccattcatatggaacttgatatacttggtacaaaagcatactctattttaaatccacatataaatccaatggatgattatcttagggggcctgtaataataaaataatattttacataagcaacagcatatatatgtatagtaaagctctatattttcatattctgctttactatattttcttaattataaataacggtgacaatgaataggagtgattaaatgttatatatagctgtcttatggcttatgattattttattaacagtacttttaaaaaaacaacttaaaattaaattcaattcatttatatgcattgtaatgacaatattggtggttctttttgcagcaaacataaatcaatgtatagtagctgcacttgaaggttgcaaattgtggtataaagccatattaccaactacatttccttttttaataatctgcaatatgctcatagcctatgatggtataggcttgtattcaaaatttttaggacccataatatgtaaacctcttgcactttcaaaaaattgttctttccctattgccgccagtattttatgtggatacccacttggtgcaaaatattgtgcagatttatatactatgggatatatagaaaaagaagaatatataagacttttaaatatcgcttccaatgtaggtcctttatttcttataggctctgtagcttcagctcttcttaataatattgcacttggatacatactcctagctggaagctatatttcatgtataattattggcattattacgaaaaaaaagagaacttttaaaaatataagttctctgaaatctaagaatgattgcaatcctaatttaggtattgctattaaaaactctgttgaaaattcaataactacagtattgaatataggaggatttataattattttttctgtcattatttcacttataaaaagtagttctcttatagctattttaattaataatctagagtacttttttaaaattcctcacgatactctatactctgtattactaggaagtattgaaataactaatggatgcagcctactagcatctttatcaatctctatgcctctaaaacttagccttataagcttcttatgttcattttctggcattgctataatagctcaagtaagctcatttgttggatctacaggcataaaacttttacgttatataatttttaaatttatacaaggaatttttagctttattataacttatatccttatgatgattattccttcttctgtttatacatcaaatatatatatatattcacaacactctacaaattactatttaattccagtaattgtaatgcttgtactatttatacttttacaaattttcaatattttccatactagaaatagtgcaagcctttaagttttattttttcatacttcttagttcttttacattttcctttataacaaatcctacattgtttaatgttttgtcaatttcatttgcggcattttcaaaatttgcttgaagacccgttattaatttcattttttgaagttcaacttctttatctaactgacttaaaatttcatctgaataatctctcgaaccaagtcttatggccttagcatccctttgtgctgaggctataatttcttctgctctaaccttagcttctttaactatattatgattctcaatattctttcgcatcatatttgcagtttcttttttaacagaatcatactcctttttagcttcatttaaaattctttctttttcattcattatccactcagcttttttaagttgatccggtaaatagtttattatctgatcaacaacttcaagaatttctcttttatcaagcataacctttccgctcataggtactttaggcgaattatctaccacatcttgtaaatattcaagcaattcaataatatttacatctactttttccataaaaacactccttagctatttatttttgtcaatatatcagaaacaatttctttcggaacaagcccttcaatatttccaccaaatttagctacctgtttaacacacgaagaacttatgtgcaagttattcggagagctcatcatgcatatcgtttcaatatttgaatctaactctctgttcatatatgacatttgtaattcatattcaaaatctattgaatttctcaaaccctttaaaactacatttgcattatattcctttaataaatctactaaaagaccattgaagctgacaacttcaacattctctatatcatttgtaactttctttataagctttactctttcgtctatctcaaataagtgctttttatctacattaactaatacacctattataactttatcaaaaacttttgctcctcttcttattatatctacatgaccattagttattggatcaaagcttccgggataaactgctatactcattttatttctcctcatatttataataacacacagttgtatttccatattttttactctttaaaagctttatgttatcatatcctgaataaatttcttctatagtatctattttagttactattattccatcttcttttaaaagattattttctttaacaattttcatagcttccggaatcatctctttgcaatagggaggatctataaatattatgttaaactgctttcccttctgcgcaagattttttaatcctatgtaggcatcagtctttataggaaaacaaatatcttcaaattttaaattttttacattctcctgcaataaaggaaaagttatttcacttttgtcaaataaataaacttcacttgcacctctacttgcagcttcaagccctaagctccctgtacctgcaaatacatcaacgattgttccttctggtatatataattgaatagagctaaacattgcttctttcactctatctaaagttggtcttgtttccattgttgccggaggtattaatttatgccctcttgcttttcctgctattattctcaagtatatttcctccttaaggtatatattaattatattaacatatttgtatataaaatttcaatttaattaaaacaaatatatttactgcttctttgtaagtttctacttatttcatttacaagctccctatttactgtagaatcatctttaattatattaacagcttcttgctttgcgcatcttagaatattaatatcctcataaagattagcaagagcaaatcctgcatcaccgctctgttttcttccaaacatctctccagctcctctaagctttaaatcttgttcagatattaagaatccatcacttgattcagtcattatcatcattcttttttttgttatattactttttgccttagcaattaaaacacaatacgattcatattgacctcttccaactcttcctcttagttgatgcaattgtgctaagccaaaacgttctgcattttcaactatcataacagaagcattgggaacattaacaccaacttcaattacagttgtagatattaacacatcactctcatgatttttaaatctttttataatatcatctttttcatttcccttcatttttccatgaagtatttctactcttaaatttttaaatatagtactagttagtttttcatatagtgtttctactgaattaagctgttccttttcatcttcttcaattaaaggacatacaatatagacctgtcttccttttttaatttcatcataagctaattcatacgctatatctcttttagaatcttcataatacctagtatcaattttctttcttcctggtggaagttcatctattacagatacatcaagatctgaatataaataaagagcaagagttcttggtattggagtggctgtcattactatacaatccgctttattacctttattcataagcctgcttctctgttcaacaccaaatctatgctgttcatcagttattataagtcctaatcttccaaattcaacatcttcttgaaataatgcatgagttcctataacaaggataggttcatttccccttattctttcttttattctcttcttttcttttatacttgttccacctgttaaaagctcaatttcaatgttaaattgtgaataaacctttttagcttcttcataatgctgagttgcaagaatttctgttggtgccataagaacactttgataattatttttaataacattaaatatagctataagcgcaactatagtcttaccgcttcctacatctccttgtataagtctattcattggacattgtgatttctgatctctaagtatatcacgtacaacttttgtctgagcattcgtaagaggaaaaggcaaactttccttaaatacttttaattcatccacccattcaaatttaattccattactatttttctttaactggtatttcaaaagcaaaagttttaaagaatatgtaaaaagttcttggaatttaagcctagttttagctttttccaacatatctttattttccgggaaatgaatacttcttatagctgaatctagtgatacaagtttatatttatctaatatatcttgtggcaaattttctttaatattcatctgagccaatatagtattaattaatttttcaaataatttattactaatatcgccctttagaggatatttaggtactatttcgtttgaaatagcttctccacaagcaataactggtcctactatttcaagcatattaccaactcttttaaatttccccataagattgtactggcttcccttttgaaaattatttttcacatagggttgattaaaccactttgcagtaactttatgttcaccatattgaaagtctattgttgttaaaagcttgccattttttgttcttacatctcttttaaatgcttttacctcacataaaagaataagcttctcctctccatcaatagtttcaaattccacattaccttctataaaatcataatctctaggaaaatataatagaatatctaaaatattaaatataccacatctatttaatttttcagttgctttaggtcctactccttttaaagttgatatactgctatatatatccatataaacctccttttcgattatctataaataccgaatttattcttacataataaatatctgttgttcattataccattatttttataattgacaaaatcatatattagcacaatttaatataaattataatattaaaatagaattataatttcaccactatacttctaataatctaataaattcaaatagacctgctcaattttgaacaggtcctaacattatatattatgataaaacataacttcataagtattatgctatattttcttgtcttctcttttttaattcatagataattttatcttgatactcaccttctaatttatatccttttatatatattatataaattagaacagttataacttatggtacacatatcattaatattttcatccccaaaagtgttgtatcagtttgaactgaatcagcaacatacccaacactagttagacctaccccaactgaccatcctgctactgctgatgctatttttacaagtaatgtttgaaatgaagcaattatactttcatttgttgtcccaaatttatactctccataataaatttctacttgtcctatttataaatttaatatgaatttaaattcttaacgctatctctttctataaacttggttggaataattacaagtttagaataatttcttccttttattttttcaataactaaatcaactgcaacttttccaagttcttcaacttgaacaccaattgatgttaatggtggtatagtatattgtgatactacagtatcattgaatccaattatgctaacatcaaccggtactttgtattcgttttctgtaagccctcttataacacctgttgcaacagaatcattagcaacaaaaaatgcacttggaatttttcgtccttcatttatataatttattatcgcatcatatccaccctttgagctcatatggcaatctattatataatcctcttgaaacaaatctttttcttttaaatattctatataatgttttaatctcttgtcaaaaacaggtacctttaaatctcccaaggtattttttgctccaatataaccaatatctttatgccctaaattcaaaaaataatctaatgcctgttgaatcccaagtttgtagtttatttttattccatcataaaattcatcataaggtgaagaatctaaaaacacaatgttaggtgttttttcagacagttcatttatttcatcatcatcaaattttcctattgcaattataccatcaagtttaacatcatctagagtttcataatgtttatctcttttaaacattatgataacttttacatttttcaaaaaacaggctttatccactatatttttcaaaataagataatatggatcttctaattgtttaaaaacatcatacatttctacaactccaatgacatgaaagcttttctgtatgttccttccttttctttgttttgctgttttataattaagttcttctgcaacttctaatatttctatcttagtatcatctgatacaacaataccagtatcattattaagcactctagagacagttgctgtagaaactccaactttttctgcaatttcttttaatgtagccaaatatcctcactcccttaatatgcgtattcaaatctttttatacattttattatatactttcttaaatgtatggtaaaacaaaacctccttgtgatattttacaaaaaatcagaaggaggttgtaatattcaaattttaattaagaattataattgatatattcataaaactacttaattatgttaacatcaataaattagaaaatcattaaaattctattctactgataacaagaagtaataaagtggttgatttcccttgtaaacttgtatatcaaaatcttcatatttttcttcaagcatactagagaaattttcagcttcttcatcactaacatcgcttccataatatacagttataagttcactatcatcatcaatcatatgttctaaaactttaactgcaacttcacctttatcctgacctacttcttttattttaccttctaccaagccaagcatattaccttctttaatttcaattccatctatttcagtatctcttacagcataagttacagaaccagtctttacagcctcaattgcagattttagttcttcaaaattatcttctacatcactatctggattaaacatagttacacatgcgataccttgtggaatacttgttgtaggtattacacgaatatccttgtcacttatttctgatgcttgatttgcagccattattatatttttattatttggaagaataaaaatatgttctgcattaattttatttattgcttcaagcatatcttgagttgatggattcattgtttgaccaccttctattacatagtcaacacctaattctttaaaaatatttgaaatcccatcacccattgctactgttacaaaaccataacttttcatttcttcagaagaagtagcaacttcttcatcatggttattattctcagcttcttcatagtctttagattccattaaaagttctctatgttcttctctcatattatcaatttttatttttgataactcaccaagttgaacagcatgtgataatacttttcctggatcatttgtatgaatatgaacttttataacatcgtcataacctacaactatcatagaatcaccaagttcttctattttatcttggaattcttttgctttatttgcatcaccaagaattataaattcagtacaataaccgaattttatatcaatttcttctgtagcttgagcccctacttttccgctttctttaactactatatctttaacttcggcttttattccatcttttagtgcttcatacattccttgaagaataatataaagtcccattccacctgaatcaacaacttttgcttttttaagtgctggtaaaagttcaggtgttttatctagcataactttagcttcttttgttacttcatccataaaatctacaatatcatcagcttcacttgctactgctgcttctgatgctgctcttataactgaaagtatagtaccttctgttggtctcataaccgccttgtatgctgatttagacccttcaaagaaagctactgcaaattccgaacaatccacatctgttttaccttctaatcctttagatatacctctaagaatctgtgacaagataacaccagaattacctctagcacccattaaggcaccctttgccagctttttagatatttctccaattgagtctgtatttatgttttctatttcttttactgccgccttaaatgtcatagacatattagtcccagtatcaccatctggtactgggaaaacattaagtgcatttacaaactcactttcttctaataatctattgctagcattgacaaccatgttataaaaatcatggccattaattctttcatatttcattttagtttaccctcctagactctaaccgcttgcacattcactgtgattgatgaaactttaagtccagtatagttttcaacgctatagcgaaccttttgtataatattgtttgatataacagaaatctttgttccgtattcaaccataataaataattctatttgtaatctatcttcatcggttagaactaattttacgcctttgcttaagttctcttttcccattagctcccaaagaccttctgtaggactttttgaaaccattccaactactccgtaacactccattgttgataacccaacaatttttgctaaaacttcttctgaataagttacattaccattttcgttgcaaaatccaaccatatatattcctcctattattatatcctattttatattctatattagaacataatttaattcaagttttttgaagcctcaatacatttgtttacctgattttataataattatttccattttatttatattgtgtacggataatgaaaaaaaatatgtgaaattattcattttcttaaatatagtcttaattaagagaactttcaatagaattttattacaataatgtagtaactacaatatatttttttcatataaccatatttatttaatattctataaatatatcagatttatctatgtttaattgtcatttatcctataaattttacacgaatattctaattattattcttttttacgaatatctaaatttaatacaaaaaaatcacttgcataacataaaatcatatgctataattttgaatgtcctattgaagatgattatctttgtaatataaggaggtgttttctaatggcaagaagatgcgaaatttgtgataagggtgttgtagcaggtgtacaatacagccactcacatcgtcaatcaaagagaacttgggctcctaacataaagaaagtaaaagctttagttaacggaacaccaaaaactgttcatgtatgtacaagatgccttagatctggaaaggttcaaagagcaatatagttcataataaggaatgcaattgttatcccaattgcattttttattttgcctaaaaacaaatacataaatcatattttacctacacttatctttatttattcattgtctcattccattataattaaatttcaccaaatacctacttaaaaataaatagtcataaataagatttttgaaatcaaaccttactcatgactaaatattaataatattattttgtactcttagagttatttatgtatactctactttttccttctaaaaaacttaattatattagaaaaaaatttaggtaatttaacagcaattattttcatacttaatgcctcccatgaatattaattttttcaccttattatattaatattcacaaacatctaaatatgttcctattttttaatcaattgcatgaattattaataattctccactttcatattttatatttataggtgtatcaataaattcattgcatacagccctaggatcaagaagatgcatatcataactattaagattatacttggcacctcttatctcaaaaccctttacaacatcacttaacgcatgaaaagaaataatttcgccctgacttccatttaaactcatatttttatcagcaagatacattttgttatgatcatcaactattaaaagtctggctcccttattctttgttgtaagcaaaagtcctatatttccaagactatgatctgctcttgttccaagtccaccaaaaagatatattgtatctgcacctctttttattgcttccataattgcaatttcagtatcagtataatctttttctggaggaaattttataatttcaacttgtttttcttctattttttttaatttttcttcactaatagaatcaaaatctcctaaaataatattaggcataatttcataatcatataaatattcactgcctttgtctgctcctataattaaatcaccactcttaatataggaattcaacaatttctttgaaggtttatttcccccagtaacaatgattgctttcaaaatattacccccttaaggctttaatattttcacttacatctccaccattaaatacagcagaacctgcaactagaacattagctcctgcatcaattacttcttttgcatttccacatccaattcctccatctacttgtattagaagttctggatttaacttttcgctaagctgtttaacttcattaatcttatcaagtgaatatggaatgaatttttgtccaccgaacccaggatttactgacattattaaaaccatatcaagattaggtattaaattttttaaaacacttacaggagttccaggatttaatgctacccctgccattttaccttttgattttatatagtttatagttctgtctatatgtctatctgcctcatagtgaacagttattaaatctgctccagcctctataaaatcatcaatgtaatgtgatggattatctatcatcaaatgtacatcgaatactttatcagtaatctttcttatgctctttattataggaaaaccaaaagatatattaggaacaaaagaaccatccataacatctatatgaataaactctgctcctcctttatctatagacttaacatcttctcctaactttgaaaaatcagctgataatattgatggtgcaatttttaccatttgtttttttcctcctccattatttcttctaatgatttaatataaaaatcatatctgtacttattaaccttaccttcttcaacagcatccttcaatgcacatttcggctctttatagtgcagacatcctctatacttacaattatcattatactcgctaaactcaggaaaacaatatttcaaggagtttttatccattaaatctttaatttccaaagttgaaaatcctggtgtatctactatatatccctgtgcaacttctataagctcactatgtcttgttgtatgcttacctcttccaagcttttcactcacattacctgtctgcatatgttctttatccgcaagctgatttataagagttgattttcccgccccagaaggaccacaaaaaacagtaacattaccattcattttctcttttaatctttctatacctattccctgttttgcatttataaataaaacttcataacctatgtcatttattctttttttaatttcttctctctcttcttccgaaaccaaatctatcttattcaagcacactataacttcaatattattatattcacataaaactaaaaatttatttaatagatcaaaatttatatctggatttttgactgcaaaaacaataaatgccaacgaaacattagcaactgttggtctaacaagttctgatgttctcttatgtatttcttcgataacgccctttccattttctatttgtattgtaacattatctcctaccataggttttatgtctttatgtctgaatttccctctagccttacattctattaagccttcttctgtcttaatataataaaaccctccaattccttttattatctttccattcatactattcctccataaaattttctataaattaaatatattataaaaggagaggcacattaattcaacctctcctctataatttatttctataattttattgtataatttttaatttccactaggagttttattactttgagagtttgctttgttatcaacatcatcccaaggtccttgtggttctttattttctgtattaccagagttaggtcctgatgtattgctgccaccaggctgagtctgtgatgaatttgtatttccgtttgaactattattgtggttattaccgttattagtattaccactattattagtattatttgagctgccactattagtattacctgtacctggattagtctctggtgttactgtagtttctttttcaacatatttaccaactgtaattttaactgtatctccttgttttactgtttcaccttctgatgtttgagatgaaactattccatctctactcttctcacttacctcttctgtggtaacagaaacatttagcccattattggccaatctgcttttggccttttcttctgataaaccaacaacattaggaactgttgcatattttatctttggtcctttacttacaacaactgaaatttcttgatctttagtaatttcagtatcttttgttggtgtctggctaattatttcaccgctagcaacactgtcactatattcttctgtttttttagttattttcaatccatatgaacttaatatttctcccgccttatcaagatcatattcacgtatatcaggcattttaagcttgttttcaccaccacttactattacccttacttcacctttttccttaaccttatcgccagcttttggattcatttccattacagtaccttctggatattggtcacttgtttcttctccagcttcaactaaaactaaatttaatttttcaagtgtgcttttggctgtgtccacatccattcctactaaattaggaacttctatttcttttcctccacccacatttccaagtattctatatgttccccatcctaataatcctaacataaacaaacatgcaacacctattaagattttctttataagattactattaccttttcttttagggttttcatcatcatcgtcatcataatagtcatcatcatcataatagtcatcatcatattcttcatgaactgattctgaatttttcttaacttcaacattttgtttagccatttcttctgtaactgcagacattattattgtatgttcattatcatcatcgtcatcatcaatacgtgcattaggattttctttaatcttttgaagatctgcaatcatttctttagcgctttgatatcttttgctaggctctttttccattgcttttaaaataagcttatttaaactatctggtatttttgaattaagttttttaggtggaactacttcttcttgaatatgttttaatgctatggttactgcactgtcagcttgaaaaggtacatttcctgtaaccatttcatacaaaacaacacctaatgaatacaaatctgttctacagtctataaaactgccctttgcctgttctggagaaagataatgagctgatcccataatagtacttgtatttgttatagtagaagatgttgaagatttagcaataccaaaatcagttactttcattacaccatcttcagtaactaaaatattttgtggttttacatctctatgaattatcttatttctatgtgcacaatctaatgctcttgcaatttgtattgctacagaaatacctgtttcataattcatttttccaacttgcttaatcacatcttttaatgtcttgcctttaacatattccattacaatataattaatatcatcttgagttcccacatctaatatgttaactatattattgtctgatagtgttgcaatagcagtagcttcgcctttaaacttttcaacaatctctggattattgcagaattctttttttagaattttaactgctacaaatctattaagcttattgcatctagctttaaatacttcagacattcctccttctcctattttctctagtaactcatatctgttaccaagtacaattccattcatatctacatctctcctccaaacaacaatactgttatattatcccttccgcctttttcctttgccaggtcaaccagattattagcaatgctaatataattgttctcattatcgattattttcaaaatatcttcctttgtcacttcatttgttaatccatctgaacataatataaacagattatattgattaatatcaagtctgaaaacatctacttctacatgaatacaagttcctaaagctctagtgataatatttttctttggatggtttacagcttcaacctcacttatagttccactatctaaaagttcttgaactaaagagtgatcctttgttattttttttaattcaccatttttaaaagccatacaacagctgtcacctacatttgcaatgtaaataaactttggagttacaagagcagctgttaccgtagtacccattccatttagtttatcatttgtttttgagaatttatagatatcttcatttgcagcttttattgcattagatattaatgtttcttcaccttctaatgagtaattttcatctatatattgaacaatctgctcagctgccattttacttgcaacttctcctgcattatgtcctcccattccgtcagctacaacataaatcttaaaatcagctctttctaaatagcaagcagaatcctcatttaatttacgtcttaatccgacatcactaactaagcctaccattttattccccctatcttttgggtttcaatgtaacttcttctaagttgtccacatgctgcatttatatcactgcccatttctcttcttgtagtaacttctataccattatttcttaatatttcggaaaaatcatctattgcttttttcgaagatcttttaaatgaattttctttaatttcgttaacaggtattaaattaacatggcaaagcattccacttaataattttcctaaagcttttgcatcttccattccatcattaacatctttaaccaaagcatattcaaaagtaattcttctctttgttttattaagatagtatctacaagcttctaataattcgcttattgtatatttattagcaattggcattatttcttttctcttttcatcgctaaatgcatgtagtgaaatagctaaggttatgcttaattccttgtctgcaagttcataaattttaggaactataccacatgtagataatgttatatgtctctgaccaatatttaatccataatctgcagaaactatttctaagaattttacaacattatcataattatctaatggctcgccactacccattaaaactatattagatattctttcaccaatatagttttgtacagcaattacttctgataatatttctccagtagttaagttccttacacgcccttctattgtagatgcacagaatttacatcccattctacatcccacttgagttgatatacatattgaatttccatgcttatatctcataagtacactttcaattaaattgccatcagaaaatcctaataaaaacttttctgtaccatctaattcagacttatatacttcaactatttctggcatagtgattgtaaagttttcttctaatttattaattaaggatttgggtatgtttttcatacccttaaaatccattacccctttgtaaatccacgataatatttgttttcccctaaatgcactttcaccattttcgctcatccatactttaagttcatctaaagtataatccagtaaattgttcatttattcacctactattatcttttttctaattttgcaataaagaaaccatccatattttcatttggcattactgttaaaagtccttctctgctgtatacaagattatcttgctttccaacaaatattctcttaacttcacaatcttcatgattgtttaaaaaccattcaatattttcttcattttcttctttatttaatgtacaagttgagtaaatcatcactcctccttgttttaaatattgccatgcattattcattatttctctttgaacaggtattatctctcttaagtcatttctttttttattccattttatttctggtttctttcttattattccaagtcctgaacaaggaacatctataagtactctatcagtacttgcaactaattcagcatttaatttagttgcatcttgtgcaaaagttgtaacatttgttattcctagtctttcacagttttcttttattaaccctaatttagattcatgaaggtcaaaagcgagtacctttcctgtattacctaatatttcagctatatgtgtagtcttacctcctggtgcactacataaatctacaactgtcattccttctttaagatcaagaagtggtgcaacaagcatagcgctttcatcctgtacagttatcttaccttctttaaataatggattattttctattgattttccacctttaatatttatagcctcaggacatattacgccttcagatatttcatattccatttcttcaagcttttcataaacttcatcataatcagagttaagttcatttactcttatacttaccttaggaatagtatttaatcctgacattatttttttagcaacattttcaccatattgtttaattaaaagtcttatcatccaaggttcaaatgaaaacttatatgcatattcgtctatcttattaccaggtacgttaatatcatctggatttttagtaaaacttctaagtattccattaacaagtttactatcattttcagatatttctttagcttcttctactgcttcattgcatgctgcataagtaggaatcttatctaagaaattcatttgatatattgcaactcttaatatattaagaatatttttatccattaacttaatatccttaacaaaatttgcaattattacatctaatgttctctttcttcttaaaacaccataaacaatttctgtaagtaatgctttgtccttatcatttaattctacttcatttaattcttttgaaaggattatatttgaatatgctccttcatttaaaactctgtttaatatttttactgctagttttctacaattcatacgctacctctttttcaattatatatctaattatgaaatttcataattcacagcctataaataattagctgcattttataagactttaatattacataaataagttttaccatatctttcttaaaagattacaatttaatcaaataatgtgtaggatatctctaaactctaactatgtacattaatttatatttaactattaaaagttatcctaaaattatattttcttcaatttcatgaccattaatatattcagctatagttaatggtttcttgtttggaaactgtaccttttttataagaagcacagaatctttgcatgcaactttcataccttctttagttacttcaattatagttcctggacattttgaagtcttgtcgtcaatcacttcactttcaaatattttcattctttcatttttataatcagtataagcgattggccatggatttaatcctctaataagattatgtatttcttttgcagtcttatcccatgaaataactgctatatttttatcaagcatttttgcataaaaagtttcatcattctgcttttgtggaacaattgtattatttatgacaccatctattgtctgtaaaagaagatcacttcccctttcctttaatatgtcataaagctcacctgctgtcatatcatctggaatttcaacttcatctttcataagcatatctccagtatctaaacctacatccataagcatcgttgtatttccagaaactttttcaccttttataactgcccattgtattggtgcagcacctctatacataggaagcagagatccatgaaggttaatacagccatatttaggtatatctaaaacttcttttgtaaggagttgcccaaatgcaactacaatcatgaagtctggctttatatcctttaatttttctataagttccctatcttctttcagctttacaggctgatatattggtatatcatgctttaatccttcttctttaacagcagagtaagccattttctttcctcttccttttggcttatctggctgagttaatatagccgttacattatgtttttctattaatctttttaacgacggaactgcaaagtcaggagtacccataaatactatattcattgtttatcctcctaattttaatatttaatttattataaattttatgactttttttaatcataaatattaatacatatgttcaactacgaattttataagtatatttagaaatcacatagtgatttcaagattaatttctcacaggaagtacccataaggagtatccctttttaaatgtaaattgcaatatttatacttattatttatttactctatctatgaataaagttccatttaaatgatcatactcatgtaaaatagctcttgctaaaagttcttctgcttcaatttcgaattcttgacccttttcatttaaagctcttgctctaacgtagttaggtctcattacttcttccatttttcctggaagacttaaacatccttcttcatcaatttgctttccacttgtttcaattatttcagggtttataaacactaatggtccatctccaatgtcaattacaaataatctctttagtattccaacttgtggtgctgcaagacctacaccatcagcatcatacattgtttcaagcatatcttttataagtactaataatcttttatctatttcttcaacttctctacattcttttcttaatacgtcatcaccatattttcttatatttcttaatgccatttctaattccccctacgtcatattattaggattaatatctatactaacccttatttcattatatacactcttatttaattgataaagagtatctttaactttttcactaaactcatcattaaattttccttttattatgatctgccatctataattttcctttaatttagttattatacatggaaccggtcctaatatagttaaatcttctattattagttttttcaatttttcttgtaaattattcatgaatttctttaatttttcttcatattttgatgacccattaatcaataatattttaccaaaaggcggatttcccatcaaccttcttaattttatttcttctttgaacaattcttcataattttcttcttttgcataattaagactgtaatgatttggagtgtagctctgtactatcacttcaccttcatcattgcctcttccagctcttcctgcaacctgagttattatctgataagttctttctgccgatctgtaatctggtatatttagtgacatatcagctgcaagaacgccaacaagagtaacatttttaaaatcaagtccttttgaaaccatttgagttccaaccaaaatatcagcttcaccatttttaaatgaattatatattgattcatgggaatttttatgtcttgtagtatcaacatccattcttaaaaccctagctttaggaaaatattttttaacctcaagttcaactctctctgttcctgctccaaaaaacttcacataacgacttccacactcaggacatattttactaaccttttctgcccttccacaataatgacatataagataaccattattatgatatgtcattgaaacatcacattctgggcatttaaacacataaccacaacttctacatgaaataaatgttgaatatcctcttctattcaagaataaaattatctgtttctttctattcaaagtttcatctatagcattataaagcttcccactgaataaagataaatttcttcttttcaattcctctctcatatctacaatttccatatgtggcattgctcttccattaactcgacttttcatttctatgagcttatattctcctgaaagagctttataataagtttcaatacttggagtcgcagatccaagtacaagtttgcatctcttaagcttacacatatattcacttacttcacgtgtatgatacttaggattttgatctgacttataagtattttcatgctcttcatctattattataagtccaagattatctaacggaagaaacaatgcacttcgtgcgcctattacaagtctagccttcccgtctctaatcctgtaccattcgtcaaatctttctccatcagaaagcctgctatgaaacaatgcaacatctccaccgaaacgtcctttaaatctttctatcatttgtggtgtaagagaaatttcaggcactaatacaacagcactcttaccttcatttaaagtttctgatacaagattcatataaacttcagtcttcccagaccctgtgacacctttaataagatattttaattcacttccatttaaaatagtatcaaggcactgttcttgttcttgtgtaagttctttcttaacatcttcatcatactttctcttattatatctaaaaatcactttatcttctactttaaaaattccatcactaatcattttattcaaagtatataaagagtactgtttatctcttgttatatcagccttagtatatataccatcgttttctaatatataattatatagttttttatagttttccttgagttcttctgttatttttagctcatcattgatacatataactgccttttttttatttgttgatcccttcattataccaacaggtatcataagtcttatagcatcaatatatctacataaatatcttcttcttaaaaaatctactagtttaagattatctattgtaagtattggttcttcatcacatatttttaatatattctttactctataattaatttcaatatcatcaactataagagtataaacaaaaccctctacttttttatttccctttccaaaggatactataaccctatgtccagcactaatagtatataaaaactcttcaggcaccttatatgtaaaaagcctatcaacttccaaagcatcgctgtttattattatttcagcatacatacctatatcatgccccttttctgagactaatttgttaattgataattcactaagcattaattagtatattacaataaagaaagaagcgcaatctagcgcttcttaattattatgtcaaataaattttctgcaatcttttctttactcattttttctagatgaatttcttcatcgtcctttgaaaaaatgattactctgttatcttcacttgcaaagccagtatctttagatgttatatcattagcaacaatataatcaagatttttctttttcatttttatcattgcattttcttttaaattctgactttcagctgcaaaaccaacaagaatctgattttcttttagactgccaagttccattaaaatatcattatcccttgtaagttctaaagaccagtttccatgacctttttttattttatgttcactataagattcaggcttataatcagcaacagctgctgattttattactatgtcagcttctttaaaaactttcatagctgcctctttcatttcttcattagtacatatattaataacattaatatttctaggaacatctaaattagtagggccacttatcaatgttacatctgcgcctctatttctagcttcctttgctattgcatatcccattttcccactagatctatttgtaataaatcttactggatcaataggtgctattgttggacctgctgtaaccacaactttcttgtttaacaaatctttattttcattcaattccattaaaactctgtctacaataacttctggactttcaagttttccttttccaacatctccacatgcaagccttccctctgctggttcaataaattcataaccaagcaatttaagcttttttatattttgttgaacaattggattttcatacatatttgtattcatagctggagcaaaaataaccttagctttagttgccataatagtagtcgataacatatcatctgctattccacttgcaactttacctataatatttgctgtagcaggtgctactaaaaacacatccgctttatcagctaaacttatatgctgaatttcccacaccttaggttcttgaaatgtatcacatgcaacttcattctgacttaatgactgaaaagaaagtggagcaacaaacttagtggcattttctgtcataataacattaacattaatgttcttttttacaagaagacttgtaatttccaatgccttataagcagctattcctccgcttaccccaagtacaacattttttttcatcttactttgaaccttcttcattcactatttcaaaattaatagcatcttcatcaacttcatgtatagcaattgttaatggcttttttgagtgtgcgtccacttgtggtttagagccatctattatttgtctagctcttttagatgttaaaattactaacgaatatctgtcctttgttttttctagtaaatctactactgatggattaatcatagagttgttcatgaataatgccctcctttgaatctaatatactatgttttattctatctactctacacttttcagcacaaacaatggcttcaagtttatctactgctgtttcaacttcatcatttacaacagcataattatatcttgatataaagttaatttctttatatgctgacttaaatctcttcattaaagactctggagtttcacttcctctttttattattctagcctttaattcttccattgaaggaggtaatatgaaaataaatactccttcttctgtattttccttaacctttaatgcaccttgtatatcaatctctaatataacatctttgccactttctagcaattgttcaacattagatttaggtgttccataaaaattatcatatacttctgcatattctaagaaatcattagcttcaattttttccttaaactgctcttttgacatgaaatagtaatttataccgtcaacttctccatttcttggagatcttgtagttgcagatactgatattgccacttcagaatttctttctaagaagcttttgcatatagtaccttttccagcacctgacggtccagaaataactattaatagtcctcttcctttatcattcattattcatcatcctcatcaactatatcatctttagttgctaatctatgtgcaactgtttcaggttgaaccgctgataaaataacatgatcactatcagttattataacagctcttgttcttcttccataagtagcatctattaacattcctctgtctcttgcttcttgaataattcttttaataggtgctgactctgggctgacaattgcaactaatctgtttgcagaaacaatgtttccaaaacctatgtttattaacttaattcccatcttttatcctcctatttattcaatgttctggatttgttctcttattttttccaaggtattcttgatttctataactatattagtcatatttatatcacttgatttggatgctattgtgttagcttctctgttcatttcttgaattataaagtcaagttttcttccaataggttcatctagacacaatgtgtttcttatctgacttagatggctctttagtcttgttatttcttcatcgactgcagccttatctgaaaaaattgcaacttcaagtgctattctgctttcatctacatctacacctgataataactcatttaatctttcttcaagttttttcttgtaatttttaggaacaacatctgctaaaacttcaattttctttacatcactctctatattttcaagcttaactaagatatcctcttttaatttcgtaccttctcttactctcatttcttccataagattaagtgaacactccactaatggagcaatttcattaaatatctcttcaagattttcttcatgttcttctattgtaataacgtcaggaaatcttgcaatcttagttactgatatatcattaaccacatcaagattatttgcaatttcttttaaacaattataataatctttagcaagttctatatttaaaactgcttttccagaggagttcgaataatttttataattaataaatacatcaactttacctctgtttaatcttttactaattatatttcttattttttcttccaatgaaagcatagtttttggcatcctgatatttatatctaaatatctatgattaacacttttcatttctattgaaaaacataaatcttttccttcttcactttgtgctcgaccaaagctagtcatgcttttaatcaaaccatccacctccttattcattattactatattactatttctattgctaaattaataataatcaatttttttttcaccgtcaacattttgttcacaaattgttaacatttattttttgtaaattcatttagagatttcactcttaattataacttctaaatttcaaaagtttaattctctaaatccataaaaaatcactatattcaataaatataattttttataaacaataaaggagctactgactagcaataactcctttggaattcctattttttattttaaaaagaataacttacatataaatacaattgctagtacaatcataacaattgaaactttctttttctctcctgattttgcaaagaatatattatataaaacatttattaacacatacgctattactcctattgttaagccatcacctatactgtatgcaagaggcatcatagcaattgtcataaatgctggaagaccttctgttatttctccaaaatctatatttttaactgcaccaagcattaaatatccaacatatataagtgctggagccgttgcacatgatggtattgctatgaagattggtgaaaagaacattgcaattaagaataaaactcccgatgttatagctgtccatccagttcttcctccagctgctacacctgttgaactttcaacataagttgttacagtggatacaccaagacacgctcccacagtagtaccaacagcatcaaccatcaatgctttaccaacattcggaacatttccattttcatctaacattccagctcttgaacttacacctactaatgttccaactgtatcaaaaaagtctacaaacaaaaatgtacaaactactactatgaagttcataatattacttggatgaagtacataagccaaatctactttacctgcaattggcgcaatactttcaaatttaaaaataccatttggaagataaataccaagagctgttgcagcttctgggttcatcattgcatatccccatgacaataatgtactaacaactataccaactaatatagatgctttcattccttttctatctaaaacagctataattatcaaacctacaaaagcgattaacactgttggagacgcaaaattaccaagtgcaagataagtagcatcatctgctataacaaatccacttcctgtcaacccaataaatgctataaataaaccaatacctgctgttactgcatgtttcatatttattggaattgcatttacaactgcttctcttactttaaaaagtgataatagtataaatataataccttcaacaaatactgctgttaacgctacttcccacgatatacctttaccaagaactactgaatatgcaaaataagcattaagtcccatacctgaagctaacacaaatggtaaattagcataaacacccatgagtatacttgcaaaagctgcagctagacaagttgctgtaactaatgcccccttatccattcctattccttctgtacctagtatgttaggatttacagctattatataagccattgttaagaacgttgttatcccagctataatttcctttttaaaatcaacattttcattagaaaatatctctaggaattttttcttttcatttacttgttgcatcttactacctccgaaaaattaactgaatagaatatagtgactttattatcacttttattcttttttcttttaacttctgaattttctcatagtcagatatgttacggtatctggtagaaactcgtggaccttattaccactattatatgagttcactcattcacgaatgttattatatattttttatcgaacgttgtcaatatttattcgttctttttacgtttatatgcgaatattatttctcattttttatttttctttcctatttatttaattttaagtacaataaaggcatatatcataattaatatacgcctttatcacttctataatcaaaactttttatactttttcacaaaaattgttcatattaaataatctttaagatttatcgtatgattccactgatgaagtttatagaatattcgattcaaaaatagactttatcttactcatatcattactataatttagtgcaactataagttttattctagctttttgacttgcaaatacatctccaaaaatacatccaatttccttaagttcttttccaccaccttcgtaaccatatgattcaaaaacccttccctcaaagcatcttgaaactattacaacaggtatatccttagctatagcatgctttattccatcaaccatggttggaggaacattccctcttcccagtgcttcgattacaatacctttataaccttgatctattgaaaaatcaataaatttagaatcacttcctgcactacattttattattgcaacatctttatccgtattctgaattttcatatgaatagattcaggattatttctataaaatataaccttattattatcaactatacctattggtccaaaatttggtgtactgaacgcattcaacgccattgaatttctttttgtaacttcgcatgcactatgaagttcaccattaaaacaaactaaaactcctctatttcttgcatcatcagatatagctgtacatattgatgaagcaagattaaaaggaccatcataccccagctcagagctacttctcattgctcctgtaataattacaggcttttgactttttaatgtaagatctaaaaaataggcactttcttcaagggtatctgttccatgagttacaactactcctgtaatatcgtctctatttaaaagttcctgaacctgattagataaatcaagcataagttttggtgtcatatacggtgatggaaggctcgaaaaattataactttctatttctgcatattcttcaattccagttaccattgccataatgtcttctccactaagacttggcactgctgcttttattctatcatcaactttcatggatatagttccaccattaaatacaactgctacttttttcatactatccctccaaaatatcttttgtattatttactaacatatttaaatttaatatcataatcatattattatctataatatgcataaaaaaactcttagatgtaatctaagagtttaaacgtatttcttttttggcaggtcggcgtatcctgcatctctgattactaaacaatagcgcgtgaggagccttttctcacctcaaaaaattaattacaacaattaatatattacaatatattttcttttatttcaatatcctctatttttataagccttcctctatagattctggcatttagcttagataatgttaaaggatacattgttgcaacataaatatattcgccttccatgtcaatttccaatcctaaaagaattattatattatcaacttttttaactaattctatagattgaacattccttcgttcatattctgcacctacataatcgggtctttaattattctctcaactatatctattatattatccttaactttcttcgtaaattgctttccatgtctcttttttatatggtttataacacctggagaggcataaacagtttttggtacgctgagttccaagttctcacttacagattcttttattttaccaactttcttataagctttataatcttttctcataatacccctcatttacatcctttcttttattatatcccaacaaagtgtttttttccacttatgtaataaaaagattgtaattaaggataaacaataatttaaatttaaaatatgaaaataagctaatataaataaatattagcttatttttatatctacttatatgtgttaatgcttttatttaaattgtttttactttttataagattatgcaaatcaaaccgccatttccttcattaataatcttttgaagggttttttgaatcttaacttgtacatcttcaggcattttatataatttattttgaagaccttccttcacaagaacttctaaagatttcccaaacatattactctgccataacaattctgggtcagtttcaaactgttcaagtagtccctttacaagttcttcagattctttttcagatcccattataggacttatttctgtttttacatcacatttaataagatgaagactaggcgcacttgcttttaacttaacaccaaatttacttccttgattaacaagttcaggcttttcaaatttcatttcagaaagctgaggtgcaacaagtccataaccagtttcctttacttcttctaaagcatcttttactttatcatattcacattttgcatgagttagatcttttattattcccaaaagatcactttcagaattaacttccaaatcacatatttcacttaagactttataaaaaattccgtctttaggtttcataagtactttagccataccattacctaaatccacctcttttatagttgctgttcccataaaatcttcatcttcaaaatcattaagacaatattttatatcccttattttcgaaacatcctgacacatgtccataattatgttgaaaaaatctttctttaaccagtgaccagcttctaatttttcaagccattcaggcatatcaatatttatttcttttattgggaattcttttagtactgatttaaataattcagctatatcatcttctcccatattataaacatccattacctgcactgtaacattatatttattctcaagttctgactttaaattttttgtttcttgagaatttggcttaattgtattaagtacaactataaaaggcttatttaatgattttagttcagaaactactctttcctcagcttctaagtaatcatctctgtctattccagtaatgcttccatctgtggtaataacaagaccaatagtagaatgatcattaattacttttcgtgtacctatttcagctgcatcttcaaatggtatctcataatcataccatggagtatgaaccattttactttcttctccatccatatatcccaatgcaccttttactatatatcctacacaatccaccattcgtactttaaatttaatttcatcatctaatgttatttctaccgcttcattcggaacaaatttaggttctgttgtatgaatactttttcctgatccactttgtggtaattcatccttagccctctcttttttataagtattatcaatctttggtattaccatcaagtccatgaacttctttatgaaggtagattttcctgttctaacaggaccaacaacacccacatatatgtccccttgcgttctatcagctatatctttgtatatgttaaaattctccacatgattccctcccatattctttttaccaatatatatatattcctcaatattggaaaatatacacaaagatatagttatttatattttgctaattcaattattttctaactattaataaactccatctatactcctataatctattctcctcatccaaagtatataatatatatataaataaaaatctcgaaatattcaaatcatcattttctaaatgatagattttaaatattccgagattttgtagtttttattaactaaaataattcactttttttatctcttatcataagattatctattatatctttaggatgctcattttcaaataaacctttatatagtccatctgttataggcattgaaattcccattcgttctttcaactgatagaatgctctgcacgcctttacaccttcaactaccataccaatttcctctaatgcttcatttaaagattttccttgtcctattaaaagaccagctcttctgtttcttgaatgcattgaagtacatgttacgataaggtcacccatcccagtgagtccataaaaagtttctgcttttcctcctaatgctattcctattctgcttatttccttcattcctcttgtcataagagcagcttttgtattatcaccataaccaagtccatctaaaatccctgctgccagcgctattatattcttaacagcgcctcctacttcaactccaattatatcatcattagtataaattctaagattaggagtcataaacaaatcttgaacttcaaatgcatatttcatatcatctgaagtacttacaagagttgttggaagtttcatagcaatttcttcagcatgactcggacctgatagtattactacaggattgtttaattcttctttaatcactaccgataatcttttatcactatcttcctcaatcccttttgcaatagaaataataggaatattttgtggaattatatcttttatagatctacacatacttcttattacatgagaaggtacagataacacaatataatcttcaccttcaacggcttcttttattttatcaaagcctgtaacattctctggaatctttatatttttcatatacttttcattcgttcttttaatattaatttcatcaacaacacatttatctctgttgtatatattaacaatattatctttttccgcaagtaacacagcaagcgctgtaccaaaacttcctccacctagaaaagtaattctactcatataattattcctttctttgtctatattctatttgtataccagttcctttaaagtcaaagctatctcttaactgattttcaatatatctttcatatgaaaaatgtcttgcttctgaatcattaacaaagaatacaaactttggtggtcttgtagcaacctgagtagcatagtaaattttcattctcttaagacctacaactggtggttctttcataagaactgctttacttattacatcattaagaattcctgttgaaactctcttattatagttatcataacactttctagccatttgtagaaccttatgagttctttgtcctgttaatgctgatataaataaatattctgcatagtttataaactttaatttaccttgtaaatctcttttaaaattatctaaagttttatcatctttttcaacaagatcccatttattaacgataatcataatagcttttctcatttcatgagcataacctattatcttttcatcttgttctgttataccttcttgagcatctatcattaatatacatacatctgatctttcaatagcagcataagttcttacaacactgtatctttctatttcttcttttactttactctttcttctaagaccagcggtatctattaatataaactttccttcttctgtttcaagttcactatcaatagcatctctagtagtacctgcaacttctgaaactataactctgtcttcgcctaaaagtttgttaattaaagatgactttcctacatttggtttaccaatcatagcaattcttatgtattcatcttcatcttgctcatatatagagctatcaaaattctcaactactctatcaagcatatctccaagacctaaaccttgtgatgctgatattgttataggatcacctatacctaaattataaaattcccatgcattatcttcttcttttaatgaatctactttattaactactaaaactacaggctttttgctttttctaagcattgttgcaacttcatgatctgcagctgttaagccttctttaccatcaacgataaatacaataacgtctgctgtttctattgctatatttgcctgtcttctcatttgttgtactatgatatcatttctttctggctcaataccaccagtatcaatcattgtaaatgtatgagtaagccattctgcttctgcataaactctatctcttgtaactccaggtgtatcctgaactatagatattctctttcctgctaatctattaaataatgtggatttcccaacattaggtcttccaaccatagcaactatcggttttgccattatttttcctcctctttatattcattaatcttttgaatcaaatcttcacctgtaaaatcaactactataaccttcacatctaaagcttcttcaatgtctttaatcttagtatcatcaagcattatctgttctgtagaatctgaaagttcatatccttttctgaacatgttattagacattattaaatacttacttttaataacccctttcatctgctctattatatcagtaccagtcaaaagacctgctatagtaattgttttgccaaagtaactattaattatagcatatacatctaattgtatgttaggatttttttctttaatcttttttgctccttcacatatttctggatatgctaaagttcctgtaactatagaaaaacttccattcatatttacatctaactcttcaatagtatcatctattgcatccctgaaacatctcaccataccaacaccatcttcaatttgatgataattgtcataaaaatctgcatctggaatagttttttctcctaccaaataaaattcatctgatagtcttacaaatgggctgcctgtttcctttaaatattgtttttgaagtttttcaacattctcaatctcacgcgctgactcttcttttgtatatgttctcacatgagcaagtttttctctatattttgttatacctatcggaactactgctacactgttaacttgtggataaagggaatacaagtcttcaatagtatttataagttcctctccattattaatatcaggtattgaaaccacctgtgcattcatttcaattcctgcatctgcaagtcttttcattctttcaagtatatttcctgcaaacctattattgagcattttaattctcaactcaggatttgttgtatgtacagaaacatttataggacttatatgataattaattattctatctatgtcttcttctttcatatttgttaatgtaacaaaatttccctgaagaaaagataaccttgaatcatcatctttaaagtataagctttctctcataccttttggaagctgatctataaaacaaaatatacatttattactgcatctttttgctttatcaattaatcctccaccaaattcaattcctaattcttcaccataatctttttctatttcgatttcccaaacttctttactatcagctttttctatttcaattataagctcttcatcatctgaaagaaatttgtaatctattatatcctttacttctttaccattaatagaaataagtatatcatttttttcaatgccaacttcttcagcaatacttccaggagttatttcttttataatacttctcactatcttcactcctcaattataacatactgtctttgttatattaccttatcaaatcatttaagtcaataaaaatgccaccatgttaaattacttcctttattatatattaattatcttaaataaattttatatttagctatatgttttatattttttccaaaatttcaacttacattcaaaaacaaaatctctacgttaaatatgtaacatagagatttaaattaattataattagacatattgttttactgtttctcgttgaagatttattgcaataagttgtgaattttccatactttctctcataaatctttcttgactatttacttcttcatcagttattgtctttcttatatattcaccattacaatttaactcacgtgcttttacattatcctttaacataatatcaatcatgttgtttattctattttttatttttttatctaatataggacatgcaacttcaaccctattctcagtatttcttgtcataaaatcagctgatgaaatatatagtttttgaaattcgccttctccaaagctatatactcttgaatgttctaaaaatcgtccaacaatacttgtaacttttatattttctgtataaccttccaatcctggaataagacaacatattcctcttataattaaatctattttcacaccagcacaagatgcttttgataattcttttataatatcaatatccgttaaagaatttaattttattataattcttccattttcctttttttcagcttctgctttaattaatgcaataatcttattttttaattcaaatggagcaactaataaaaaattataagaaccatttaaattagcaatggccatatttttaaagaagttcgctgcatctatccctatcattttatttgatgttattaatgataaatcagtataaagttctgctgttttttcattgaaattaccagtacttatatgtgttaaatatgtaatattttctttttcacgttttgttacaagacaaactttagaatgtaccttaaatccttcaaatccataaattattcggcatccagcttcttcaagtctttctgaccagtctatattattttgttcgtcaaatcttgctcttaactcaataagcacagtaacatcttttccattttcagccgcttcacaaagatattctactaatctagctttctttgcaagtctatatatacatatttttattgatacaactgatggatcaaatgctgcctcttttaccatattcaaaaacggatgcatactttcaaagggatatgacatcataatatctttattctctacatgttttgtaacattgtcatctattaataattgatttgatttttgcggtgaaaaacttggataacttaaattcatttttaaagaaagtgatattttactctttatcaagtgtatatatcccattttcattggtgactttgtgcaaaatatttgctttttagttatttttaatttttcacaaaagaattcttcagattttttgctaagaggttgtcctacttccaatcttactactgataacttttgacgtcttgataagatttttttcatcatgtatctaaaatcttcattgatatcaaaagcttcatcatctgctgtaatatctgcatttcttgttacacagatataatttttttcaataacattgtacatatcaaaaacttcatctgcatattctaaaattatcttctctatattaatatacttgatatcactgtcaggcatgaaaattatttgtggtaatgtagttggaactggtattatcccaaatactgattttcctttactttttaaaattgttactatatgaacaactttattagataaatgaggaaatgggtgatgtgtatctataatttgtggtgataatattggtagtatttgttgtctgaaatacctcttaacataattcttctcaatactgttaagttcgtttatcataagtgattctataccatatactcttaaattattttttatttcagcatatatttcgtcttttttcttatataatggcttaacagcctcataaattttattaagctgttctccaggtgtcattcctgatttattatcaattgtatctttatctacaatagacaaatcaaataaactgcctacccttatcataaagaactcgtctaaattatcattaaatattgatgtgaataataatctttctaataatggtacacttttatcagatgcttcatctaaaacacgctcattaaatttaagccatgacagctctctattttgagtatacttacattgttttttttcattattcaactctcgttactccttctacgtctatttacttcatataattatttatcatcatcagatatatcaattatatcaatcttaaaattgcactcttcagttttgatttgttccgattcctctgtaatttttaatgattctttattttcatcaaatttatctatcattaaacaagaatcaactttgttgttatcttcattttctttattaacatatataatattcttattattaatcactttatctataagatatccttctcttataccatactcacacaaccttactattttacaattatagaacttcataattgtttttaatattatcattcccgttggcacagtgtgtattctatctggtacaacttctagtatttctgaaactgctatattaggtttttccataaaaatatctattaatttttttatattttttctagatatttctttattatcactttttatttcaaagaaatctctatttattttagaagcacctctaatacttccaccaattccatagatttcagaataactatttctatctaaatctattttttccaattcatctataatacgtttttttatttttttattttgttcctttgtaggtataagcttgtcaacatacttttgatacatattaagagatcctattggaagagaaacaattttttcgatttttttatccataacaaaaattatttctgtgctccctccaccaatatctaatataattccattatttacatttgtcttatatgtagcacctataaaatcataaaagccttcttcttcaccagaaataacatttatctttaaatttgttttgttctctatttcatttacaacttcttctgtattatgtatatttctcaatgacgctgtagcaaacacaaaaagattttctaaacctattcgttcaattatttcattgtattcatttaaagtatttatagctttctctacacctttttcaattaaaattccattatcatctatataacttgcaagtcctactactcgtttcttatttaacattggtttaatcttatcatcttctacttcatataatgataatctaatagtgtttgatcctatatcaattacgccaaacatttttctcccctttgtacagcacatatttatttagtttcaataaatatccctaatatatttaatactagataaactaatctaaaaccacatttaaattaattcatctagtatatattaattttcctaattattatctactcatttaaatctacataattaccttctttagagaaaatagtccattcacaaatattagtaacatggtccgctactctttcaagatactttattataaatagtaattgagctccatcattaaccaaatcttctttttccttgataatttttattgtactttcaaataatgacttacataatttatctactttatcgtcttcttcacatattttatatgctaaatcagaatcattttttatatatacatcagtagaagctttaatcatagatcttactttttggtccatatcccacagttcatctaaacttccattgaagagacttaaatttcttccaattttcttagtcaatttgcagatatcaactgcatgatctgccattctttctaaatcagttactatcttagatgctgcaaaaactcttcgtaagtcagacgcaagaggttgctcagttgctataaacttaacacactcatcctctatttttttttgcatattatctacagcatcatcatttttgataactacttcgattttatctaaatcataattttttaaacataacatactttcatataactgcttttcaacaagacttgacatagcaattaaatctttctgaatgtttttcactctcatattttgtaattctctactcatttatacttcctccacttatttttagccgaatcttcctgtaatataatcttctgttctcttatcctttggattatagaatatatcttcagttttaccgaattcaataacttcaccatttaagaaaaatgctgttttatctgctattcttcctgcttgttgcatattgtgagtaactattattacagtatactttttcttaagttcatccataagttcttccatctttgatgtagaaatcggatcaagagcagaagtaggctcatccattaatataacttcaggtgaaacggcaagtgttcttgctatacataatctttgttgttgaccacctgacattccaagagcactttcttttaatctatcttttgtttcatcccaaagcgctgctccttttaaactcttttctactatttcatctaattgttttttatttgtgataccatgtattttaggaccatatgctatattattgtaaatagacattggaaacggattaggtctttggaataccataccaattctttttcttaaatgaatttcatcataatctttatatatgtcttttccttcaaaaagtacttccccatctatcttaacaatatcaataaggtcattcattctattaatagttcttaaaaatgtagacttaccacatccagatggtccaataagtgctgtaacttcattcttatttatgctaatatttatattttttagagcttgtttttctccataatataaatttaaatttctagtttcaataatgctcataatttcctcctatttaccgctataagctttcatcaatttatttcctgctaattttgcaataatattgaataataaaactgctattataagtactgctgctgtaccatttgctatttgtgatgcatctggaactaccccttctgaattaagtttccatatatgaacagctaaagtttcagctggtctaaatagagagaaagcagatttgtttccagtcaaacttatctctgtaaaatttaatgcctttgaacttaatcctgctgtataaaggaaagctgctgcttcaccaaatattcttcctgctgcaagtaatattcctgttataatttcactcatagctgttggaagtgtaagttttactatagtttgccatttagttgcacctaaacctaaagatgcttctttcactcttttgcttgctgattttatagcatcttctgatattcttgtcatagaaggtatatttaatatacttactgataacgctcctgcaagtattgaatatccccatcctgccatattaacaaaaactaataaaccaaacatacctataactatagaaggtaatgatgacattgtttcaagacaaattctaataaaattaacaataggtccttgttttgcatattcagctaaatatattcctgcaccaatacctattggtatagttattaaaagtgatattataagcatataaaatgagttaaacaactgtggaccaattcctccacctgctcctgatattttaggctttccaaacaagaaagatggttttaacatacttccacccttatataaaatataagcaataaatgctccaagcaaagttactataaatatacttattgcatagaaaacaatagttgcaattttatccgctctttttgaattcattatttgctgcacctcttcccaataaatctaactaataatatgaatccgaatgatataatcaatagaattaatgctaatgaccacaatgcattattccacattgttccaccaactgtatttgccatgtccattgttattacactcgttaatgtcgacattgaagaaagaatgccatcaggtattttcactgtatttcctattaccatctgaactgctaatgcttctccaaatgctcttgctatcccaagaacaatccctgtaagtattccagatttagctcctggaactataaccttataaatagtctgccatcttgttgctcctaggccataagaggcttcaatatgatcttgtggaatagtttttatagcatctatacataaagttgcaatagtaggtaataccattaatgaaagaactaaaatccctgaaagtaatgaataccccataccaccaaaattattttttatgaatggaaccaatactgaaataccaacccatccataaacaactgatggtataccaactaaaatttcaagacaaggttttataactttgctaccaaatccttttgatattacatttgtaaatatagcaaggcttactgctataggtgcacttaatactattgcccctactgatactaaggttgaaccagcaatgaaagctaaagctccaaaggaaggctcttcctgacttggctgccagttatccttaaataagaactgcgttatactatacccatcttccgtaaatatttttattcccttagatgcaatgaatataataattgatattgtaattaaaattattaacattccacaaattcctgcaaatccctggcctatatattcatttttcagcctctccttaaaacttcttttttccatttctactcatccttaatacaaatttatttttatttatgcttactaattataataagaaaatataagtgctttttaaaaagcacttatatctcagtttctaattaagttttactatactatttaactttcatttcattacctgaaatgaaacctaagttttctaaactttctttattgtcactgcttgatacatattctataaatgcttttgatgcttcatctgcttcacccttagtgtacatgtgtccccatgaccagaaaggatatgatccatcacatatgtttgctttttcatcgctctttccatcaatctttacagatgttaaagcttcttttgcttcgtctgtattcatgtaagcaagacctaagtaactaatagcaccttcattttgcttcatagctgttaaaactgcaccatttgaatcttgcattactccaattgagtcattttctaaactcttatcaccatctaagattttttcttcaaaagtagctcttgttcctgacccactctttctgtgaactacaaagatttctttatctggacctgcagttccatcttccttagttatttgattccagtttgttacttttcctgagaatatatctttaatttgatcttttgttaaattatctattcctaatgatttgcttactactactgcaaatccttgagctactactttatggtcaactaattgtttcgcttgatctgcttctaatttatcttcagcaaatatatctgagtttcctatattaactgttccatctaatacttgagtaagacctgttccagatccacctgcttgtgcgctaatttccacatctggatacttttcattaaatttttctattgattgttccattaatggtaataatgccgaagatccactaattgttattgatccacttacgctttgttctttagttgtatcagcacttttatctgctcctgtatcattgttgctgcttccgcatccaatcattcctaccccatcattgtaattaaaagagcacttgctaataattttaaagactttcttttcatcttagttcccctgatcaaaataattttgaattcatttaccttacatgttctataataaacgctttaagttaaagaattattagagatatgttaagttgtattggaactatgttaaaaatatttaacatatgcattttttataaaactttattttacaaatttataagtacttataatatttattcaagaatagtatgtgctgttttcttctttattaatcacctaaatttaatattacatgccttatattaaattttctcatctttacaaattagatttgtttttataatatctactaatataaatttaacatttcttcatcattcattatggatacaaatccaaattggctcacaacagtctatttttaataaaatttttacattagatatactattactattaatacaaatcccatatgtttcttaaaatattctttcacttattatgtagaataaaaaaagcagaaaataaactttctgctttaaaatacataatcacttttacatatatggaattttaacttcaaatgtagttccttcacctagtttgctcttaacattaatttcaccattaaatattttaacaatatgtttgacaatagctaaacctaatccggtgccgccttttttcctagatttatcaactctataaaatctttcgaaaatacgcgatatatcttcaccaggtatccctatgccattatcttgtattttaagatgataatatccgccatcattatgactagatattttaacataaccttctttttctttggagtatttaactgcattctcgattaaattcagcacaagctgataaaacttgtctctatctcctaatatacattcactactattatcttcaaattcaacagacacatttctatttctagcagtttttcttacaatatttaaagtttcttcaataactatccccggcctgaactcttctacatctgcaacaagattactttcaatattagataatactaatatatcatttataagccgtgtaagtctttctgcctctttgtctattatatctaaaaatttctctctagtagcactatcatcaacaattcttaaagtttcagcaaatcctttaatagaagttaatggagtttttaactcatgagatacatttgcaacaaattgacttctcattagttcaactctcttcatatccgttatatcctgaaaacttattacttttccaagattaatttttttatctatcatttcagatttttttattttaatgtttctttcaataggatgaagtattgttatttctttatcttcctcttctgagtccattaaaaatccatttatttcatgatctgaaacataatctgttaatttttccccaacaatacttttcttaattccaagaagaagctctgctgctggattaatggaaatcacattattttcattatcaactgcaactacaccactatccatgctattaaatatggattctaattttgtttggttatttacaacttcctgaatttttaactgaagttcatctgccatatgattaaaactatcacccaaaattcctagttcatcattactatttactttagctcttattttataatcaccattagccatttttaatgttacactttcaagctcttttacaggttcaacaatttttcttactaaccttaaagataaaaatatagaaaaaatcacagtaacaaatactagtggtatatagtattttattctttcacgctgagttaattttattgtatttacaggaacagaacttcttattattaaatcatcatttatttttgttgcataataaatgtaatttaaatccatggttttactatatctgctcacatatccttccccatattctaaagcctgtattacttcgtctctatcactatgattttcagtagtgttactttcactatcatatactactgaaccatctgtttttataagtgtaaaccttaatttcatttcattaattttaatattatcatattgtttaattttatctgtaacttcatttccagattgagcaattaaaaaattaatacttttaagagaatcttttgtactttttatctgctctacatttgtaactacagtaaataggcatgttaccattaatattgcagataatactgttattataacaagacttaatattttattcttcataacattaaataggattaaatctatatccaactcctcttatagtttcaataaatttaggatttttatcatcctcttcaattttctttctgagatatcgtatatgtacgtcgactgttcttgtctcaccaatatattcatatccccaaattttatctaaaagcatttctctcttgagtatttttcctttattttttataagaatctgaagaagttcaaattcctttaatgttaaatctactttattaccttgtattttaacttcatgacgttcaaagtcaactttcaaagtctttgattcatatatatcattttcttccacattaaatgatgcagttcttcttaatacagcttttactctagcaagaagttctctaacagaaaatggctttgtaatataatcatcagctccaagttcaagacctaatattttatcaagttcttctccctttgcagtcagcattattattgatgtattcttcatttctttatccttttttatttccttacatacatcaaaaccatccatacctggtatcattaaatctaaaagaattaagttaggcttttcttcttttgctatcctaactgcttcaatcccatctgttgcaataaatgtttcatatccagagttttttaagttaaagtctaaaagttctactatgtgctcctcatcatctactattaatatcttttctctagtcattacatctcccccttaatgtaaaataacaaaagcaaacattcttccatatgctccatctgattttctatacgaatgaagtttaatttcttcactacaatgtgtacataaatttaaactatttatattttcatctcttagtccagactctttcaaattttgtactatacaagcttctaaatttaaatttcttttttcaaaaagtatttcaggattaatcatttttttcttttccaagaatttattttttaattcctctgatatctcataacagcactgccttatatgaggtcctataaaagctttaatatttatatcttcacaaccaaattcgcttttcattttttcaacagttttaaatgtaattgattcaaatgttcctctccagccactatgtatagctgcagccacaccttttgtatcatcaacaagtataataggcacgcaatctgctgtaaatactcctattataacatctctttcatctgtaacaatggaatctccttcattactattaaagtcattctctcctaatttgtaatttagtattttatcactatgtatttgctttaaatacactacatcttttactgaaaatttattttttaaagaatttaattcattaattccagtttcagtatttctattgaaactacgtccattttcagcattagtaaatactactgtaaaactatcttgttcaatttttaaaaaatcttcttctttttccattacatttaaacttaataaattcaatgtttccctcctaaaatacgccttaattatttttaatgtattctaatcttcttacataatattaacacttttcctcaatatatataatgttcttaacaaaactttaacttcattataacaatactatattcttataatatattatcacatttattataaaaaaaacggatattgaccacaaaattcaacatccatttttttcttctattttaggttattaaattctttatttcttctaaaaatgtatttatatccttgaattgtctatatactgatgcaaatctaacataagatatttcatctaactctttaagctttgacatcaccatttctccaatatcttttgaaggtatttctgtaagcatactattagatattgctttctctatatcataagccatgtcttcaatttgttttctagaaacaggtcttttttgacatgcaattattaatccattaattattttttctttattaaaattttccctagtcgaatccttctttataactaaaataggaaaatcctctatcttctcatatgtagtgtatcttttattgcactttaaacattctcgtcttcttctaattgtagaattatcatctgttgatcttgaatctacaaccttactctcttggaaaccacaaaatggacatttcatctcattcttcacctcactgcttttctctagtgtttataaatattatacatatattttattgatattaccatattatttttcgtttaaagtttgattaaccttaactagtattacatcgcttcctatttttactatatcctcccataaaacctctatattatcatccttggaaaaccatgattttatttctcctggtaatattaatgatagtattttgttggtctcacaatcaattttaaaatcacttatgtatcctattttgcttccagtaagtatatctataacttccatatttctcattgcattaagtgaatgtaattcaatttccaaactaatcccccctgttaccttatatattatatttattgtatttttaatttacctctatataatatatgtctaataagaaatttaaatcacaaatttataaaaactggcattataataacaccagtttttttgtcatacatgtttacgcatatgttttagcgctgttttttctaatcttgaaacttgagcttgtgaaataccaatctcatcagcaacttccatttgagttcttccattaaaaaatcttaagtttaaaattaatttttcacgatcgcttagctttttcatagcttcttttacggaaatgttttcaagccaattctcatccgtatcttttgagtcactaatttgatccattacatatattgcatctccaccatcatgataaataggctcatataaagatacaggatcttgtatagcatctaaagcaaagacaacttcttctcttggcaattcaagttcctttgctatttgtgaaattgttggttccttgttattgtctttaataaacttttctctaacaattaatgctttatatgcaatgtctctcaatgatctacttactcttatagagttattatctcttaaatatcttcgtatttctcctattatcattggaactgcataagttgaaaatttaacattttgggataaatcaaaattatcgattgatttcattaagcctatgcaacctacttgaaataaatcatcaatattttcacctctattgttaaagcgttgaataacacttaagactaatcttaaatttccctttataaatgtttctcttgcacttttatctccagctttcatttgtagaagaagttgttttttttctttttccttaagtattggaagttttgaagtattaacaccacatatttctactttattaattatcataagtatcaaccccttcggaagtaataatccattgcattaaacattatttccgataggtgatacttttatacttacagacaacctaaatcattctatttatttcttttttcaatcttttaattatttttttctctaatctcgatatataagactgagatataccaagcatatccgccacttctttctgagttttttctcttgctccatttaaaccaaatcttaatcgtacaatttctttttctctatcatttaaactttttaatgccataaataaaagttgtttatctacttcatcttcaatgagattatatacagtatcgttttctgtccctaaaatatctgaaagtaaaagttcatttccatcccagtcaatatttaaaggttcataaaatgatatttctgctttaaccttgctatttcttcttaaatacattaaaatttcattttctatacaacgtgatgcatacgttgccagtttaattttcttctcaggattaaatgtattaactgctttaattaatcctatagtaccaacagatattaaatcttcaacataaacacctgtattttcaaatttgcgtgctatatagactactaatcttaaatttctttcaattaatgtacttcttattttttcatcaccattgtttaatttttttaataattcttcttcttcatccttagataaaggaggtggcagagcgtcattacctccaacataaaataaattcctgctaaataatttgaatttactcaatagcttattaaaaaacagaattaatttctccatacatatatcctccctacaaaattcctcttgataataatgcgttaaactcattttctctgcttaatttttccacacaaggacatattatggcatcaacttgtctataccataattctctacctttaatctttatgttgttaattcttattccctttaaattgccaccgtatccgattgcattataaggtatattatatatattttgattgttaaaattaaacatagaaagcaaatctttttcaattaaaatacatggaagattagtaaccggctcccttaattcattacctgtatccaggaagcttcgaaaactatatatcctgccatctatttcaaactctattatataaatataactatttacagcaactttatcttttatatattcaattaacctgtccaaaaatataaatataatcataagtgcaagcataatatatttaattgaatatttttctattttaaaatttccacttaacatataataattttgttttaatgaaaataaaaaacatattccacttaatgtgaatgtcagcataaggaatgcccctaatacttttaacatatttataaatgtagtcttaccataagatactctaatcatcaaatatgcagtcaataattcaaatggcatgatagctaaaaagtttagtttgggaattatcataacaaaactatatattgccccaataaaagcagcagtcaataataaaaaaaagggacttttgtgttttaaacatctcatagttatacttaataaaaatagattaactataaagttttctatgaaaaacacatctgcataaactatcacttttagccctcctatctgcttgagtttaattatagacgttttctccttaaaaatttgtcataatcagatatgagtactttattttttatattaaactttttacatatatttacactatgttttccctttactttttacaagttaaaattaaacaaattataatgtgcaaattatttttttctatctaaatttgatataaaatctacaaaaatatccctgcaaactttatagttattactttttattctttaggacttttaatttattaatacacgtttttaataatacaaagttatccatagatttcattacaatcataatttgctaaagaataaaaaaaaaggtatggattatatccatacctaacgataatataaattaatgttttctttgtcttcttaaaaatactggtatatccaaatcatctgactcataagaatttgccgatgtttctggttctttttctgcagttgtagctgctgcttcttcttttgctgtttcatgctgtactggctttttaagttcttgtactgaatttgatgacaatacatttttacccgcttctgtttcaaaaccagtagcaataactgtaattcttacttcttctgtaagagtttcatctattactgctccaacaattatattagcatctggatctacagcttcacgaacaacatcagctgcatcgtatacttctaatgcacctaaatcagctccacctgtaaagttaattattacatctgtagcaccatcaattgaagtttctaaaagtggtgatgatattgcttgtttaacagcatcttgtgctcttgtatcacctttaccaaaaccaactcccatatgagctaagcctttattaagcataacagctttaatatcagcaaagtctgcattaataactccagtaatagttataaggtcagatattgcctgtaccccttgtcttaaaacatcatctgctaatctaaaagaatcaagtaatgttgtctttttatcagccattgtaagtaatctttcatttggaataataactaaagtatctactttttccttaaggttttctattcccatttcagcatgtctcattcttctttttccttcaaatgggaatggtttcgtaactacacctactgttaatatttccatagatttagctatttctgcaacaacaggagcagctccagttcctgttcctccacccataccagctgtgatgaaaaccatgtttgcaccttttattgcggcagtaatttcttctctgctttcttcagcagccttcttaccaatttcaggatttgcgcctgcccctaatcccttagtaagtttttcccctatttgaatcttttggtctgcttctgaaagtaataatgcttgtttatctgtatttattgcaataaactctacattcttaagaccttcaactatcattctattaacagcattgcttcctccgccgccgcagccaattacttttatgttggttaattcttgcatatctgcttcaaaatctaacaaaacaattcctccctttagaaaatcttattaaagaaacttttcaatttatttaatatgtgattttcatcttcattattgtgtaaaatttctgtgtcttcattcacattttctttttctgattttttattattaggaattatcttattatcccctaataagattaatctatcatacacttctttaactaatgctaatgaagttatattttctgaattctttattcccaaatcaatatcttttataatttttatttttttcttgaaaatcttactaacgatttcagcaatatcttcaaaatagcttaatgcatctccatataaaattatactacaaattctatcataatgaccagacttttttaactccatatggatatgatttaatatttcttcaattcttgcatttgtcacttcaaaaaataattcttttggaacatttactgtgcctactttaatttcgttagaaacagatttatctttatacaatgttttataattactagaataaatcttttttatattatctgcttctaaaaacgaaaatttaccacagatagccagatcatttgaaatattatttcctccaacaggtatgctacttatattttttattacagcattatcatcaaatactgaaatatcaactactcctgcgccaacatcaacaagtgcatattctccatcatatttattttcacttaaaaatatctgtcgtccagtaataatattactttttatagaatcaattttatatttagtatttttaaatatttcattgtatttatctatttcgcttttattacctattactaaagtcagattcatttcaaaactatcagctttccagtttattatatctttgtatacaacctgattatttataatataaaagtttattatttcatcaataataatctcttcttcgcttagtaaaaattctctttttgctttatccaatccttccattaatgattcttgtgttatttttccatctttcacatcaacttttactgttatttcagtaattcttattttccttgaagaaattccgacagttacattttttatgtttctttcagtcgtttcttctaattcttttaataatttttctattgcttctctacatttattaatatctacaatagtacctttttctatcccaaccgatttacagctttttgtaagtaatatttctaattcattacttttattttttactccaatggttgcagataactttttacttccaatatctatagctgttattatctcttgtaacatgactagttctttcccttctttgcagaaaaaataatccctaaaatatatattcaacaaaatatattcaacacataatagaaaaatcctctaaatatatgtatttaattttaaaattttattaaatatatgcttatatttccatttttcgattaaataaagcttatcttttgcatacccaaacatattataaatttagcaaacataaatttcaagttattaaaaatttccaataatatattatttattatttctcacccatttttcatattcttctttcgaaataacaccattattaaccaatctccttaaatccatatctattgtctgcattccaaatttattacccatctgaataaaactatctatctgttcataatttccttctcttataaggttctttatactgggtgtacataccattatttccattgctgcagttcttcctttaccacatgaattaggaattaaaacttgtgatacaacacctcttaataaagaagataattgaattttaacttcattttgatgtccagactcaaacgaattaataattctatatatactatttgcagctcccatattatgaagagttgaaaatacaagatgtccagtctgcgctgctcttaaagcaatttctattgtttcaggatctctcatttctccaacaagaataacatctggatcctgtcttaaagcagctctaagtcccatagcataacttttagtatcttctccaacttccctttgattaatcatagatttttttgtttcatgaatatattctataggttcttctaaagtaataatatgttttttttgtgtagtatttatttcatttatcatagcagctaatgtagtactttttcctgacccagtaggacctgttacaagtactagtccatctgtcaattctgtaaaatctcttaaaatcatcgaatcagtaatatcacttaattttggtatactttctttaataactctcatacatatggcatatgtacctttacatttaaatgcattaactctaaaattactaattccaggcttattatatttaaaatcaatttctccacttgtcaagaactcattgaatttagttggaatcatatcctttatatattgttcgaccatttcatgaggaataggctcttcattaacattaaccaaatttccatcaattcttaccattggttttaatccagatgtaatatgaacatcagacactatacgtatatctatattatccaataatttatcaatttcagccataaaatcctccatatattacttgcaaaataaatcacatttttatttttaaattaaatacaataagagtactataattaaaatagcactcttattccaagtatgtcaatatttatcatgtatataaatgttctaaatttatatattgtgttttgaaatacttaattaagtaattaattttttgaatatagttctttcttcagtttttttaatgcttttttctcaattcttgaaacatatgaacgtgatattcctaaattgctagctatttctctttgtgttttgcattttccgtcaattaatccgtatctcattattaatattgaactttctctgcttgttaatgattcaccaagtttcttatacaaagctctaacttgcagattactttctactttatctagtactgaatctttttcactgcttaatatatccattagacaaaactcattgccttccttatcaactccaatcggatcttggagataaacttcactcttctgctttttattatttctaaatagcattaaaatttcattttctatacaccttgaagcataagtagcaagtctagttcccttactagaatcaaaagaatcaattgcttttattagccctactgttcctattgaaattaattcatctacgtctttatttgggaaagaatattttttaacaatatgagctactaatcttaagtttctttctatcaatatacttttagcacttttatctccttctttaaatttctttaagtacatttgttcctcttcttcatctagtggtaatggaaaagtattgttgttggttatatatcctgttaaaaaaaaggaattgcatataagctcaactaagccatttaatataaacacctttttcctccataacagtgcttcatattatagtatgttttttcttagaaaaagttgcttatacatttatatttatttatcgcataatttttctactatgtctttaaagataggggcagctgtgtctccgcctccagcatcattattgttagcattttttattaattcaatatctggtgtaaaaactatcattgtatattttttattatccttcataaaataacctgtaaaccatccatgagttttgccattactacctgtagcagaccctgtttttcctccaataatcacattatccatatatgctttttttccggtaccatttttaacaacttcagtcatagcattttgtacaatttttgcagttgtttcactatatacttttttttcgtcttttttaaattcttctactacattttcatccttatccaaaatggcttcgataatatatggcttttcataaaccccatcatttacaactgtatttatagctcctagcatttgaattggcgttacattcatacactgaccaatagatatgttattcatacctgaatcttcattaggcattattcccattgcttcatttctatttgttccagcaaaatttaaaactcgattatataacccctggatttttgaatattccattaatttatcataaccaagcttagatcctatttgagcaaaaacatcattacatgaaatttcaaaagctttttcaactgtaatttttccatgaggagttttacaaatatctcccttacatgtatatgtgtcatttatattaataatcccacattctaaagcagaactcaatgttattattttataaatagatcccggctcatatcccatctgctctatacccagattaatattcgcctcactctcatctttttgaaccattgattttatttttccactgtcactctccataattattacacctatattttttagataattatatttatcactatctaaaacttcctctactttatcctgcatatccttatctatcgttaatcttaaattcctattttcatcagaaacacttactgattgttttgagtaaatagctttgtcatctaaataaaattcgcctttaggtgtctcattatttttcaaataattataaagatctccttcaattgttccttcggcattatttccttcacatattttacttagcatattttcaatactccacgctttttttccatcaacagtatcggatatatacgtatatataccttttatattttttaatttatttattttattataagtatcttcagatatattgtaatatacttttccaccctgtttcataatattagaataattaaattgcggatcttccgatttcattataaaattcaatgccatcaaatcttctaaagtctcttcataattgttcaatgtaaaaggctttacatcaataacaagcacatatttcttatcatacttcattaaatctttaccattacaatctaatatcatgtaatctaaatttgttatattttcttcttgatgattctgataagaactttgtactttctcagatgggtgcaactgcagcttatatattctcattgttaataatattaataatgtaaataagaaggccgtaacatacaatatcctttgttttttgtataatttttcgataaaaataaaaagcacctccctatggttaaattttaacccacgaagatgctttttattcagtttaatccttttattccaaaaaattcattaataatctttttattgaatgcttaatcgaatcaaaattataaagagtaagttttatttcctttaacaagcatatcattcttttgaagtggttcactaacctttactttaaatatcatatgcgctctattagcaacatctgttttacattgcttgctaacatcatacatttcacttattttaacattaaaatatggtgtatgtggtcttaaaacttcaacttctgtattatcaaatactctatttttttgaagtatagttgctgtttgagtttcagcatcatattcttgaaccataccaactatttcgtaatcacgtatataagattgatcttcataattttgttcaccatttattcccaagaaaaatcctgtatgatattgtctatgacttactttatttaatatgtccatccattcttccttaaattcatatgcttctttattatcataatatgaatctaaagcctctctataagccttaactgctgatgctacatagaattcacttttcattcttccttcaattttaagagaatctatacctgcctctacaagttctggtatatagtgaatcatacataaatcttttgaattcattatatatgtaccattatcatcctcaataacaggataatattcacctggtcttgtttcttctacaagatgatacttatatctacatgcatttgaacatattcctttattagcatctcttccaagcatataatttgaaataagacatcttcctgaataagcaatacacattgatccatgtacaaaagtttctatttcacaatcttctggaatattttcagtaattgtctttatttctctgaaagttaactctctagcaagtactattctttttattccaaggtcataccagaactttgttgcaacccagtttaccgtatttgcctgagtacttaaatgtatttctaaatcaggagcgacttcttttgctattgcaattaatgatggatctgcaattaacactgcatctacacccatatcatatagtcctttaatatattctcctgcaccttttaaatcatagtttcttgcaaatacatttaaagtcacatagacttttttacctctatcatgacaatattttataccttctatcatctcttcatttgtgaagttatttgaaaaagcccttaaatttaactttcctccacctaaatatacagcatccgcaccaaaatctattgctatttttaatttttctaaattccccgctggggctagaatttccggtttctttttcatgtgattttttacctcctcttagttactgctatcccatctcccattggtataactgatgtaattaaactttcatcctgtgtaactaaatctaaatatgttctcattctttttactattgttatttttcttctttttaccaattcttgagatgcaaccattcccctgaaaagtacgttatcagctacaattataccatcgtcttttaaaagtctaagacagtgtggtaaaaaatgattatagtgtcctttccctgcatccatgaatataagatcaaatttatcatctaatctttctaatacttcaagacagtctccttgctcaattttaattttatcccttaaattaaatctgtctaaattgattttagccatttctatcattttttcatcacgttctatagttacaatgtcaggttctacacctgcactttcatacattaaaattgatgaaaatccaacagctgtacctaactctaagatttttttaggctttttcatacttgtcataaactctaaaaatactcctgtttccttttgaactataggtactccattttctcttgcaaagtcttctatttcttttaacgttccagttctttcaggaatcaatcctcttatatagtcttccatataatcatatgtaattttactcaattttctctcctccaaaactagtatcctaattctttctttttcgctaagaaatcctcatagctttttgtgaaataatgtgttccgtctttttgcaatatataatataaattatctgtctttgctggaagcagagctgcttttatgcattcaattcccggacttgctatcggtcctattggcaaacctgaatatttatatgtattatacggagaatctacttctaggtgtctgtttaaaacaacatcaacatgttctcctaaagcatataatactgttgcatctagttgcagcttcatacccttttccaatctgttataaattacagatgaaattaaaggtctatctatatcttcactagcttctttttctatcatagatgcaatagtaattattttatcaatatcttcattctttataacaatattattttctttttctatttcttttattgccgtattaaatctttcaagcatcttatctattatattatttgcatttgttcccatttctattagatatgtatccggatataaaaacccttctaaattatatcttcttttttcattaacttcaacaaaagtcggcaattcataattttttattgcttctataaactcatttttactacataggcctttttcttccataagttctgctatttcttctacagaatatccttctggaattgttaccttaatcatatttatattatatgaatcatcttgaaggtcctttattaattgttcaagagtaacatctgaatttatttcatatgttccctctttaagggtaatattttgtttatcaatgctcaatttcacttttataagaagtttattatgtagtttaccctcatcatcaagtctatttagaacatcataaaaaccatcaccagcttttacttttacagaaactgttttttcattgctttttaaaggtttacttatggcaccattatataaaatcgcaaaagtaattacagctataaataaaaaaagcaaagtaattattcttatttttttcatttttttatttactttcataaaagttctcctatatgcaataaagtaaatagcctaataagactatttactttaattatagttattttattataagttttaaataatagaaattattttttatttctgcttatcattcttcttctttcagcaggatctaaagctatttttcttattcttatgttttctggtgtaacttctactaactcatctgaaccaatgaaatctaaacattgttcaagagtcatttcaagtggtggagttaattttaatgcatcatctgctccagatgatcttgtatttgtaagtttcttacctttacatacattgatatcaatatcttctgatcttgaacatacacctacaaccattcctgtataaactggtacaccagctcctatgaataattgtcccttatcttgagcattgtataatccataagcaattgaatctcctgattcaaatgatactattgatcctctgtttctagttggaatatcacctttatatctttcataactatcaaatacatggttcattattccattaccttttgtatcagtcatgaattcatttctaaatccaataagtcctctagctggaattttgaattctaatcttgtataaccattaactgctgaagtcatattaaccatttctgcttttcttggtccaagcttttccattattggtcccataaattcttctggaacatcaatagttaagtattcaattggttctaccttatgaccatcttcttctttaaatataacacttgcttttgaaacttgtaattcgtatccttctcttctcattgtttcaattaagactgaaagatgaagttctcctcttcctgaaacttcaaaacaatctggagttatttctttaactcttaaacttacgttagtttctaattctttcattaatctatctcttaaatgtctagaagtaacaaagtctccttcttgacctgaaaatggtgaatcatttaccataaagttcatacttaaagttggttcatcaatatgtacgaatggtaatgcttctggagcacttgaatctgcaattgtttcacctatattggcatctaaaacaccacttacagcaactatgtctcccattccagcttcttcaacttcaactctcttcaatccatcgtatgtaaatactgctgttattttatagttttgagtacttccatcgtttcttactaaagaaacagtttggttctttttaactttacctctatgaatcttaccaattgcaattttaccaacgaatgcatttgtatctaatgtagttacaagcatttggaatggttcatccatttgaccttctggtggtgcaacatgttttaatattgtttcaaatattggagtcatatctgcatttgtatcttcaacattgtacattgcaaatccttctcttgctgatgcataaactattgggaaatctaattgttcgtcattagctcctaattcaacgaataaatcaaatacttcatcaattacttctactggtctagcatctggcttatctattttatttattataactattggttttaatcctaattctaatgatttcttaagaacgaatttagtttgtggcattggcccttcataagaatcaactactaataaaactgagtcaaccatcttaagtacacgttcaacttctccaccgaaatcagcatgtcctggagtatctactatattaattttcactccatcatgcattactgctgtatttttagaaaggattgtaattcctctttctttttctaaatcattagagtccattactctttcttgaactttttcattgcttctgaatatattactttgctttaataatgcgtcaactaaagtagtcttaccgtggtcaacgtgggctataatagcaatatttctaatatcttctcttttaattaattccattttaattcctccaaccagtatttgtactgtgaattttctatttattagtttatatctataactaaatataaacaagtaaaaattaaagtatatgttgtaaataagttcttataaagttcattttttaacatacattcaaatatgttaacatataaacttaaataatcctgtaattatgtaaatgtaaacctataactgtttttttccaaaagaaaattggatacaaaaagtatccaattcctcacataactatatttaatattactcttttcattataaaaagtcaagtatattaaaattcatacaaaaatattttataattaaaattccattattataggtaatatcattggctttctcttagtcttttcataaaggaattctctaagttcatccctcattttagactttaatgtcgcccagtcagttatttgtctttcttcgcagttctttaacacagatctaacaatttctcttgcttcatccataagaccttctgattctcttacatagacaaatcctcttgaaattatatctggtcctgatacaacttttccagtctgtttttctattgtaacaactactgttaatataccatcttgagataaatgttttctatctcttaatactatatttccaacgtcaccaacacctaaaccatcaacaaagacttggcccgaagttacacttccgtttttcttgatatagttacgagttaattctatcacgtcaccattttcacaaataaccaaattcttttctggtaaacctagttccatagctaattcaccatgttttttaagatgtctgtattctccatgaacaggaataaagaattttggcttaactaacgcctgcataagctttaattcttcttgacacgcatgccctgacacatgaattttttctactgaatcatatattacttcagcaccctttttaaataactggttaacaacctttgaaacaaatttttcattacctggtattggcgttgcagaaataattacagtgtccccaggaattatagcaatttttctatgttctgaagctgccattcttgcaagagctgacattggctcaccttgactaccagttgttataattaccattttatcatttggatattttcctatttggtcgataggcactaacacatctttatcaacttcaaggtatccaagttcaatagccacttgaacaatattttccatacttcttccagatacagcaacttttttttcatatttctgagctgcagtaataatttgttgtattctatgaacattagatgcaaatgttgctacaattattcttccattagcttttccaaataatctattaaatgtttctcctacaactttttctgtcatagtatatcctggtctttcaacatttgttgaatcggccatcataactaaaacaccttttcttccgatttcagcaagtcttgcaaaatccatcatttctccatcaatcggagtataatcaatcttaaaatctcctgtgtgaagtactacaccaagaggagtatgaattgctattgctactgaatctgctatagagtgattagtttttataaattcaactgatacactacttaattttattatgtccttaggcttaactcttattagctctgttgaacttaataaaccgtgctctttaagctttgtttcaacgattccaagagtaagctttgtaccatatacaggaacatttaattgctttaatacataaggcaatgctcctatatgatcctcatgtccatgagttaaaaatattccttttattttttccgaattcttaagaagatatgaaatatctggtattactatatctattccaaacatatcgtcatcagggaattttaaaccacagtctataattacaatatcttctttatattctatagctgtaatatttttcccgatttcatttataccgccaagaggaattatcttaatcttcgctctttcatttttcatatttcccctccttttcctatatttatttataaacaaaggttcttttttattgtaaaagcccttttattcatcatgttgtttagactgacactcatcacaaataccataaaattttacgctatgatcaagtatcttaaatttatagtcattttctatattactttcaagttcttctaataaatcatcttgaacttctaataccttatgacatatattacatactaagtgatgatgcctatgagtttcgtcagaatgtacaatttcatatctactacatccatcatttaaatcaagtctagatataacattcaattcttcaagaagcagaatagttctataaactgtagctaaccctatttcagggcaatctctttttacttcatcatagatttcttctgctgttaaatgtttaccttcattctttataattgtatcaacaattgatcttctctgaggagttaacttatatccctttttctttaagtcctcttttaaggcattcatatcaattaaatttgcatcttgcattataacacctcactttcttcattttaaacagttttaatattataatttactctattttaattattcttcaaataatccatcttcactcattagagtattataggtttctaataccatttcaaattcgtcatcatcatcttctaaagctaagaatatttcacttccatcatcttctttgaatattttaaatgcgtatgcctcgtcagtttcttcaaatgcaggtgttgcaattatatattgtccttttaacttttcaatttcgaagtatataataacctcaaacttaacatcatttccattttcatctggtatatatacatattttgcttctttatccataaatattttcctttctttatctaatttatatgttaattctctttataactttcataaagagattattttcaaattaatctttaaatcatcatattttctatactataaaacaattacatctttatttataactcttcaagtgtaaaattttataattgtctagatatcatatctaggtaaccttgtaatatgtatgttgatgccactttatcaactatcttttttcttttatttcttgacaaatccgcctcaagcattgccttgtgcgctgccactgttgtcaaacgttcatcccagaacttaatttctatttgaaattcttcttctagtagctttccaaaagccattgcaatttcacccgatggacctattgttccattcatatttttaggaagccctatcacaatagtttctactttgtactcatcacaaattttttttaaatcctctatatctttttctttactgcctcttcttattgttgtaagaccttgagcagtaaaacctaatggatcgcttattgctactcctatagttttttgtcctaaatctaaacctagtattcttttcaaatttgcacctcttaaaaaataagagtacccgtaataacgggcactctctactttatctctaaataagattttattacttcttctagtatgtcatctctttcgagttttcttactaaagcccttgctccgttgtaattagtgatgtaagtagggtctcctgaaatcaaatatccaactaattgatttataggattatatcctttttcttgtaatgaattataaacctctgataagatagattttgtaagagcttctttattcttacttaaatcaaactgcattgttgcttcaatattattactcataacgcgctgcttaactgcagctcacccccttacttatattctaaggaaaccatatccattctttattattaaccttatgattaaaatttatacactgaatctttacttagattatactctaatttgaataaaaagtatactattttgctaaagtttcaactattttatatgattcttcaatagcatcattaattttttctggaagcttaccaccggcttgagccatatctggtcttccgccaccgcctccaccaaggatagctgaaacttcttttataagtttaccacagtgtgctccatttttaacggcatctttgcttgccattgcacatattattactttaccagcattttcactcataagtaaaacaacactattttcaaccttatcttttactttttcacaaacttctcttaaagtatcactgtcaacatcttttaattcataagatacaacatttataccttttacttctttactactagcaattatatcatccaatcccatagctgcaaacttagcttttaatgctgaaatttctttttctttttcttttatttcttttaagttctgttcaatcttagatgtaatttctttttgtgtacattttaattttccacaagcttcttttaataattcttctttttcatttataaatttaacagcttcttttcctgtcactgcttctattcttcttgttcctgctgcaattccactttcagatagaatcttaaataatcctattttaccagtattatctatatgagtaccaccgcataattctttagaatattctcctgctgtaacaactcttaccttatccccatatttatcatcaaatattcctatagcaccactatttttagcatcatttaagtccataacttcagtaactactggagtaacactcattatagcttcattaactagatcttcaacttttagtatatcttcttcacttaacccttcaaaatgcgaaaagtcaaatcttaatctttcatcagtaactaatgaacctgcttggtgtacatgagaaccaagaactttaactaatgctctatctaaaagatgagttgctgtatggttctttcttattctttcacgtctttcattatctatttctaaagtaacagtatcatttatctttacttctccagataatacttcaacaaaatgaactatttttccacccatatttttctttgtgtcaacaacttttgctttaaagctgtcattatatatgagaccagtatctccaatttgtccacccatttcagcataaaatggtgttacatcagtaactagtatacctttatttccttcagttaatgaatctgcaaaatcttcaccatcaattaatacttcaactttaccttgtaattgattatttgtatatccatcaaattctgtttcaacatctgcacttattgcatcagaagtcttaacgtctgcacccatatagttagaaacttttcttgcatttctagctctttctctttgaatcttcatttcttcatgaaatgcatcttcatctaaagaaaatccttcatcttctaaaatttcttttgtaagttccatagggaatccaaatgtatcatataatttaaatccttctgcaccactaagaatttttttattattttctttcaattcagaaatgaatccatttaaaatttctattcctgcatctaaagtttctctaaatttatcttcttctattttaattacttttttaatgtattctctcttagcttctaattcagcatatgcttccttagaatctcttataacaacatcacataaattgcaaaggaatgcatcttttatccctaaagtctttccatgtcttgcagcccttcttaaaagccttcttaatacatatcctcttccttcatttgatggcattatatcatctgaaatcatgaatgttatagatcttatatggtcagtaattaatcttaatgatatatcagttttcttattttcaccatatctaactcctgcaagattagccacttcatttaagatattttctaatgtatctatttcaaagatactatttttttcttgcattacaactgcaagtctttcaagccccattcctgtatctatgtttgtacttgcaagtttttcataattaccttttccatcaccatcaaattgtgtgaatacaaggttccaaacttctataattttatctgcatctgataattcaacaaattcttctgcattttttggaacatcatctgttctactgaaatgtatttctgtacaaggaccacaaggacctgcaccatgttcccagaagttatcttctttacccaatctgaatatgtggctcttatctacatctgtaagtgtagtccagaattcatatgcttcatcatcatctaagtatattgttacatataatttatcttttggcatttctaaaacttctgttaagaactcccatgcccatggaataacttcttttttaaagtaatctccaaaagagaaatttccaagcatctcaaaaaaagtaccatgtctgcttgttattcctacattttcaatatcacctgttctcacacacttctgacaagtagtaactctttttcttggtggttcttgtaaccctgtaaaataaggctttaaaggtgccatccctgcatttattaataataaactattatcgtttttaggtactaaagagaaactatctagctttaaatgtcccttactttcaaaaaactttaaataagcatctcttaagtcatttgtctttgtaaatttcataagttattcctccattaatattaatttatctgtgaatagtcatttttaaatgacattacaccggataaagataatcaaaaaaatatatacaaaaaatcatataacatcattaattatactttatcattatttcatttttatgttaaaaaataaaaaagccctctccctataaaaacaagggacgaaagctaaaattccgcggtaccaccctaattatgtataaaatatacatcacttagtaagttatagctcctaggcagcttcaaaatacaatagcaagaagttttcaccagccacttcctctcttaatatctattaataattctacttttcctattcatcgcttaatatatgttatttcaacaaaaattatatttcatatacataattatgtcaatatgctaccttcttagagaaaaatttattatattttttattcatcgttttaatttagattagaataaataatagttaatgtcatcatacaatactttaatcactacagctattggtactactacaatcattcctataaagcctccaaatttatctcctataagaagtaaaactattattacaaagggatgcatctcaatgctatctcctgtaattttaggcgataatatattaccttcaatttgttgaataagaatcataccaataagaacccatagagcctttgctggagatatcatcagcgctacaataacagcaggcaccattccaaaaatcggaccaaaataaggtattatattaaataatgcattaaaaatcgcaatccacaatggaaacttaatttgtaaactcagcaataaaataaatgtaagtatacctattattccacatagatacaactgtcctgatatatatctttttaaaaccttatttatatccataactatattttgtgtaacttctcttttattagttggtaaaataagcatcattcttgaaaataacctatccccatcacacataaaatagtaaattattataggtattacagctaatgataaaattttagaactagcttccaatatataatccaataaattatctgaaacacttgtcaataaaccgtttcctttttccactattgagttatatatagaatttattccaggaatactattcaaattaaacttatctgcaatattattataaaatttttcaacattatcaaagacatctcccacagaagctaattcatcaacaaaacttgggagcattacagttattccacctattattaacccaactacaattaaaatgataattaatgaggatgttcttttattcactttcagttttgtcatcaaaaattcttttgctggatttaatacatatgataaagaaaatgaaataaagattatatttacaatttctttaattgatgaattaaacaaatataaagaaataaagattacaattattaatattgaaaggattataaataattttgatttatgctttcgaagattcatttttactctccaaattatgaggaatagacttaaacattatattatcctttccattataaagtatatactcatctccaagtatgcattgttccaacaaaattatttcttttccttttataagtctgtcaattaatcctgagcttattactattcctttaattaaatagctatattcatcaactataatatcttcaaaaacgcctttgacaataccattaatatctacaacttcaatatttttaagggattttagtcctaatccattcccctgcttttcttcaatcacgataatatcttccccaatattaattacatcttcaatatctatataattctttcttgaaaatagagccgaaaccgaacatttaaatccagttatctttcccttataaaagtctatgtatacatcttcaattactcctaattttcgtccttcactgttatatacattttttaagtagaaatccttacttttaagcataaattgcacgtcccctcatttaatttatgactatatgttgcccaatacaaggaaaataattctactttttaataaattattcaatataaaagccttctattttgaatattaaaaaatacacaaaatagaaggcttttatattaaattatgctttcaattattccgccaccaacaactacttctttatcataaaaaacaacagactgcccttttgttatagctctctgcttatccttaaatgatactttcactttaccatttggcaatggataaataattgcttccgctggtcttgcagaatatcttatttttgcttgaacatttaactctccttctaatttatcaaaagaaataaagttaacatcagttgcaattaaatcatttttaaaaatttcatcctctgatcctataataacctcatttgttttagcattaatcccagtaacaaatactggtcttccaagtgataacccaagcccttttctctggcctatagtataatacactattcccttgtgctttccaagtacatttccttctttatctacaaagttacctggttttactctacttggtcttgcttctgaaatatactttccatgattattatcagaaataaaacatatttcttcactatcttttttattatgtacagctaatcctatttccttagctatttcccttattttagtcttttcataagctccacaaggcattaatgtatgagctaattgatcttgagtaaaattatatagagcatatgtttgatctttcgaatcatcatctgatcttataagaagatatctgccatcacgttcttctatctttgcataatgtcctgttgcaacatagtcagcaccaattcctcttgctcttcttaaaagttcatcgaatttaagatgtttattacattcaatacatggatttggtgttcttccatccatatattcttgtataaatggttctataactttttctttaaagtaatctctaaaatttaaaacataaaaaggtatacctaatttatcacatactcttcttgcatcttctactgctgaaagcgaacaacatccaccttctctttcttcaaattccttatcttcttgccaaatctgcattgtggcaccaatgacttcatatccctgttcctttaaaagatatgcagcaacggagctgtcaaccccgccactcatacctattaaaactttcttcttactactcaatgttactattctccgtgaaccatgttgtgtaattcatcatggtcgtgttcttccataggctgtacttctaatccgtttctttccctatagtcattgattgctttatgaatagcttcttctgcaagtaccgaacaatgcattttaactggtggaagaccatctaaagcttcagcaacagctttattacttaattcccaagcttcatctaatgtctttccttttatcatttcagttgccatagatgatgatgcaattgccgatccacatccaaaagtcttaaatttaacatctttaataatgttatcttcaacctttaaataaattttcattatatctccacatttagcatttcctacttctccaacaccatttgcatcttcaatttctccaacatttcttggattttggaaatgatccattactttatctgtatatatcatattaattttctcccttcttaataaagtcatcccataatggtgacatatttcttaatctttcaataataggtggtgtaacttctaaaacataatccacatcttcttcagtcgatccagctcctaatgtaagtcttaacgatccatgagcaagttcatgaggaagacctatagcaagaagtacatgagatggatcaagcgatcctgatgtacaagcacttccacttgaagcacatacacccttaaaatctaacgaaagtaatattgactctccttcaataaatctaaatcttacatttacattaccaggaagtcttttttctcctcttggtccatttaaatttgtatatggaatttttaaaagcccatcaattaatctatctctcaatgccgtcatcttttccatatgttcttctatattgcatgttgcaagttccatagctttacctaaaccaacaatacctgcaatattttcagttccagctcttctgtttttttcttgagctccaccatgaattaagttatctattttaatgcccttctttatataaagcacaccaattccttttggtccataaattttatgtcctgctaaagatagcatatcaatattcatttctttaacgtctatcggtacattaccaactgcttgaactgcatctgtatggaaaaatattttcttctctttacatatttcaccaatttcttttacaggttgaattgttccaatttcattattagcaaacattattgaaactaatattgttttatctgttattgcattttttaaatcgtctaaattaatgaaaccttcactgtcaacatctaagtatgtaacttcaaatccatttttctctaaatactgacatgtatgaagtactgcatgatgttcaatttttgttgttattatatggtttcctttatttttatgagcagacgcaataccttttattgcccagttatctgcttctgatccaccacctgtgaagtaaacttcatctggaagacaatttagaccttttgcaactttttctcttgctgtatctattgctctctttgtttctcttgatattccgtaaaatgaagatggatttccaaacttctctgtgaaatatggcatcatttcttctaatacttctggtttaacataagttgttgctgaataatccatataaacattcttcattatattattcacactcctccactaattttatcttaccgctttctttttttattttctcatagttatcaactatatcctgtagtgaaatagaattcataacatcatctatactgttttttattttttcccatacaaatttagttgcacaactgtgttcactatcacatgcatatccatctatacaatcagcaatctcaattggcccttctaatattgtcataatatcaccaacagtgatttcactcggggctttacataaaacatatccccctgagctcctcttatacttcttattatattagcacgtcttagtgggctaaaaagctgttctaagtaatattctgaaagattttgttctttcgatattgtctttattgaaataggggcacctccatagtgagctgcaagttctgccattgctcttactccatatctaccttttgttgataatttcataatctcaccccttaatattaatcttatttcatttatatcttatcaaaatactcggctattgtcaaacctgatattttttaataattatttattgttttttatttctaaacatctctttataaatagcttaattaggagtttttattaattgttaactgttaacccctaactgttaattattatatcaccatatcatagtttgcatagattttttttatttattataacttttactggtttactttatatttttccaataattctttatactattttcatatttattgttttgttcttcataatattttcttccaattaattcctgaggcatatattcctgttttacataatgattatcaaattcatgtggatatttatatcctccaacacctaatttttgtgcacccccataatgtgcatcttttagatgcatcggcacatccccaaaattcatactttccaaatcagacaacgcacctcctattgcaagatatgcactattagactttggaagagtagcgagataaataaccatttccgacaatattatcctcgcttcaggaagtccagttttaagaactaattcaatacctgaatttattatgcttaaagcatttggggctgcaagccctatatcttctgcagcaataacagcaattcgtcttactattgccgttaaatctccacctttaatgagtcttgcaagataatgaacagctgcatcagcatcacttccacgtatacttttttgaagtgcacttaaaagattataaaattcatcaccactactatcagccctcatgttagattgccccaaactttcaatatattctgttgttatttctcttacatgcttaacttgagaatttattgcaagttctaaaatattatatgattttctataatccccttgggatatttccgaaatatatcttaaagcatcctgtgaataatttacacgtaccccttcatcaatcaacttcgttatagacttttctaaaccaataattatgtcttcactacttagaggtttgaatgaaaaaatgttgcatctgcttattatagccttatgtataacaaaatatggattctctgtcgtacttgcaattaatgttattcttccatcttcaataaattctaaaagcgcctgctgttgttttttattaaaatgttgaagttcatcaatataaagaactacaccactatagctcaataaactatccagattatttgttatgtcttgtatgtctttaacactagcagtagtagcatttaatttataaaactttttatctacataattagccatgatatttgcaagtgttgtctttcctgttccaggtggtccataaaatatacaattacatatatttttgctctttattaaattataaagaggctttccctgactcattatatgtttctgaccaacgaaatcatctaatgatgaaggtctcattaaatccgctaaaggtctcattattttttcacctcttctatgtataactgattctatttgtttttatcacatcactatacaaagtaaaaaaatcagttttttattaatattataaaaaactgattaatatttttactttattctacaattaggttttatatgttttaaagttcatctacgttctttatattatctttcaaactcactattaattcttactcttatgacatcttatatatatatgagcaaacctattttaaatgttttggaaataaaatagaacttataaaattcttcacctatctattactttcttttattatttccgtattttcagctgcttaaatatcaaattttatatttatttatacaatttatattatagcttaaaatattgaatatttaaatgaaatatttaaaaataaatcctgtgtagatttttctacacaggatttatactctatttaaatgttatatacaattaatagtctctatccaaatagagttctatcacttaacccctcttctccatttccatttgctttttcaaataattcaagaagactgtttgtatctaatctttctttttccctgcctttaatatcaacaagtatttcacctctatgcatcataaaaagcctatttccattttcaattgcatgtttaagattatgtgttaccataagtgttgtaataccactttcttttactatttttcttgttatctccataatcttttcagatgtttttggatctaatgcagctgtatgttcatcaagtaatagcaatttaggttttgacatgaccgacatcaaaagagtcaatgcctgtctttgtccccctgataaaagctgaactttattatgaagcttatcttcaagacctaagtttatttcacttaccatttctttatagtaatcgattctttttttattaacaccaagtccaaatccaaaatttttacctttattatctgcaagtgctatattttctaatattgtcatattaggtgctacaccttttgatggatcttgaaaaactcttcctatagatttacaccttacatactctggcttattaataacctcatctccatctaaaagtatagatcctgaatcagcctgtaatgtacctgatatcatatttaataaagttgattttcctgcaccattagatccaattatacttataaaatcaccttcacaaacatttaaagataattcatcaaaaactctattttcatttatagtattctgattaaacactttgcatagttgtgttacttttaacattattcttttcaccaccttctataagttttttctttttcattctaaatacaccgttgttagaacataatgctatcactacaattatcgctgtcataagcttaagatcattagctgtaagtcctattactgctccatattttaataccagcgcaattgcacctttatatattattgctccaataatagaaagtgtagttgcttttataaatgacattctttcaaataaagatgttccaattattactgctgcaagtcccattacaacagtacctgttcccattccaacatcagcaaaaccttgatattgagctgttactgctccagctgtagcagaaagtgcattacttataagaagtcctaatatttttaccatatctttatttacacctaaagaagatacaacctgttcattatctccaacagcaataagtaaaaaacccgattttgttttaagatataaatctaaaagaatttttactattattaatgctgctgcaataataactatagcaggaacattatatttaaaaatattatttacattaaataaaggaacatttgctttccccattatccttaggtttattgaatataatcctatcatcataagaattccagccattaaattatctatcttcaatttaacatgcataattcctgtaactgcacctgctaaagcacctcctaacgctgctaaaagtatacttatccatggattaacaccttgaactaacaaagatgcactaatagcagctcccattggaaatgttccatcaacagacatgtctggaaaatctaatattttatatgttatataaaccgctattgctacaatggagaataatagtccttgttctaaaatatttattaaaacattcactattcaacccctcctgtaactaaattagcatttttacgaatatcttctggaatatttatccctaattttgtagcaacatctgtatttatagtaaatgacatctcacttaatgttgatatttcaatatcagaaggtttctttccttctaatatttcaacagctttataacctgcttctttaccaagtttataataatctataccaatagttgcaagtccacctttagttactactgcttcttctgctcctataattggctttttagcatcaatgcaaagttttccaactagactatacgcagatgctactgtattatcagtaggagtatataaaacatctatgtcatttagcgcactagctaaattttgattaatttcatttacatttgttacaccaatttctttaactcctaatccatctttttctgctgctgcttttaattcttcaacctgaattatcgaatttgtttcagatgtattataaattactccaatagtttttgtttctggaagtaactgctttaacaatttaatttgatcttctactggaaccttatctgatgtacctgtaacatttgtaccagaacttttccaatcctttgcaatttccgctgcaacaggatctgtaactgctgtaaacacaattggaatatcctttgtagcattataagctgcttgagctgctggtgttgctactgcaaaaattaaatcctttttactatcagcaaactgctttgtaattgtctgagcattcgcctgctcaccttgagcattttgctgatctatctttatattctttccatcttcatatcctttttcttttaatgcatctacaaaccctttattcgcagaatccaatgcatcatgctgtacaagctgaactacaccaatattctttacttcttgtcctccctcattgcttgtactactcgtacctgcactactgccacaacctattaatgacgtacctattattgcagctgctattagtgcccctaatctttttttccctaccataattccatcctcctgatctatgttgtctctttaatctttcagattcataaaaaacaatttattaattgtatacttatatttatgtaattacatcaattaaattgacaacaatttattaatttattaatttatgttatcatattttaatttttatgtaaagttttatctattatatattaaagtttttttgctttttttaagtgatataattaataatatgtcgaagaaaaagagactttaaaatcttaaagtctctttttacatggtattaaataaaatttcattaataataatcataatcaaagcttctaatttaataaattattattttgcttaaataactatcgatcttttatttatgttttttataattcaattatgatcaagataaagtttaactaattttttaattatttactctatgttctatataggaagacatctatgccctattccaataacaacctcatctaaatgaagaagtccaatactaagaaaaatacatactgaaatatgttctccacctcgtgcaatacctatttttccgcctatatttaagccattagctctattattaacctgtattatagcatctcttgccgcacctattactgcaccttcatgaaggtgttcttctcttataagaccgtttctttttgatgcaactaatgcactttcaagaatcttagaaatagaagaatttatattccctcctatatttacagccgttacttttattccttgttcagaatataattttttaagtgaattttcttcttctctatcacatatagccatttttgtggctatcttggctactttagtactattactctccatataaatcttctccttttatataattgctttaacttgattatataacaataagcaacctttgtcagttttagcatacaaaggggctgtatcaaaacaattttgatactagccgataaaaaaagagaattcataaatttgaattctcttttttgcgcataatattaatatgaacactaataatattatacctatgcatcaaataggtttcccaataaatatagaaaatattatatctgatagtgattcagtaagagtgctttatgatgttatggagggattagattattcagaattaaatagaacttactctactattggtagaaatccagcacttttacctaaaactatgtttgcaattatagtttatggatatatggaaggaatatattcaagtcgtgctcttgaaaaggcatgcaaaagagatataaatttcaaatggcttttacaaggtcaactaccaccaggacacaattctatagatagatttagacgtgaacgattagctggttgtatagaaaatttatttaatcaacttgtgaaaaaacttagagaacttaatgaaattcaatttaaaaatatttttattgatggaactaaaatcgaagcatctgcaaatcgatatacttttgtttggaaaaaatctattgataaatttgaagatagactacaaaagaaaataaaagaaagcttaataaaaatgaatcatgatttgaatttatgtcttattattactaatgctaaaatatcagttcaagatgctaattatattttagatagtatcagaattatgattgaagccaataatattgaatttgtttatggaaaaggtaaaagaaaaagtaaattccaaagatatactgaacaacttaatgaatttattgaaaagcaaaataaatataatgaatacaatagcatttttaatggacgaaacagtttttcaaaaacagatcatgacgcaactttcatgcatatgaaagaagatcatatgaaaaacggtcaattaaaaccagcatataatatccaaataggggtagaaggtgaatatattgtaggagtagacatttcaagtgaaagatctgaccagcttacttttataccatttttagatagattagaaaagaatttaaatcaaaaatatgaatccgtaactgctgacgcaggatacgaaagtgaagaaaattatgcatatcttgaatctaagaaacaagaagcttttattaaacctgcaaattatgaaaagtcaaagacaaagaaattcaagagtgatattagtaagaaagaaaatatgtactataacacagatgaagattactacatttgtgcatctggtaaaaaaatgcttctaaaaggaacaaaaaagaaaaaaacaaaatctggatatgaaactactgttagcatctatgaatgtgaagactgtgatggctgtgaatataagagtaaatgtacgaaagcaaaaggtaatgaacaaatacatgtggctaaaaattttatgcgtctaagaacaaattcacttaaaaacatcactacacctaaaggaatacttttaagaatgaacagatcaattcaagtcgaaggagcatttggagttattaaacaagattatggttttagaagattttttatgcgtggaaatattaaagttcgtactgaatttttgttaatggcgtttggttataatgttaataaattgtaccataaaaccattcaaaatcgtaacggtgagctgcttcataagcagcaagcttcgtaattttaaatatatagttaaaatatggataataatgtttatcctttatttgtgttatttcaaaataaaatatttggaaatatatacatgaataaaatttacgtttataagaataggctgtatcaaattgaatttaaaaaatttcaatttgatacagcccctttttaatagaaattacccatctctctgaatttcttatatctttcatcaactaaactgtccaaatccttctctttaacttttaatagaaattctgtaatactgcttcttatctcatccactgctttttgaggatttttatgagcaccacctcttggctcttttatcatttcatcaatgattccaaattcctttaagtctttagctgttattttcataacatctgcagcttcttttactctcgatgaatccttccataaaatagaagcaaatccttctggtgaaagaatagaataaatcgaatgttcaagcatacatatcttatctgcaaccattaaagctaaagcaccaccgcttcctccttcacctgtaataacagacataattggagtctttaagcgacttaattcaaatagattatttgcaattgcctgaccttgacctctttcttcagcaccaagtccacagaaagctcctggtgtatctacaaaacatattactggacgtttaaatttctctgcttgtttcataagtcttaaagcttttctatatccttctggatttggcattccaaagtttctctttatattttcagtcgtattagatcccttagtaattgatataacagtaacatttataccatttacagatgctataccaccaataatagccttatcatctccaaaagatctgtctccatgcagttcaataaagtccttaaaaatattttcaatgtaatattgtcctgtaggtctttctttatgtcgtgctatctcaacactttcccaggcttcattgctacctttaataaattctttactcataattcttcactccatgtaatacaagaatcttatatatgcaagttctaagatcttttctttcaacaatagaatcaacaaatcctttttctaataaaaattctgccttttgaaaatcttctggaagagtttcttttatagtattttctataactcttcttcctgcaaatcctacaagggcattaggttcacttaaaataatgtcaccctccattgcaaaacttgccgttactccaccagttgtaggatctgttaatactgaaatatataaaagacctgcctcatcatgtctagccagtgcactacttacctttgccatttgcataagagaaaaaatcccttcttgcatccttgcaccgcctgatgtagtaaatataattacaggaagcttattttctgtagaatattcaattagccttgttaacttttcaccaactacagttcccatacttcccatcataaaaaagctatccattattccacatgctacttttaaaccatttatctggccaattcctgtgacaaccgcttctgaactatttgttttaagactacttttattaatcttctcatcatagccttcaaaatcaagaggattagttgtttttaaatctttccacatttctgtaaatgattctttatcaaaaagcattctaattctttgttttgcatttaatctgaaatgatgattacagtttggacaaacatgtttataattctcaagatcgtcctgatatattattccattacatttatcacacttggtccacatgcctgatggaatgttaggtttttcttcattcatttcattgtatttttcttcatctctctttaatactgaaggttttacagttgcatattgtctttttacaaataaatccttaagcattcttcttcaccatcttttctgctaaaaatgacgtatcatattctcctcttaagaactcttcagtttctaagatagaaagatcaaaatttatgtttgtaacaacaccacctactgcaaattcagataatgctcttctcattttaacgattgcttcatccctatcatttccaaatgttattaccttcgcaatcattgaatcataacaatgaggtatcttatatccacagtatattgctgaatctattctaacacccattcctcctggaatacacaattcttcaatctttccaggacaaggtctaaaatcatgatcaggatcttcagcatttactctacattcaatagcatgaccttttagttttatgtcatcttgagtaaatcttaacttctctcctgatgcaattcttatctgctctttaacaatatcaatgccagttatcatttctgttataggatgttctacctgtattcttgtattcatctccataaaatagaaattattgtccttatcaaataagaattctatagttccagcatttttataatctactgccaatgctgctctttttgctatttcacccatcttttctctaagttcttcatttaacacattagatggtgcttcttctaatactttttgattttttctctgcattgaacattctctttcacctagatgaattacatttccatgttcatcagctaaaatctgaaattctatatgtttaggtttttgtacatacttctctaaatataatgtatcatttccaaagcatgctttagcttctgctttagcagttttaaagcccattaagaattcttcatcattaaaagcaattcttattccttttccaccaccacctgctgatgccttgatcataataggatatcctatttcttttgcaagttctaaagcatgattctcatcacgtatttctccttcatatcctggtactacaggtacatcagaaaatttcataatttctctcgctttggctttatcaccaataaaatcaatagtctcatagtctgggcctatgaattttatattacattctctgcacatcttagcaaatttagagttttcagataaaaatccaaaccctggatgaatagcatccgctccagttaaaacacatgcacttaaaatattagccatatttaaataactatctttaggcattgcggatccaatacatacggcttcatctgcaagctgagtatgaagcgcatctttatctatatcagaataaactgcaactgtagctattcccatctctctacatgctcttattactcgtacagctatttctcctctgtttgcaataagtattttttttaacatattatcacctatcctatagcaaataatatttcagcttcacaggctaccttaccatctacagtagcaacaccttttcctacacctataggtcctttaagttttactatttcgcaatataaatcaagtcgatctcctggaacaactttatttttaaatctaactttatttgttcctgcaaacaatggtgtttttcccttaaatttttccatagataaaatagcaactgctcctgcctgagctagtgcttctatttgtaatacacctggcataattggttcttctggataatgtccttgaaagaaagcttcattagctgaaacatttttatatcccttaacataaagtttttcttcaatatccatttcaatcaccctatcaattaatagcatagggtatctatgaggtaaaatttcttttatttcttttatatcaagcataaattaagcctcctttattttaaacaacggctgaccatattcaaccatatcaccatctttaattaaacattcaactatttcaccattgtattcactttctatttcattcataagcttcatagcttcaatgatacatataatttttccttttgatattatatctcctactttaacaaatgcaggagtgtctggtgaggctgctgaatagaatgttcctaccataggagaagtaataatgctcaaattgctatcttcttcttccttaacctcttcttttacttcttcttttattacttttttcatttcattattagtagaattagatattggcttttctactacttgttcagtaataatcttatcattagcagtgcttacagtgttttctgatccacctctgtttaatgatttatccatttttatatgactatttccatcagaaagttcaaaaaaagctaaatctgaagtatctataagtgtaataagttcttttatctgttcaaattccataatataacctcccaggagtttttacttccacttctttaaaagtaaaactgcattatgaccaccaaaacctaaagaattagtaagtacatattgtaaatcttgttttcttcctacattaggaacatagtctaaatctagaccttcatctggtgtattatatcctattgttggtggtataaatccatcttctaaagcttttgcacatataattgcttcaatagcacctgctgcacctaaaagatgtcctgtcattgacttagttgatgacactggaatctttgtatcttctccaaacacattcttaattgcatttgtttcaaatttatcgtttaattgagtcgatgttccatgagcatttatatatgaaacttcttctggattaattccaccttcatttaatgcatctctaattgcctttgaagctccacttccatctggaataggagatgtaatatgatatgcatcacatgttgaaccatatcctaaaacttctgcaattatatttgctcctcttttttctgcatgctctaatgattctaatactaaaacaccagcgccttcacccataacaaatccacttctatctttatcaaatggtatagatgcttttttaggatcattatttgaatttaatgctttcattccattaaatccgcccattccaatttttgttataggcgcttctgatccacctgcaaccataacatctgcatatccatgtttaatcattctaaatgcatcaccaatactatttgttccagttgcacatgctgttactactgatgtacatggacctttcaaaccatatttaattgcaatattacctgctacaagatttattattgccataggtataaagaaaggagatactctcttagatttacctgactctagttttgtacattctgtttcaatactttgaagtccaccaattccagaaccaacaattactccgattctttctaagtcttctttttctaaatctaatccagaattttcaatagcttcatgagctgctactaatccaaactgttcaaatctatctagtcttttacattcctttttacctactatagcttcaggatcaaaatttttaacttctcctgctacttttacatcaacagactctttatcaattattgttatataatctattccaagttttccttctttggcattattccaaaatgtattaacatcatttccaataggagttactgctcccatacctgttataacaactcttctatccatattaattttcctccactacattaacattccaccatcaacatgaataacctggccagtaatataatctgaattttcacttgcaagaaaagcgactacattagcaacatcttcaggctttccaagttttttaagtggaatattcttctttatttcatctttatatttatctcctaaaacatcagtcatatcagtttcaataaatcctggtgctacagcatttacattgattcctcttgaaccgacctcttttgcaagggattttgtcattcctattacacctgctttagatgctgaataatttacctgccctgcatttcctgaaataccaacaaccgatgaaagatttatgatcttaccatacttttgtcttaccattacaggtgtaattgtttttaaacaattgaatacaccttttaaatttacatctataactgtatcaaaatcttcttctttcattctaagtattaaagtatctttagttatacctgcattattaaccataatatcaattgcaccaaatttctctttagctgttgaaacaagtgtttctacatcctcaagtttagaaatatcacctttaatacttatggcatcaacacccatatctttaacttgcttttcaacttctaaagcttcttgctcgctacttctataatttaaaaccaaattagctccaagggatgctaacttcaaagcaatagcttttcctattcctcttgatgcccctgttacaagtgcacatttaccctttagcataaatcttcctccttaataatttcctatacaatatctattttgtaaataataacttaacttaaaataattttactaataacataataattccaaattatatataaaaatatacctttatgaatcctataattatacattcagtactgaaatggtattatttaatgaattcacatcttcaacatttagcaatattgcttttctatctatttttttaacaaatcctcttaacgctttaccaggcccaacttcaataaatgtatcaacacctttttcaagcatatctcttatagtcttttcaaaaagaactgatgatctgatatgctttttcaaaagatcccttatgtcatcattttcttcatataaagttccttttacatttgaatatacttcttttttaagaggtttgatatttgcttttttaattgtattataaaattcctcacttgcttcttttaaaagtgaactatggaacggaccacttacattaagcataattcctaatccacctaattcttttgcaattttaacagcttcttcaactgctttaaattctcctgacactgaaacctgaccaggacaattaaaattcgcaccttcgattattccaaattttcttgatctttgtaataattcttctaacttttcatcatttaattttaaaattgctgccattgttccaagtccttctggcaacgcatttcccattattcttcctcgttccttaacaagacgtaatccatcttctagcgataatgctccaccatttataagagctgcgtattcaccaagacttaatcctgcagcatattctgcatctattccatttatctctaatgcttttaacgccataagtgatgcaaccaatattgttggttgagcattttcagtttcagtaagaaggtcctctggaccttcaaacatcatcttctttaatggcatttttaaaatttcttcactagagtctaatatttctttacattctggtatgttttcatataattcctttgccattccaacggtctgaacaccttgacctggaaaaagaaatgctatttttctactattcatctctgcctccaaaaagcttaaatctttcctttgcttctgtaaataattcttctattatttccttagcagtctgttccttattaacaagtcctgcaatctgtcctgacatgactgaaccattatctacatcaccatcaacaacggcctttcttaatgcacctacacctaattgttctaattcttctaaacttgcaccgtctttttccatttttatataagttcttgcaagcttatttcttagaactcttacaggatgacctgttggtcttccagtaacttctgtatctatatctttagcttttagcactttatctttgtaattttgatgtactgtgcattcttttgctacaagaaatcttgtaccaatctgaatgccttctgatccaagcataaatgatgctgcaacacctcttccatcaccaataccaccagctgctataacaggaatgcttacggcatcaacaacttgtggtactaatgccatagtagtcaactgaccaacatggcctccagattcagttccttctgcaataattgcatctgcacctgatttttccattctttttgcaagagctactgaggcaactactggaataacttttatgtcgtgttctttccatttagccatatactttcctggacttccagcccctgttgttacaacttttatgccttcttcacaaactaaatctgcaatttcctctgcattttctgacattaacattatatttacaccaaaaggcttgtctgtgatctttttagcttccctaatttgttctctgacccattctgttggcgctgctccagttattattccaagtccgcccgcttcacttacagcagctgctagcgatgcatcggcaattctggccataccaccttgaaagataggatattctattttcaaaagttcgcatactctatttttctccataagaaattcccctgccatcatcaaataaacttttagtttctctgattgtgctgataatttaaatatctatattgaaatactttttactattaattttctttatgtgattttacatattctactgcatcatttatagtctttaaattttctacttcttctatttgaatttcatacttttcttcaagttcaattactatttggaataaatctaaagaatctgctcctaattcatcgaatgttgtttctaaagtaacttcttccttttcaattcctaattgttcacaaataacttctctaatttcttcaaataacataatatatacctccaaaaattttcatattttttattttaaagacaattcattttgatattgtctaaaatttacttattttaatattaaaattacattttttaccattctatcatagtggctgcatatgtcaagcctccaccaaaggctacaagtataaacttatcacctttttttaacattcctttttcatacatttcatttaatgcaataggaactgaagctgatgacgtatttccatatctctcaagattaatataaaatttatctaaatcagtatgtagcttcttagctgctgattgtattattctaacattagcttgatgtggtactatatacttaatatcatccatagaaagtcctgtttcatctaaaactttgtttactgaatccgcaagtgcatttactgcaaattttaatacatctccaccattcatatatatatgtctatctctttcaacagactcttttgaaaatggagtattaaaatcagcagctcctattgttaatgcatcaccttttttaccttctgattttaaatatgattttattattcctggttcttcagttctttttaaaactgcagcaccagctccatcaccaaataaaatacatgttgatctatctttccaatttataacctttgataaagtctctgaaccaattataagagcatttttataattcattgatttcatcatgctttgtgctatttccattgcataaacaaatccagaacatgctacattaatatcaaagcaagccgcatcatctgcacctattttactttgtacaagacatgcaactgaaggtataaacatatctggacttattgttgcaactataatcaaatcaacatctcttggatcaacatctgctctttctaaagcacacaatgcagcttttgaagccatatctgatgtatcttcaccttgagaaattcttctttctcttattccagttctcttcataatccattcatcattagtttctacaagttcacttatatcatcatttgtcactgccaaagaaggtacatatgctcctgtccctgcaattccaacattactcatcgtttttctcctttataattacaattcatatttttccttaaaaaatttattaatcttcgttagagaatgaattaaaacttcttcttctttatcatttaatccatctacagctgtattaaccatatctttatgaaatttatcatgcagcctataagcaagtttgccttttttagtcagcttaattaaaacaactcttctatcttcctctattctttttctttcaacatattccttttttataagtttgttaattgctgttgtcaaagttccaactgttatttttaggttttgtgcaacttcagacatacttttctgatcatacattccaattgcctcaagtgtatgaatttcagttatagataaatccgaaatcggtccatcttttaaactctgttcttctatttgtaaaacatcattaaacaattctaccaataattcattgataataactgtagatttgctcattaatttaaccctcccacatataaatgaaagtttatcacttatcgtcataaatacgtatttattttgtactttaagtttaaaatactttgataatcaaaatatactacaatcaaaataaattgtcaataaattcttaaataatactaagcttttatttttcgagcccatatgatataatttatgaaaatataatattttattgttatattattaatctaaaggaggtgaaaactgttgctttaaatatttaaggatatttaatagcaatagtacatgctatgattagaaagcttattttaacaactgttttaatgctaagcgtttttacaatagtttcttgtggatctaagaagaaaactgaatctgattctaatactccaccagttactgattcatcgtcttcttcatctacaaatactgaatcaaacaaaaatgatgatgacaaaaaaaatgaaactgaaaacaaaagcgaaacagaaagcaaacctcaatctaacgcaaaagacactgatagtaaaattaaattctctatttataaaatagatgaaaattctttagaacctaatgaagttagtagcatttctttagattcaagtctaagtttaaatgataaattaaatcaattatcaaatgcagtatcaaaaactaactttgatggtcttactcttaaagtaaaatctattgatactataaatggtaaaaaagttgctactattaatcttgttgattctggagataagacatgggttcctaaattccaaggttcaactggaggacaggtgacagcaaatactttaatagaaaattttcttcagtcaaataataagtcaaatgttgattggattgatggtgtaaaattcttatacaacaatgaaactatagaatatgatcatgtatctgaattatctgaagttcattataaataaagtattcagaatacaattctattttaaagatgtcgattttcgacatctttttattatataaaaagtatcttttaaccaaactttttcttatttttaacactatgtttgttctatttctaaattaaattttttgtatatttaagcaaaaaactgcattgatatttattcacacaaacatcaacgcagtcttaattatacaattattcatatcatccacaatatcactgaaaatacaataaacattatacctaatgaaattaatttacataacatagaaaaagcaatttgtttttctgcaagctccacatattcaaggtcatttcttgtataagccagcataaccttatcccctattttataacttctgtcattttctgaaatatcatatgttattattctaatttcattattttcatctacaaaccttattacaggtctagatacggttatataaactatctgtttatcttcattaatatatgatgacataccctttttaaaatctattatttcaccttcagcctttataccatatttaatcagttttatcttatccaaaaaaaccataattccaattactatgaatgttatccctatggacattaacaaaatactaaccatatacattcctcctatttatgtatatgaaatatctatgattcttgttaataaattgatactttattctatttcctatactccataaattttttatattcttctaatttccttattggatctaattccgagtctttcttcatgtaatcaaaaaacagttcatctaattctatactcctttttacatcataaaaggcttcttcatttttatctatatgaacattaaaacatgccctgttataatataaaaatccttgttcttcattttctttaattccttcatttataatatgaattgctttttcatattctttattttctttatacataactgctaaattcaaaaaactatatgggtatttaggatttacttctatggattttttataatattccttactttcttctactctattaagcttgtttagtattacacccttattaaataatattttataattatttttatctatatctaaagctttttctatatattccaatgctttttcatattctttttgttcttcataaatacatgataaattagcataagcccaaagttcattcggattaatatctattgactttttataattgtgtatagcattctctctatcatcccaaatatcataaatattagccaaaaagaaatatgctttatcataattaggatttttttctatagccttttcataatatttttttgctgttcctaattcatcattatcatcatatataatagccaatccataataagccctcgcctcatctttatctaattcaattacttcaaagtatttttcttccgcttcacttttaagcccaatctcatcatatataagagccatatctattagtagttctatatcctttttcccaatttctagattatacgcctttttataaaaagacaaagcttttaataaattattttcagttcttagatttctagccatatttaaataattattgtataaataatttttattttgcattcttgcatcctcaccaaatcttttataataactaatatattatatcactaatgaccttaataaaaaatcatccataataaaatgtctatacacaaatattctttacatgtgtatagacatttcaattgaaaatatattttaatagtcctcatattttttatgttcttctgcttcctttttcttttctttaactcttttaaataccgtatatacaagaagtcctacagatacaatgattacagatccatatacaaatagtatcatccctgcaataaacatatacttgcctattcctctataactacagctgtaccataagcaaccatttctgcagcaccctgtgcaatagctgatgatgttaatctcatcccaactactgcatttgctccaatagaagtcgcttcatcaatcattcttcctatggctatttttcttgcttctgtaagcatttcattataaccatccatttctccaccaactatatttttaaatcctgccataatatcacgacctatgttcttgcatcttacagtacttcctttaactaaaccctttacctcttttatctctttccctggtacactatctattgtcaaaattatcatctacactcacctctacaatttgattattaaatcataatgtaataatttttacattataatattaattatatactattttatcaaaattattataatcttaataagtgtatacctctattacggttactttataacttatattgaataaatatctgaaaattccctttgtatcttttcttcatcactttcaacaattctcttactataaaattccatgtcatctaatacttctactggaagacatattataacttctgttccttcaccttcgttacttattatttttatctttccattatgtagctcaacaaagcactttactaaatacaatcccactcctgatccttcacattctctagataaagaattatcaacttgtccaaagcgttcaaagataacatccagtttattcctaggaatccctcttccttcatcttttacattaataaatacataatcctcctcagaatttaaatcaatttggattttttgttttttatcaccgaattttattgcattagatattagatttaataatattcgtttcattacttctttatcaaatgccattaatttttcttcaacatttgtatcaaatattaattcaatatttttatcatgtatatattgtgctgttttttgtattatactttcaacagcatctacaatatcagcattttccttactgattttcatttcaccagcttccaaccttgtagcatccacaaaattattaattaaacgtatcattctaagacagttttgtttcatgttttttatatatactctatctctttcaacactatctgaattatatttttgaatatttaaatctatagcttggattgcagaatacataactgttattggtgttttaagttcatgagacatattaatgaaaaagcttctaatcaacatattgaattcttttgtctcatttaatatcttaatatttttttccatatcaagctttaagctttctattttcttctcgtttgtcacatctgttaagactgtcaaaatcgcactttcttctttataaagaaaaaaagatgatgtattgctaactggtataaccttaccaaacatatcaataattgtttcttcttcaataacctttgacatatgctctttctctattttttggtatttactatttatatattcacgttgcttttcagtataaaattcacaaattgtctttacattaaagtcatctatataatcataccctaataaattactagcacttctattagcatatagtatttttccatctttatgtacaataactgcatttattgaattttcaaataatatatcataacaagtttcattatttactagtattttttgtatttcttttctttgcttgattttttcttcaagtttgctatttaatacatttaatttattttcttttttcctatcttcttcagataccaaatcaacataatatccaaaaatccatcctattactataaatatccctgtcattattatatcttgttgaaatatcatgtttattccatcttttataggtgcatacaataaatctgtactgagtatggctattgatgaaaataatgaagttatcataccgtatttggatccatattgaattgtgctcgataatataagtaataaaaaaatatacttatattcattggtatatgttacaaaaaaatgtactggtaaagatataaataatatacataatatattttctataagccattttaatttgaatacattatgatacatctctactttaggagacattaatatacacagcatataaactactattgtaatcagtaagaaaaacattgctgtgaatatatttattttaccaacaacctccatccttgtattcatccaatattctgataaatgcatatacactataataacagtaaaaattatcattgatacttttattatcagcagcatatcagatagtttctttttattattttccaaaatcacacttctctttcatatttaattttaataaaatcacttaacataagtttagtaatttatattgtttaatcctttttcaattattcttataattttcacccgattcctatttattgtatttattacccataatcaaactattctataaatgatcactattctgattttattctacattttaaaatcacggcagataaaaataaaaagattaatgatggaattcccaatgaaccctttatataaatttcattatcttcccaaaatttattatctaaaataattaaaataattaaatttaaaatttcagaaaactctaaaatagtgaatgtaattaacgtattcttaatagatttaatcaatggtattccaagtatagtcattatacttataaaggtaattaaattgataacaatatgaactccataatatattggaagtagacgcactacatatgttaatacagataaaagtatactgacaatataatagttagtattatttatactccttttggataaagtataaatcataaagtttacaataaacacttccactatacatcttaaaaataaatatcccccatcaatatcaaccatattattttcctcatttcgtttattcaaaactttatgctaaatttaaatcaaccacaccttaaatctattcttttttcgctcaaaaatacatttatatgaaaatatatatttttattctatttgttacataatatttataattaaacattttatcttaaattcctcttttttgttaatattattatatattttttatttaatacgtatatgaggagtattaatatgttatatacgtttttatttcgatacatttacttattttctttagtttaaaatggaagtttttttttatttatccataaatttaaattttagcaatataaaaagacaggtttagttaaataaaccaaacccgtttcttataatttattctattatttaaatatgcctatatcagttctacaataggaatctttgaaattaacatatttaatattgtcataagcttcttttcttgcttcttcaatatcttttccacatcctataactgataaaactcttcctccatttgtctttaatactccgtcttcgaatttagctccagctaagaatactttatcttttaccttttcatctattgttatttcatatccctttacgaaatctcctggatatccttttgatgctaaaacaacatttatgcataccccatctttccacttaacagtagtcttatctaactcttctctaagtgctgcttctataagttcaacaagatcactttccattaaataaagaactgattgagtttcaggatctcccattcttacgttgtattctaaaagataaactccttttttagttatcattattccaaagaatattatccctttaaaatcaaaaccttcttcacgaattccataaagtgtttttgccataatattttcttcaaaatctttcattgcttcttctgtaatatatggattaggagccataacccccattcctccagtatttggtcccttaccaccatcaaagatctgtttatggtcttttcctgataggaatggaattattgtttttccatctgtaatagaaagtattgatgcttcaacaccttctagaaattcttcaattacgattttatttccagcacttccaaatttctcatcaaccatacattcattaaccgctacaactgcttcttctttattttcacatattataacacctttacctgcagcaaggccatctgcctttacaacggtaggatattcacatgtttcaagatacttcaaagcttcagaggcatctgtaaatgtagcatattctgcagtttttactccatactttttcataaaatcttttgaaaaactcttgcttccttcaagtcttgcaccattttctgctggtccaaagatttttaatccttccttcttgaatttattaactatcccattagttaaaggatcttctggtccaactacagttaaatcaatacattcttttttagcaaactttattaattcatccatatctgttatgttgatattttcacatttatctgcaattgcagtaccaccattacctggtgctacaaaaattttctctacttttctactttgagccattttccaagctaacgtatgctctcttccacctgaacctattaaaagaattttcattacaatcatctcccatatatgaaattgacaatggacaatagaaaatcagcattgacaaaaccattttacattgatttttaatactgtaattttctatgccattgtcctttaaattaattcaataaagaaatccacctagaactccaattttaataattaactcattctagtgtttgaaatgtctataaccagtaaatatcattgctattccatgttcattacaagcatctattgattcctggtctctcatagatcctcccggttgaactatagcttttattccatatttagcagcttcatcaacaacatctctaaatgggaaaaatgcatccgaagctaaaatagttgctcctttacctctctttaaggcatcttcagttggccatattctattaacctgacctcctcctattcctacagctacaccattatgtgctgtaacaatagcattggattttacatatttcactactttcattccaaataataagtctttcatttcttcatctgtaggtactttttcagtaacaacttttatttcatcaacaagttttctatcttcttcttgaactaacattgcgccatcaacagtaaccatatatttttcagcctttggaacattattaaacttaagtactcttaaatttttcttgctctttaatacttctaaagcatcatcatcataatctggtgctgctactacttctaagaaaatcttcaccatttcttcagcagtctttttatcaacttttctgttgaatcctataattccaccaaatatagaagttggatcaacctcatacgccttcatatatgcttcatatgaatcatttcctacagctactccacaaggtgtattatgttttaatgcacaacatgctggctcatcaaattcattagcacacttccatgctatatcaacatctttgaaattattgtatgataattctttaccatttaacgtttcaaaagtattcatagctccatcaagcattgttgaagaatatacagccgcactttggtgtgaattttcaccatatcttaagctctgcattctcttatatgatactgaaagatattcaggatattcttcttcatcatcagcaagcataaaattagatatagctgcatcataagcactcataagattaaatacttttcctgctaatttcttcttaaatttatagcttacttcattatgttcatttatttcttccataactttagcataatcatttttgtttgaaattacaacaacatcttggaaatttttagctgccgctctaagcatggttggtccgccaatatcaataaattcaaccttttcttcaaaagtcaaatcttcttttactttttcaaagaaaggataaagatttacaacaacataatctattgtgtgaatgtttctttcctttaatgtattcatatgttcttcatcatctctgattgctaatatcccagcatgtactaatggatgaagtgtctttactcttccatctaacatttctggaaagttagtaacttcatttatttcaattacatctattccattttcttttaaatatctataagttccacctgttgatacaatttcaacatcttttgacactaaaaacttagcgaaatctaaaactccatccttatcaaatacgcttattaaagctctcttcttcatgaaaaaccacctttcatcaattgacaattgacagttgacaattaatgatgaaatctttatttgattatttatttttaaagaaatacatcattaattataaagtcataccgtattcacattttcaattaaattactattcttatttttttaatattaaaattttatcttaatgtatacatgctaatgtagcttagcttttccatttataaattcaactttaccttcacttattaatttgatagcttctggtaaaagaatatgttctttttcaagtattctcttttgaagactttctgcattatcttcaaaatatactggaacaacgtcctgaagaagtattgctcctccatctacatccttatttacaaaatgaacagtacaccctgaatacttgacaccactattaacagctgcttcatgaacctttaatccatacattcctggtccacaaaaagaaggaattaacgatggatgaatatttattattctattttcaaattcatcaagaattttaccatctaatatagataaaaatcctgctagtactattaagtcaaccttatcttctactaactctaaaattttatcacttgctttttcaccatattcttttctagatacaacatgtgtttctataccatgatttttagctctttcaatagcaaaaatcccatctttgcttgcaataagcatctctattttcacatttaaatatttgctttcaactgcatctattatggactggaagtctgtaccaccaccagaagctaaaactgctattttaaacaaacaccttcacctccagatgtcacatgacctatttcataagccttttctcccatttcacctaaagcctttattatagaagtaacatctttttcatcaacagctaacacaaaccctattcccatattaaatgtattgtacatgtgatctttatctacacctttttcaattattctttcaaatattccaggtaatggatatgagtttttatttattactgctgtaaattctcctccattgaacattcttggtacattttcaataaatccaccaccagtaacatgagccattccttttatttcgtaactttctaataacttaagtactggcttaacatatatttttgttggagttaatagtgttttccatactggttcaccattaaaatcttcatttaaatcagggaataactttctaactaatgaataaccattagagtgaattccagaagaagctatacctataagcttatctccctcttttattttgcttccattaattattttatctttatcagcaatacctacagcaaatcctgccatatcatattcaccatctgaataaaatcctggcatttctgctgtttctccaccaattaatgcacaatcagaatcaaggcatccatctgcaatacctttaactaaatctgaagaaacttcagcttcaagcttaccacatgcaatatagtctaagaaaaataatggtttagctccatgacataatatatcatttacacacatagcaacacagtcaatacctactgtatcatatttattatttttgaaagcaatttctaattttgttcctacaccatcagttcctgatactaatactggtttttcgtatcctgatggaagttctaccataccagcaaagcttccaaggccattaagaacatattcactcattgttttagcagcatattcttttattagctttacacttctgtatccttcttctatattaactcctgcttctttatatgatgttaccattaatatacactccctttattcagtttacagttttcagtcaacagctattaattatccaaactgaccataactgctacttgattaactatttttattctgtttctattggtgtagccacaggataaaccccattaaagcatcccatacaaaaaccttcttttcctgcgcagcttatctttacgccttcttcacttaaatatcctaaataatcagcaccaattatatctcttatttcttcaacactattgttagctgctattaattcacttctatacggtgtatctataccgaaataacatgggtatttaacacttggagatgctattaaaaaattaatttctttaacgccagcttttctaagtgaatctattaaatgctttgaagttgtacctcttacaattgaatcatctataagaacaactcttttaccttcaagatttatctttaatggatttagtttaacagctactgctctttctcttatttcctgagaaggagatataaatgttcttccaacatatctattcttaataaatcctgtatcatatggaattcctgatgcttttgcatatcctatagctgctggtatacctgaatctggcactgcaataacaatatctgcatcaactggatgttctttgtaaagctgttctcctgctcttacccttgatgtatgaacatctaatccatcaatttttgaatctggtcttgcaaaatatatatattcaaatgcacaagtctgacatacagtattttcagaatatctataagattctattccattttcatctataataactatttcccctggttcaatatctcttacaagttcagcacctattgcatctaaagcgcaactttctgatgttaatatataaccctcatcaatttttccaagtgaaagtggtcttattccatgaggatcccttgcccctattaacttattttgtgacattattgttaatgcaaatgaacctcttatagctgacattgcatcaacaactgcttttgctaagccttttttagcacttcttgctataagacatgctattacttctgaatcagttgaagtgtgaaaaatctgtcctgcatcttctaaaagttcctttataacatcatcattaactagatttccgttatgagccatagctattgatcctattttagaagtagtaactattggctgagcattttcaattccctttccacctgcagttgaatatctcacatgaccaactgcaatgtgtccttttagtttttgaagatcatcctctttaaaggcatctgtaattaatcctaaacctttatgtacttctattttttctccatctgctactgctattccagcactttcttgtcctctgtgttgtagagcataaagaccgtaataagtcatagatgctacatcgataggcttatttgcataaacaccaaaaacaccacattcatctttaaatttatctaagctagggtccataattaattcaaaatctgattttgtcatgtatacaatcctttcactctaaaatattgttaattgactattaagatgattcaatggacatttatatgtccattgaatacagcaattatataattgtcaattatgtattatttagaaattctctttaatatttcaatataagcgtcttcaacatttcctaaatctcttctgaatctatccttatcaagtttttcacctgtagttgcatcccagaatctacaagtatctggtgagatttcatcagctaatactatttctccgtctgctgtcttaccaaattcaattttaaaatcaattaagtttatattttcttttgcaaatgcattctttaatatattgttgatttttgcagtcatttctaaaataatatctatttcttcaaaagtagctgctccgattgcaactgcatgatagctgtttattaatggatctcctaatgaatcatctttataagaaaattcaaatacagtagtctttaaagctgttccttcttcaagacctaatcttttagccatacttccagctgcaacatttcttacaattacttcaagaggtactatttcaacctttttacataattgttctctatcgtttaacttcttaataaaatgagttttgattccttgagcttctaattgttcaaaaagtattgaagttatattgttgttcataactcctttatcgtgaatttgccctttcttttcaccattaaaagcagttgcatcatctttgtagtatacaattacttcatcatctttatcagttctaaatatttgttttgcttttccttcatataacatttctaatttttccattataattccactccttcagcattatcttctataaattttttcttcatatttactctatattcttttaatttatttttaatttcttcattatttacagaaagcatttgaacagctaacatacctgcattgtaactattatttattccaacagttgcaactggtattgattttggcatctgcactattgaatatagtgcatcaacaccttcaagagcagccttaactggtattccaattacaggtaatatagtttttgaggctataactcctggtaaatgtgcagcaagacctgcacctgctataataactttacatccttgtctttctacttcttctaatgtttcttctaatttttctggtactctatgagctgataatacaaatgctttataagttattccgaattcttttaatgcatttgctgctcctttcattatttctgtatcagatttacttccaaaaaatattgctacttccattttagaaaagcctcctaatatttaatcaatattttaaattattatcatttatttcacttagctgacactggattaatgtcagctaagtgcttgaaattaagttatagatttgagctctcactttttaagaaaactcgactcacattcgttcgctgagtaagtaattcacaccaaatcctcttattattgaagttaacatcaaatagatgttaactaagttcgattaaccaaatcaaagatttgggctctcacttatctacttaaagtacttaactccagattcaaatatcttttgatcatagtttcctggaatgttcttgaatatatcttctccacttctttcactatgagccatcttacctaatactcttccatcaggacttgttataccttcaattccatacattgatccatttggattatatggcatatctaatgaaacatttccttctaagtcaacatactgtgttgctacttgtccatttgctattaattcctttattaagctttctggtgcaacaaatcttccttcaccatgagaaatagctactgagtgtatatctcctgaatttacttcactaaaccatggcgatttatttgaagtaactcttgttcttatgattgaactcatatgtctgtttatattattataagttaatgttgccatatcttctttaatatctactatttcaccatatggtactaatcctaatttaattaacgcttggaagccgttacatataccaagagctaatccatctctatttttaagaagttccattacttcataagctatcttttcatttcttaaagcatttgctataaacttacctgatccatctggctcatctcccgctgagaatccacctggtaccataagtatctgagctgttgaaatttctttagctaatctatctattgattcatttaaagcatccttagttatatttctaaatacaacttgagtaacatctgcgccagcatttctaaatgctctttcacaatcatactcacagttatttcctgggaatactggaattacaactttaggtcttgctatcttaaccttaggtgaagcatatgatttagcttcaaacaatggtgtttcaatttttttatttacttctttagtttctattggatatacagacttaagcttttcttcgtaatttttttctaatgaacaaatatcaaatttgaaatcatattctctgcttgttattatactttcagctattgtcttaccaactactttatattctgattcattaaatgcttcttcaacattaacatcttcgcatacttctgctagtatacatccataattaaatccaaataattcttcttttgttaaattttcaatttctgcaccaattctatttccaagagccatcttagttatacattcagaaacccctccgaatttaacacttgaagctgaaataactttttcatcttgaatcaagctgtataaaacatctaagttctttttatacttatccatgttaattgttccatcactacatgtttccacagtaagtaatattaattttgaaccaacattcttaaattctggtgaaataatctttttagctttttcaacaccaactgcaaaagaaactaatgttggtggtacatctaaatctccaaagcttcctgacattgaatctttaccaccaattgctgcaatttcaagagccatttgtgcttcataagctccaagtaatgctgcaaaaggcttgccccatctattgctatcttttccaagtttctcgaaatattcttggaatgtaagatgagcttttctaaaattaccacccatagctgcaagctttgtcacactttctattactgagtaataagccatatgatatggactccacattcctagctctggatttaatccaaatgtcataatagttgcatctttactttcaccattaggaacaacaatctttgcagccataccttcagctggtgttttagcatactttccaccaaatggcataagaactgttcctccacctattgtagcgtcaaatctttcacttaaaccttgttgtgatgcaacatttaatttctttaaattatttatccattcttctttaacatttatatctttaacattgtatggatacgctcctggagctttaacagttacttcagtcttttgagtagctccatttgtatctaggaacgttctctttaaatcaactatatttttccctctccagaaaagtctcaatctatctgtatcagtaacatttgcaactaacgtagcttctaaattttcttcatttgaaagtcttataaattcatctgcattttcttttgttactacaacagccattctctcttgagattctgaaactgcaagttctgttccgtctaaaccttcatattttttaggaaccttatctaaatctatatctaaccctctgcaaagttctccaattgcaactgaaactccaccagctccaaagtcattacatctctttatcatctttgcaacttttggatttctaaataatctttgaagttttctttctgttggtgcattacccttttgaacttctgcaccacattcattgatagaatctactgtatgttcttttgatgaaccagtagcaccaccaacaccgtctcttcctgttcttcctccaagaagtattattacatcacctaaagatggttcttcacgtacaacattttcttttggtgcagatgcaataactgctcctacttccattctttttgccgcataatttggatgataaacttcttgaacttgacctgttgcaagacctatttgattaccatatgaactatatccatgagctgcaccaagaactatctttctttgtggtaatttaccttccattgtatctttaattgcaactgttggatctgctgcacctgtaactctcattgcttggtatacataagttcttcctgaaagcggatctcttattgcaccaccaagacatgttgctgcaccaccaaatggttcaatttcagttggatggttatgagtttcatttttgaacattacaaggtaatcttccattcctttatcagtttcaaccttaacattaatagaacatgcatttatttcttctgatatgtctagatcgttaagctttcctctttttcttaactctttcattgcaattactgcaatatccataagagttttttctttatgcttttcgccataaacatattctcttgattttaaatattcttcgtaactctttttgacaggctctgtataagtaccttcctcaatatgtatatcttctaaaactgttgagaatgttgtgtgtctgcaatgatctgaccaataggtatctataacttttatttctgttatgcttggatcacgtttttcttctttaaaatattcttgaatcatagcaatatcatctatactcattgctaatcctaaatcattatgaaactcttctagttccgctattgttttcttggtaaatccgtttaagacttgaacgtctttaggcatgtttgaaattgatgcaagttctttgctttcaatatcaacttctcttgaatcaacaggattgatataatatttcttaattttatctaaatcatttttagaaatttttccttttaaaataactattttagctgactttatttcaactttatcttcagcgcttaaaagtgctaaacattcagaagctgaatctgctctttgatcatattgacctggtagaaattcaactccaaaagctatttctccttcattaattggtaatttttcttcatagattttatcaaccgtaagttctgcaaatattgtgtgtaatgatttcttataatactcttctgaaacttcagaaattaagtacttattaacaattcttacatcttcaagatttgcaagtcctaaattttctttaaaatctcttaataaactttgagcttcaacattaaatccgctctttttttccacaaatacgcttctaatatttgacatcttaattcctccaaaaatattatgagatttagcttatcaccacatcattgcgatgcgaatatttttctattaattatttttaactttcgcttttctaacttaagattatcacctaacacggatgatgtcaactcaaattatctatttttttattattttttggaatttaacgaattatataattgtttatttttattattattcgttttattattttttctccttacattttctttacataagtttaatttaaaattaattttattttaaacttttttagcattcgactctatattaaaacttactaatttacacctgttacttttatttattcttaattttaatcaaatagagatatatttgtatttttaacataaaaataaagatgaatttatttttataaatccaccttcattcataaatatacgaaaataatattttgaaacaaatttatctacaagatatatatcattttattatattgccttattactaactaaatttgaattagttaattttgcactacatggagctgtcatagaaaacgggtctaatatttcttcaagctgtgctcttgataaaattttctcttcaagaactatttgccttatagaaactcctgtattcaaagattttttagctataatagaagaattcttatagccaatatatgggcataaggcagtaacaattccaacactattctccaccaattccttgcatctttctttatttgcagtaatccctttaatgcagttatctattaatgtggttgaagcattttttaaagtttctatagattcaaaaagattgtaaaataaaactggttcaaatgcattaagctctaattgtcctgattctgctgccatggttattgtaaaatcatttcctatgatattaaatgcaacttgtgaaacaacttcaggtattacaggatttacttttcccggcattattgatgaaccattctgcattgctggaagattaatttctgaaatcccagtcttaggtccacttgataataatctcaaatcatttgccatttttgaaagattaactgcacatgtttttaatactcctgatacagttacaaaaccatctaaattttgtgttgcatctatcaaatctttagcttgaattacttcaaagccacatactttcctaatattttctattatattttctaaatattcagagcttgcattaatagatgtccctatagctgttgctcctatatttaaaacaagcatttcttcacttactttttttaaacgatctacatctcgttttatcatagaagcaaatgcatgaaatgattgtccaagtcttattggaacagcgtcttgcaattgagttcttcccatctttataacatcattaaactctaaggctttaagttccaattctttataaagcctttgaagttcagatactgtttctggcagcattttcaatacacttagctttcctgctgttggaaaaacatcatttgttgattgtgccatattaacatcatcatttggatgaattatactatagtcgccctttttgcctcctaaaagctcaattgcacgattagcaataacttcatttgcattcatatttgctgatgttccagcacctccttgaataggatctaatataaactgttcatgaagctttccacaaattatttcatcacaagcatttataatagcatttgctacatgtggttttaaatatccagcatttttattagtaatagctgctgctttttttatttcagcaagacttactattagcttttcatgaatacatctatctgttattgggaaatttcttttagctcttaatgtttgcacaccataataagcttcttctggcacttccatgcttccaattgaatcaaactctattcttgttttcattatcaactcaccattccttttttaatattcgtattttataaataattcttattttactaactaaatttaccttaatgtttattattataattaatattctaaagtcggatattttaatatttttatattttttcctattctttcctttcgacattcaaagcttatcatcctttgattttaaagtaaatacaatttctacttttacaaataaaacaatttttttctatatataaacttaattataaatactttctttttgtaactccttaataaattaaagttactaaattctaataccgccagaattaatacgtatatttatattaataacatatttaaagttcgtatctagtattgttttattatttgtatagtcaaacgtaaaaaaatgacagcgcatttaatatctacactgtcatttaatacctatgtttaattttgattaattacttctatagccatattaatcatatcttctttatctaattcattataattagaattcaaaatacaatatgatattccatcttcataccatattacagcttgattttgactaacttctatttcattacttccatatcctatctgaagcagacccttattttctaattctctttcttcttctgatggttcatacccctctggtaccgccttatattgattacttgtatattctattgttataccattataattttctgtagctacattatttaatttattctcatctatatatttctgatctatcttttctgctgacatagttaaatactgattattttcagctccatcctttgcatactgaaaatcagcacctttaaatttatcaacagcatctcctttttcattttttatttcattattagaataattaaatgtttcaaacttaaacccattgccaaatgactcaatatacttaggagtaaatccaaccttgtcttgaacgatttcttttgttggaaaagtctttatctcagtcaactttgaagatgaaccataccatcctgaaaggttagttgctgccacacacgttactgttgtaagaacacaaataactcctgcaattaatgctgttttgggtcttaaaaatttatatttcatattaaaattcctcttttcttcttttattaaaatttcattcctaactttaaaaaacagatcttcagatgttgaaactttgtaagcttcatttttcaaacattccttaatatttaaatcaaatttttcatcataactcttcataaaactccatactccttttctcttatatcctcacatttatcaaaatccattaaactctttttcaacttttttcttgcagtataaagtcgtgatttaacagttccctcaaagcactccattatttgtgcaatttcttttattgtaagttcattaaaataataaagaattatgaccattttttgttttatatcaagctcatcaattacctcatgcagaatatcaacttgctctttttttatatacttacttatagcctcacaatttgtttcataatctgctttttcaaaaatattatcaactggtactgatttcttttcttttttataatatttccatgcaattcgtgtaagtattttaaaaaaccaagatttaaattgttcttgcttttttaatgattttatttttgtataacatgttacaaaagcctcctgaacaatatcctcacttgtatgtttattacctataataagatatgaatatcttactgcttcatttttatatttttcaaaaataattgcaaaggcattcatatcaccagactggattttcataataagttctttttcatccaaatttctactagctcctttcttatcgatgcatctatatattagagctttcaactcatcaattggttcattaaaatttatataaatttcttcaaagcaaaagagtatcatccattattacagatgatactcttttattgttgacaaagttaaggaattttttatttcgcattcctatttatatattcagctttaatttttgaatacattatcttttgactgctatataaactataatatcctgattccatataacttactccacacgcaatcgcaaacaacactatattacctgctccaaaaagttcaatacttaatattatagaagttattaatgtatttactactccacaaaacagtgctacaagtcctaccgctgctccaaagcaaggatctaaacctaaaaacttacctacaacacaaccaaaagtcgctcctataaaaaatgttggtactatttctccacctttataacccacacttatagtaattgctgtaaaaattatttttaataaaaatgcttctggtttagctgtaccattcatagcatttaatataacatccatccctgcaccattataatctcttgttccaataataattgttaataaaactattactattcctcctataaacacacgtacataagcattagatattattttttttgatatattattgcttttatgtagcagattacaaaatataatacttactaccgcacataagcttccaagtatcattactttaactatatttatcaatgatatttcaggaattacatttaaattgaaacgaactggagcaagtccaaaataaattgatatataatatgcagtaacagaagatactatacatggtataaaagcagaataatgtattatacctatacttattacttccattgcaaaaaatgttgccgtaagaggagttccaaacaatgcagaaaacacactactcattccacataatgtaatcaaatgcatatccttctcgtcaagacctataagatttccaatttgggaacctatactccctccaagttgtaaagctgctccttctcgtcctgcagatccaccaaaaagatgtgtaattacagtccctaaaaaaataagaggagccattaaaaaaggtactttaccatcagttcttatagaattaataactaaatttgttcctggatctcctttcattcctttcttatacataaatactattaacaatcctccaaaaggaagcagatataaaatccatgaatgctctattctagtttttgttgcaagctcaacactcaaatgaaaaatactaccaactgcaccaccaacaacacctgtaataattgatataataatccacttaaaaaagacccataaatttaattgtacaattcttatttttctttttacttcttccaaattaaccataaagtaaaattcctctctttccttactaaaattttattttatagttactcagtcatatttttaactactaaatatctcttcataataatactaatacaaaaagactcagactaattaactgttctatgtatattatatgcttaaatatcaatcttgaaacttttaatttataagaacataaaaaagaccataagatattcttatggcctgaaattactactatctatcaaagcttctgttgtttctttgagcttttctagcttttctacattctggacatctaactggttcgttatcaaatcctttttctttaaagaattcttgttcacctactgtaaatatgaattccttaccacaatctttacatactaaagtcttatcttccattataaaaatcctccttatttcaaagattaacctgatactttaaacgatctctgaaacagaggcaaatttacgagtactgattaaatcttgaattatattacacttttagaatatcatactttatattaaaattcaacaaaattgttacaaattaaccctcaaatataagaccattttcaagctttcctgaattcatggaaactatcctatcacttacatttttagcaaaatccatgtcatgagttattatcatcatactcattcctttttcacttaaactcttaattaaatttgcaacttctccagtaagtccagggtcaagagctgatgttggttcatcaaaacaaattatttttggttctaaaactaaagctctccctatggccactctttgtttttgtcctcctgataattcatatggataattatcttttttttgatctaatcctaaaaagcctaaagtctcttctgctttttctattgcttcttttttcgacattccaagcactctctgtggtgcttcaattagattttctaaaacactcatatgagggaataaattaaaattctgaaataccaagcctatatcctttcgaatttccctaagtgtacttttatctacatatcttccattatcacataattttttcccatttatttcaatgtcaccagtatcacaatactccagggcatttatacatcttaaaagtgtggtttttccaccaccagaatgaccaactacaactagtatttcaccttttcctatttcaagatttacaccttttaaaacttctgtatttccaaaactttttgttatattcctaaccttaagcatattaacccctcctacttataatagtcatatttatattctaattttttcaacagcttgctcaatattcctataactattaagtaaacagcacccactaccaaaagaggtaataaagaaacatctctatttgatgcaatctttcctactttaagaagttcatccataccaacaatatagacaagagacgtatctttaaccaatgttgttatttcattagctactggtggaagtactgttttaaatgcctgtggtaatattattctaaagaaagtatctttaggtgtaattcctaaaacctctgctgcttcaatttgaccttcatcaatagattgtataccagctctgaaaatttcaccaaaataagctccataatttaatgtaaatgctattattgccgatggaaatctgtcaaatgtaatacccaccaatgggagaccaaaaaatataacgattatttgaagcaatagaggagtacctctcattataagaacatatgccccacttattttacgtaatattatagattttgatgttctcattaaccctacaattattccaagtggaatagataatactaatgtcaatataaagatttctaatgttacttttaacccttccaacacttggggcattaatcctaataaataattcaaatttactcctcctcgctcaatcttaacagagatttttcacattgttatatttaaatattatttaacaactatatcttcaccaaaccactttttagatatttcagctgcttgtccatctccaactacttcacttaatgctttgttaaatgcttcaacaaattttgtatcaccttttcttattccaacaccatattgttcatcaccaaaattttcagttaagattttatatttttcttctcctcttgctttaatatagtatcttgctaaaatttcatctacaactattgcatcaagtctctttgcttctaaatccatcaatgcttgattattatcttcaaaagttactaaatttccgccatcaaaagtagacattatatctccatcagcctctactgcatcaactgctgtagattgattctgtgccccaactttctttcctgcaagatccgcttttgaatttatagtcgagtccgctaacgttacgataatctgagtattatttaagtatggttttgaaaattcaactttttcttttctttcatcatttatagaatatccattccatattaaatcaatatttccaccattaagttcagtttctttcatactccagtcaatagcttgaaatttaacctttttatttaatttttccccaactgcttttgcaagatctatatcaaatccaacaagttctccgctttcgtctttaaatcccataggtacaaacgtatcatctaaaccaataataagttcatccttatctaaagtactccctgaagatgttttgcttgaacttccacatcctattacacttacccccatagctacaactatacctactactgctaaaccttttattaacttatttactttcattatttttcccccttgcttaatcgctttttctattcattactttaccacactaaagtaatatattcaagcatttttttcattttctttactattttataatttttattccaaattactaatttattaagctaactttataattttttattgtaatttttaaattttatcttcatctaagcatactttcatttcttttaataaatatatatgtataaaaccattgaataatataaaatactattcaatggttttatgttctttaactattcacctaacctatttattgcattttcaagattactcatatgggattttaattgatctactgaatcactagctttttcttcatttataggactttctatattatccactctatcttttgtatcctccgttttttctttaagttcatcaattttttcatttaactcatcaattttatctactatctcttcacttctaccttcgatatctgcattatcaatagtatctttaagttcatccatcttatcattaagatcatcaatcatctcttgagtatcactatcaacctcatctaacttactactcatctcagaaggagttgtttttagcttatccattaattcggatactttttctgattcaaatatctcatcaactttgtcacctgatggtgcttcatccgtattttcattaacttttattatataatcatcttttaaatcacatcctgttatagaaaatgacattgttagcactattcccattataaacaaatttcttaatttcatcatttcacctcagctattttttgtactgacaagtatatattaatacttttttcttcattatgcaattaaacaataaaataaaaatagcaagactacttactttaaatataagtaatcctgccaaaactcataaatattttatataatgaaactttatagttttataaagcctcttccaattcacctgaaaactcatcttcaaaaacttctatatcaaatgcattttcctgctttgcaactattgttgtacaaacagcatcccctgttatatttacagccgttcttgtcatgtcaagaattctatctattcccattattaatccaataccttcaactggtaatcctactgaattaaataccatagataaagttataagtcctacccctggcactccagctgttcctatagatgccaatgtcgctgttaatattactgtaagatatgcattaagtccaagttctattccaaatgcctgggatacaaatacaaccgcaactccttgcattattgcagtaccatccatatttatggttgctccaagaggaattgtaaacgaagaaatcttttcagatactcctattttttcttttaatgtttcaattgaaagtggtattgttgcattagatgttgctgtggaaaatgcaaagctcattaccggtgcaaacttctttaagaattttcttggacttaagtttgcaaaccctttaagcatggacatataagtcacaagacattgcactgccaacgcaagcattactgcaaaaatatattttagcattggtgtaaatgcattccaccctatagttgaaaaagtagtagctatcagacaaaaaactccaattggagctgctttcataactatcattgtcatcttcatcataatttcattacattgttcaaaaaatttcccaaccaattcggttttctttccaagtgtagctagtattattccaattaatatagcaaacactattatctgaagcatgtttccacttgacaatgcttccactggattggtaggtattatgtctaaaagtacatctgctaatggtttagactctgctacctttgtttctgctatttgaatactagacatatcaagtcctattcctggatttattattttcccaataccaattgctattgaaatagcaagtgctgtagtaactatataaaatcccatagtctttataccaactctaccaagctttttagtatctccaatagccatacttccgcacactagtgaacagaacactaacggaaccactagcatctgcattgctcttaaaaatcccttacctaaaaccttaaatactccattaattaagaattcatctcttatagtacctgctggaacaaatttatatagaaaaattccacataatgcccctaatattaatccaataaatacttttgtagtcaaacctaatttttttttcatttattcgcccccatatttataaaatgcaatttatttttattttcctgcaattgataatatatttataccatatgatttaattttttacaatacatttttcattacaatatcatgactagagtcatctataagtataaaatgctttgttttttatcatttttttttgcaataatatattaatttaccttcattttataatattaatatagtgctttgtaaaaactaactatatcattcaaacaaaaataaactggtatacccttctgtacaccagtttatctttatcttctactgattatttttttatatcctttaaagtatcagctattgctgcaatgcttcctaatgatgataatgtttcatttggtaaaataagcttatttgctggattgttagccatttctttaagtgcttcaacctgttttaatgcaataactctttcatctgttcctgattcaattattgcttgatttactttcattattgcttgtgcttcagctattgctatttgttctatagctttagctttaccttctgcttctaaaagttgtgattctctaagaccttcagctcttcttatattagcttctttttctgcttctgcctttaatatttgagatcttttttcaccttcagctttttcaacctgagattgtcttaaaccttcagcttgaagtatcattgctcttttatctctttctgctttcatttgtttttccatagcttgttgtatttctgcaggtggtattatgttctttatttctactgataatatttttattccataagcatctgttatttcatcaattatacttaaaagatcctgatttatcttatctctaccagataaaacttcatctaatgacatattaccaagaatatttcttatatttgttgttgctgaataaacaatacctgatttataatcctctatgttataaacagcatcttttgcatttataaccttaaagaatattacgttgtcaacacttaattttacattatcacgagttattatattttgtggtggtacatctaatatctgctgtttagtagaaatctttcttcttacataatcaacaaatggaattataaaatgccaacccggttctaaaaccctgtcaaactgtccaaatctttcaacaacatataaataccccgtatttactattttgattgatgatagtattacaataactgctataagtaatataattcctaaaagtatcgttaaaatcatttttattcctcctcaacctttttaattaataatttaataccttctattcctgtaatgatgaattcttcaccctgtttaatgtccccacctgtattaaccgctgtccaatattcaccattaactttaatctgagctttattgcttatttccttttctgctttaataactttacctatatacgtttcttccattcgaagtgttttggtaaatccttttttaaactttttctttaaccatggatatcccactgacattgatattatgtttataactgcaaaaactattacctgcattgcaatactcatacccaaagatgcgcatatggctgcagctatggaccctgcactaagcaatacaaaacaaaaactacttgataatatatctattacaaatgatcctattgctatgagtatccataaaattattgctcccatgtttatcccctccttttacttattatacttctttttgctttttcttagtatattttttccacaatttaattatatgttattattaattatttttcaagttattttatatctctaaatatagtataaaataactcttttctcgttttactgtatttaaattgtccaatcttctttttccttggtttacctatgatttttaacactactcatatttatcatcattagattactagaaaagttcactctttttaaatatcgaccaaaaatttaaacatctacatctttaaaagcttatgttgacgctatctattaaaaatattaatattaaaatgaaaaagaatactatttttcatttaatatatcaaataaatattttttcttgtttacatctttgattaaagactttttttactaaataggatatattttttctatctgagtaaaactaaacttataaataaattgataattaaatcaaagcgaaaagttagtatgtataaatataaggagtgatcttatggattttataaaagtagcatctgcttgcccaaatacccgcgtaagtgatgtagactataacattgaaaacattttaaaatgtattacagaagcaaatgagaaaggatgtaaatttatagtttttccagaattatctgttacatcttacacttgtggtgatttatttctacaggaacaccttttaaataagtcttatgaaggaataaaaaatttactacataatactagcaatttggatatgcttatagcagtaggtgctccccttatttctggtagtatcttatataactgtgcctatattcttttcaaaggaaaagttcttggaatagttccaaaatcatacattcctaattatagtgaattttacgaaaaaagatggtttaccgaaggaatatctataacaaatcaaaaagttaaccttccttttcaaaaagaaattccctttggtgttgatttaatattttcttcaaacctaggaaattttgcagtagaaatttgtgaagatttatgggttacaataccaccaagttcatatcttgctcttatgggtgctcatattatcggtaatctatctgcctcaaacgaattagtaagcaaagctgattacagacgaaatttaatttccaaccaaagtgcacgttcaatatgtagttacatatattcttctgctggtgttcatgaatctacaactgatgtacttttcagtggacatctcattataagtgaaaacggctctttattaagtgaaaataaaagatttcaaagagataatgaaataatctatagttatgtagatgtatttaaactaaaagctgaaagaatgaaaaatttaagtttcagagatgcctcaattttcttaaatagaactccttcaatgataaattttcaatttacaaatactgaaataaaaggttttgatagatttattgacaaacatccttttgttccatcatctgaagaagaaagagatttaagatgccgagaaatattcaatatacaagcttcaagccttgctaaaagattagaacatactcattcacaaaaagctgttgtaggaatatcaggaggtctggattcaacattagccctccttgtaatagttaaaacttttgaacttttaaatctagacaaaaagaatatagtaacaataacaatgccaggttttggaacaacagacagaacatataataatgccttggatttatgccgcgaacttggaactgatttaagagaaataaacattgtaaaagcatcactacaacattttgaagatataggacatgataaaaatattcatgatgtaacatatgaaaatgttcaagcaagagaaagaactcaaatattaatggatttagcaaacaaagaaaaaggtcttttaattggtactggtgatttatctgaattagctttaggctggtgtacttataacggagatcatatgtctatgtattcagttaatccatcaatacctaaaacacttgtaagataccttgtaagatatgttgctcaaaatgaatctaacgaaatagtaagtaacacattaatggatatacttgatactcctgtaagtccagaattacttcctaaagactcaaatggccaaatatctcaaaaaacagaagatatagttggcccatatgaacttcatgatttcttcttatatcattttataaaacatggttctacaaaagaaagaatagcatttcttgcagagcatgcatttaaagatgattattcaaaagaggaaattggtaaatggcttgacaaattcatgttccgattcttcactcagcaattcaaaagaagtgctcttcctgacggaccaaaagtgggaagtatttccttaagtccaagaggagatttcagaatgccttctgatgcacaaccttggaattaacactaattctttaagtaaaacttaatttcatctagattaaatactaatctgaatgttagttgtcttataacataaactagctctatctacagattatattaaatagaataattttatataagcctaatttagaagctgattaataatactatattattaatcagtttttttaaattactcattttcatcaacaaaagtacatttatatctcaaaatgttaaatatcacaacgttttattattaatattttaaaactttatcactttttataatgaattgtagaattttcttccgagtagtgctaaaatagattgtatcgaattatttggcaataagcctaaagatatggaggaatgaaaatggggaaaaaagctgatatagactggagtaaattaggatttgactacataaagacagattatcgttatgtttcagtctggaaagatgggaaatgggatgaaggtacacttacaacagataatactcttcatataagcgaagcatcacctgttcttcattatggacaaagttgttttgaaggattaaaagcatatactacaaaagaagggaaaatccaattattcagacctgatagaaatgctgcacgtatgaatgaaagttgtgataaacttcttatgccatatgtacctgaagaaaaatttatagatgcatgtatgcaagttgtaaaagctaatgaaaagtatgtaccaccttatggtactggtgctactctatatataagaccagtcttaattggagttggagataatataggagtaaaaccagcttcagaatacatattttctgtattctgtatgccagttggcccttacttctctggtggattaaaaccatgtaaatttgtagttcaagatgaatttgacagagctgctccacatggaactggtaaacaaaaagtcggaggcaattacgctgcttctctacaagctcataaaaaagcagctgaagatggatacgctgattgtatttacttagatccagcaactcatacaaaaattgatgaagttggtgctgcaaactttataggaataactaaaaacggtgaatttataacacctaaatcatcatcaattttacctagcataacaaaatactctttattatatatagctgaacattatttaaaaatgcctgtatttgaaagagaggtttttgtagataaacttgatgaatttgcagaagctggtgcatgtggtactgctgctgttatcactcctatcggagctattgattacaaaggtgaaagatttatattccacagtgaaactgaagtaggaccaacaatcaaaaaactatatgatattctttacggaattcaaatgggtgatgttgaagctccagagggatggatttacgaagtaaaataataaactaaacagaaaccagttctattattaatattgaactggttttttgttttaaaaaatcttataaattctcaattatagcttcatttatacgctctttaggtacaaatcctactatttcatcaactactcttccattcttaaaaaaaatcaacataggtatacttcttattccatatctctttacaaccttaggactttcatcaacatctatttttacaattctaacatctttattttcattagatattttttctaaaacaggagataacattttacatggtccacaccattttgctgaaaaatctacaataacaagtccagatgattttaatacttcatgaacaaaattttcttcatttatgtgtgctatcataacttcacctcaaactaataagactcctacattaattaatcttaattaatattgaaatcatagtatttattttttctcatgatattattatattcactacattaagtttttgttcacctccatatactcttaaacttcaaattctataaattctctacaaaataaatataagcatacagtaaatttactgcatgctcatatatttaaaatgatgatattttatgtagtgtactatactcaccaccagattctatcagttcatcatgggaacctttttctattataccattattacccataacaacaatttcatcagcattttttattgtagataatctatgtgctacaacaattgttgttcttccttgacatagtttttctaatgattcttgaattattttttctgtaacattatcaagtgccgatgtagcctcatctagtataagtattgatggattttttaagaatactcttgcaatagatattctttgtttctgccctcctgaaagttttacacctctttcacctatatatgtatcatatccttcaggaaggctttttataaattcatgtatattagccattttagctgcttttataagttcttcatcagttgcattactttttccataaagaatattttcttttattgtaccagtaaataaaaatacttcctgttgtactattcctatattactcctaagagagttagctttaacatcataaatactcttaccatcaattaagatgtctccactatcaatttcataaaatctaggaataagattacaaaatgtagttttacctccaccagaagcacctactaatgccagcatctttcctttttcaatttttatagaaatatctttcaatacctgcttaccttcatagctgaaatcaacatttttaaattctatttctccttctacatcttttaactctgtggcgtcttctttatcaatctcagcttcatgattcattatttccatatatcgctgaaatcctgttattccattttggaattgttccataaagtctataagtttttttattggctgagtgaacatttttataaaaagcatatacgccataaaatcacctatatctattattcctttaaaggtaaacaatccccctccaataagtcctacatagtttaagatatctaaaccaaatccggaacccgaaaaatattctgccataaccttataagatttttttctagcattcatgaatttttcattgccctcttcaaatttttcttcttctgatttatgacttacaaaagcctttgatatctttattcctgatatactattttcaagagctgcattaacagcacctgtttctacttttgtattcataaatgcatcattcattttctttctttcaaatatagtaaatataactataaatggtataaaagcaaaaattagaattgtaagtggtatgtttatattgcataaaattataaatgaacctataagcattacaatagatataaataaatcttctggaccatgatgagcaagttccgaaatttccataagatcatttattattctggacattatatctccagttttattattatcaaaatagctgtttggaagtttttgaagatgtttaaacacatctcttctcatatctccctgcattttcactccaataacatgtccaaagtactgcataaaatatccacatgcagccttaattataaaaataataataagaacaactgcaaacatccctatcatctttaaatttttattaggtatagaatcattaagaaggtctcttgtcatcattggatataccaaatcacacatagaagctataaatgcagcaataaggtccaaaacaaaaagacccctgtatggtttataaaatgaaataaatttttttaacattttttctccttttcatatgaataaaaatcaaatagcttgtatataatttaaaatacgatacataatttttaatatacaaggcggtgtcaagtatgataaaaaaaacttttaactatgttaatatgttattcgctgtgtcattatcaatattttcacttaacataatagcaagcagtttaaatccaaacaaatatttccctcttatatttgtttgtctaggattctctaatacacttcttggaattaatttgctaaataatcataagaaaattttaagcttttgtagttttatactagcagcttttatgtttataactgttggcagcaaaataatattttcataaaacattactattataagctacactcaaacttatttaaatataaagttgttatttattttataatagcttcattattttattcttctcattttgtaaatctgacttaaaaacacctttaacacacacaggacgtccaccaaatacaataatatttcctttaaaatatatagcttcatctaagtcatgagttactaaaataaccattcgattttctttctttaaaatttctataaattcatctattattatatatttaatcttataatctaatgatttaaatggttcgtccataagaattattttggatggctttccgaaggcccttgcaatattaatcctctgcttcatgcctccgctaagttcatgaggatatttatcttctattccatctattcctacaagatttaatactttataaactcttttatttagctcatctttttcactatattgctttaatgcaatctcaagattttcttttattgtaagccatggtattaatctatcttcttgaaatacataacttatatcttttttagtaatcccattaatctcacaattttcaaactgaacaagtcctgctattatatttaaaagggttgtctttccgcatcccgattctccaacaatacaatttactttatcatcataaaattcaatactaaaattatcaaatatcttatcattcccatatactttatttaaatttttaatgcttatcttcatttaaccacctatatgttgttttatttagttttatattaatcatttcaaaaactaaggatataagaactattattaatatccaagcaaaaattccggttgtattaaaattaaccttttcaagttgaatctgagaccctattccatatttaggctgaccatgaacttctcctgctataactaccttaaatgttaatgaaagagtagatacaaatatgttcataatataaaattttattgttggcaaatatatttttcttatcttatcaaaaatacatacttcgtaaataactgtcatttccattattttagcatcaatcttagttaaactattctgaattccttcgtagagtattggaaatataatcgcaaacccaactataaagggtgcactatctttatcgaaccacactaatgctaaaacaacaagaacaagtgtaggtatagtctttacaaaagaatttaaaggcgctataagatatttaaaaaagggatacactgatgagagtatccctaaaaatactgataaaactaatgcacataaataacttattaatgttctcacaaaactactgcttacatacatataaaaatttttatcttttactaaattcaataattccttaagaatacattctattctcggaagataaatatcattatttatagttactgctattacttcccataataccaaaaataatatacacgaaaataaagtatatttacttttccatgaatattttatcatctggtatatttcctcctattgtcttaggttctaattgatttagtttattaaaataagtcttgtattcattgtaacaatcttttattccaacatattttatatttgatctactaattgctttaattattataggtttcttagctgaaactccaatttcttcacaatattctcctagtaagttcttctcttcatatatccatctacaactctcatcaactctatctaaaacttcattaacaaattctttattattatttactaaatcactttttactattatagtagcttgtggatacccatattctgaattatttaaactcttccattcatcatttaggttcattattgttttaaagttttcatttttttcttgaacagttgataatgctggttccggaatcacagcatactgtgctttaccagataatattattggtgcaagttctgtaaccccatcaacataactaaaattaatatcactgtctgtattaattcccttgtcattaagtatgcattttgtaattatatctggagttaatccctttccaatgttatatacttcttttccttttaattcttctatagatgttacctgtggatctgaagaacctatataaaatgatccccatccaactgttcctgctattacatattgtttattcttattatatgctgtagctgctaaatttgaaggaactattgctatatccggctcacctttcattacacttgtggcaagtgtatctgaactttgttcaatactatagtctatattatatttttcatctatttgtggtttttcttttatcatttttgctattgaaatagctggaagtccatcgggaactacaaattttatttcacttgcttcttgaactccactattatcatcttttaaaggagcatttccacatgatataaacataaatgtactaataacagaaatcaaaattaatgtcagtttctttttcataattaccacctctattaaatacttttttaatctaaatacaataaaacatacactctttatttatgcatatttaccactttttataatatcacaacatataaaaaagacaaagtttatactttcacaatctgaattgcataagtataatttaaattaactttataactattatttctataattcctgtaaagcttcgtaaattaaactcaaaaaaactactaaattaaattcaaatttagtagtttttatattatctatatatatcaacaatcatgccctgtatttcatcaactgctgcgacaatatttatattatccttttcatctgacagtaatgcctgcgtaagttcttcaagcttattgtctatggtgtctatggtaacataatattgtgtctgccagaagctaatatctttttttgtctcatacataaattcaagtatagactcaagatattctttaatcatctttttatacataacaacatcaacatatgtttttgtcgttattaatcttgatcctcttttcttaatatcctcaatcatcttattaagctgctcttcagatttcttctgtctctgctgattaaaactttgtgaaaaatccttttttcctgtagttacttttctttcgctagctacagtacctcttcgtactcttcctatctccatccatattcgttcctttcaatcttatataataattatatcaaacaacccaattataaactaggctatttttttgttttaaattatttctatttccctctctttggaattctaaaaaaaagattacctatttcaaactcctctttttttgtatttcgaagaacttcctcataaggtttatatattattctttcatttctaatattctctttatccagacttcttaaagaatcaaaaatagattgaacatttaacattccatatccccactctttattaggatacatgtctcctggtctcatttttgctcccctagttatataacttatcattttttgagtacgaatatttggcatattttcatcaactattgcccattgaagtattaatgcacaacaacctgccaatatagatgttgctactgatgaacctgatgcaacatcagttcctccaccaggtttaataactaatgcattgactgcaccagttgctacatctggttttattcttccatcgcgtgtataacctcttccagatgctactactgttgaattattatcttgattataatacgctgtagtaatcaccccctttgaagtccctggtatacttaatgttgtatactggctaggattaaaaaatctcgtatcattatcaagtaattctctttgtggtagccatgaccaatacctaccatcaacaatatagtccccatacaatctaaattcccaatttccttcgattacatttttcattcttattgcaattatttcatcccctgtattttcatctggaataaagtaatttatatttacaatagttccttcatataaaaatttataattttttagttgactttgtttaggatcaactttttctaatatttctcctgatggagatataatcccaatagaaacacgatcaggtctcataaaaaatatttcaaaatttaaatccatttgactctttccaacttttacttcaatgcttcttacttctccagtcttttcaaatttgctttcagtatgaacttgtgtatcaccttgatttccggttccaaccacaggaacaactccattttttttgccatgtgcttctagaatattttcaagttcatttgttccatcatgtcctcctgtattagttcctagtggaagataaatcactaacggcatatttaactctttggctaattcacctaaatatctaactgcagacatagtaaatacactttcatagactgcttttttctcagatggtacacctgcatatgacaaagtaactttattagcttcttttaatttcacaactgcaaatttacatcctggagctgctccaaggagatctggattttttcctcttcctccaatcaaccctgcactcatagtcccatgtccataatcatctttactcggtacaatagtatatggatcaccacctgataaatataattttattgcgctatttatttcatcttctaaatattctgtgccaaatttcaatccatatatttctttatctccctgtattgtctgatcccatattcttactatccttgttgtattatcttcatacataaattcttcattcaaataatctattcctgtatcaattattcctacaagcacatttcttccactcaaattgaaatgaggattacttttaaaaacttccgcaccactagattctattggtgataaagtacttaacgtatatactgcaggaataagtatcggcactatttcttgaacataagggaataattcagatattttattaaatggaagtatagctattgcaaatgattcagtaagtgctactgaagatgcatcttttatattatcattgatctttctcagattttctatacccgtatactgaattattagacctataaagtctgtattgtaatgctcatcatccatttcttgaatcgctttatttatatcttcacttgcaattttttttacactacttatatctttaacattatcactttctccatctctaaatttcattctaattatagaatttatttcatcttctatgagcttaaaagtattaaatgcacatacctctccatatccccatgtattattaggataatttaaattaactctcttcctcttagctcccttaacaagataatattttaatctttgcccaaacaaatatggatcatttccttttattattccccattccataagtaatgcacaaattccagctacctgaggagtagccattgatgttcctgttttattatcatacccgccaccaggtaatggtccagatatattttgtcctggtgcaacaagatcaggtcttattgtatatggattattttctgcacctcttccactaaaagacgaaatatcatctgttatattattataacttcctactgcaattatattttcaactgttgctggaatgcctagtgtattgcttgttaatggttctaaaaactttgtactagtgttgagaccttctgatactggaagccataatgaatagtctccatcatattcattattaagttcaatctccattttccatataccttcagcaagatacgctgatcttgctgatattattatttgaatttcattatctaattcaaacggcttaggtcctgccacataaatatccaatctatcttttcctatattagttctaaaatacccctcattcaattttattaatccactgctttgacctgatgaatttactatattaattgaaatttccggtaaaatagatttataaaaattaataactatggctttttcatcacttgcaatattaaatgttttaaatttatttcctttaaatgtaccacctgtatgatgtccagcatccccttcatttccagctgcaattgcaatagttatacgttctaaatttgctattgtttttatatactgctctaaaaggctgcttccattatgtgcaccattatttgtgctaagactcatatttattactaagggcatatttaattctttacttttatcaattaaaaatttgaatcctctcataatttgtgaacttaatgtcctaacacctcttgcagattttaccatagcaatagaggcttctggtgctgcacctttatattttaaatttatttttcctcctccgcacgcaattccaacaacatgtgacccatgacctgtactatcaattgaatttacaattgcatatggatctggtgcttttatagcttcgttaatcatctgtttatcatatatttttttacctgcacttaaatcatatatatattcaattctagtacttccttaattattcataaaagccggatgcatataatctattcctgaatctataaatccaattaatataccttttccagatacattgtatgtagatactgcattaggaatacacgatgctatattgctttctagagctgattcatataaatttttaggtaattctatatattgaatactcctgctttttgaaagcatcatcaatttatctaggcctatattaactaatccaaaattaaaccctaaatcttcaaaattaccgtttaaaccttcaaccatcagttttacattttctggttcatctctatacaaaattataagttcaatagtattgttttcttctattgcaaaatctaaattatctagtatctctttaggtacattagttaataatcctattgatgcatctacatatttttcagatgtattttctctaaataacatttacaagattcacatccttaaattactacttttatatactatgtatataaaacataaaaatgtcactttaacattactatattactcattttagctgtgtaatatttttttcattagtcaacataaatttcaacaaatttattagaatattacactaattttcatttttatttttataattttgtacaaagattgattatatatttttttatgattgaaatgaaaaaatgtttgtactaaaatttatgtaacaactagatttgaggaggtattgagatgatagtaagatgtatagatgatactctttgttctactttacaattaaataaagaatacgtggttattgaagaggcacctgaatattatgtaattttagatgataaaaaagaagaaacaatatgtaagaaatctagatttcaaataattgaagatggtgaaattgctaaaaaagcaaaagccactattacagaattaacttatcaaatagaaaacgatttttctgatatcaaaagctttaatatcagaaaaaactcaaaaggtgaaatcaaagaaatttcaatcaaatttaaatatgaatagtaataagccagtacatttaagtactggcttattactatttatatttgattattcaaccaaagatatcattaactctattaattgtctactatatttatattatactcttcaagccacatatttacttgaattaaatatgcaataagttgtggacctgtcattagttgaccataccaaggcgccttatatgaagtacctcttgtatctattatttctcttacaaccttatcatctataatttcatgaattggtgaagattttttatccaaaatacctgtaagttctctgcacacaatatctgtatagacaggattatgtgtctttggatatggactcttttttctataaattatttcatctggaagtattccttccattgctgctcttaaaagacctttttctctgcctttatataataatatatcagaaggcatattaaatgcatattcaacaagtcttatatctgcaaatggaactctgacttccaaactattatacatactaactctatcagttctatttaataaatttaccatgaaccatttcaaattcaaataagatatttcttttaatctataatctcttttactttcattttccaagtgaggaactttactcaatgatttttcatactgtgatctaacaagttcttttataggcatgtttttcaacttatcatttactatttcaattctattgtttacaaatcttgaccatgggaaagtgtcaagataaaacatttcatctcttgtaaaccaaggatatcctccaaaaatttcatctgcacattctcctgaaagtcctacaacaaagtcttttcttatttctttacaaaaaagtaaaagtgacgaatcgatatctgccattcctggaaggtccctagaaatcattgattcctttaatgcttctgctaaatctgaatgatttaacacaacctttctatgatcactgccaataaattttgacatttcttctgcataatgttcatcggatgttggttgaaatagtgattttttaaagtatttatcattatcttcataatctattgaataagttataagctgttttcctctttttttaaattcacttgctgatattgctgatattgctgaggaatccaatccccctgataaaaatgtacatactggtacatctcctacaagctgccttattattgcatttgtaattaattctcttgtatgtgctatagcctcttgtgctgtttctttaaattcttcggcctttaaagtccaatactcccatttttttatattattatctcttgatataagcatacaatttgcaggtgctatttcttttatattcttaaaaacaccactacctggtattacagccgggccaagtccaaatatttctgtaatgctttctttatcaatttcagcctttacatcaggatgtgctaaaacagtttttatttctgatccaaatataactgtattatttacaattgtataaaacaatggttttacacccatctggtctcttgctaaaaatacctctttattgtattcatcatatactgcaaatgcaaaaattccaattaatttattgacacaatcttttccccattcaatgtaagaagtcaaaagtacctctgtatctgaataagaatcaaaatcatgtccacatttttttaattcagctcttaaatcatcggtattatataactcaccattatatatcaaagtatattttctaccttctataatttttatcataggctgaattccgccttctggatctacaacaataagtcttctatgtcctaaaagtacattttcagatatatatataccttcagaatcaggtcctcttttagtaagagtttttgtcattttttctaatatatttttattctttattatattttcattaaaattaactaatcctgcaattccacacatttattttccctcagatattattcacattaataaaatatgattttattttaatgttgtgattaaacttatcaaatattatcagcaataaacctataattaaataataatttctaattctttaatgtatacattaacatcaagtatcacatactaatattgcattattttgtattattatgattaaaattatcattgataatacatctatagtacagagtacaatttattgtgaaaggaggttgttactaagtttatatacttaagtaactgtgataaatgttaaaagtaacagctaattatacaaaaaatattgaacttattcattctcatctggctgtagataaaagttttgatattgttgaacgtaaattggtagttggtggaagaaaaactgttctttactaccttaatggctttataaaagatgatgttatggaagatatattaaaatcattcttcaagatttcagtagaaactatggattcttttaaatcagctgatgaattcatgcttcatgaaattcctcatgtttctgttgcaaaagaaaatgatcttactaaagtaatagatgcacttttatgtggtcaaacaattctatatattgataaatacgaatacttctggattattgaccttcgtacttatcctggtaaggattcttctgagcctgaaaaagaaaaaacacttcgtggaagccgtgatgcttttattgaaaaattagttttcaatactggatttataagaagaagaatacgtgatccaagattagttttcgaaattcatcaagtaggaacaatgtcaaaaacagatgtctgcgttgcatacattgatggtgttgcagatgaaaaagtgcaccaaaaaatagttaatagtatagcaaaaatagacttaaatgctttaactgtaggtgatcaaagtctagtagatgcaatgataaaaaagaataccttcactccattcccaaaagtgaggtatactgaaaggcctgatgtaactgctgctcatttagttgaaggtaaatttgtaatatttgttgataattcaccaaatgtaataatattgcctacaactgtttttgattttactcaggatataaatgattactattttcctctttttacaggaaattatctaagattagtaagaaatttaactgtatttgcaacaatttttttaattcctatttttcttttatatattgatggttcaatacgccttccggctttttttgatttcttacggcctgaagcagactatagaatacctatgttttggcaattctttatacttgaatttgcaatagatggtctaaaacttgcatcattaaacacaccaaatccccttggaacatcgctttcagttattggtggtttaattataggtgaatatgcaattaatactggatggtttactgatcaatctatattatatatgtcagtcgttgcattagcaggatttactcagccaagtatagagatgaactatgcttgtaagttcgcaagaactctattattaatcttttctcaactttttggagtctatggcttaattggaggaactttactcatactaattattatgtggcgtacaaaaacaattgtaggagaaccatatttctatcctttaataccatttaattggcgaaagctaaaaacacttttatttagaactaagacaacaaaacaagttcaggaatcttaaaaaagatggttatatgaaataaaaattattcatataaccatctaaatctaatccttatttttttcaacctcaaaaatataatcttctagcaataaggaattgctgccatcataacatcctatctcaaagtatttttgattattatacttaaaaacagctattttgcattcatctctagcatgatttctttttatattatccccttcttcgctatttacatcatcgtaaataatatcatcatactttataaataatgaattcaagtctttctttattacttttcccatatattcataattatattttaatataatataattatcttttatcatataatcctctatcttaatagctaaattatcacttatctttaaataaaaggggtgaaattcttctaaatttactttgtttgatataagagtttcttctctattagcctttccataatatataggaataacttttaatttttgtaaaggcgcattacttacatactttgcattatactcagattgatttaaatttgtagatgtattttcacctaccatcgttaattcattatcatcttcatctaaaaccaaaaattcaagtctgcttttattataactcttatatgcagtgtctatttttatagtaagaggtgaaattgtaacttccttaactttccctttaagatctctagtattaattgaactatttatcttttctctataagtttcttttaatattttggcagtatcaacattaaatttaatatcccaatttccatccttattgaacattttttcaattccgattgatatgttaagattactaggaagatcatcataattcaaacttattcttttaactattctaacttgattatcatcaagtaattctaaattattttttgatattaaatgcacttcttttccattaatactaagagaggaaatatgaatgtctgcatctttcaaatctttgatttcttccccatcatttttcacaagaaaactaagcattaagatatttttgtcagcaactgcatattcaagtgttacagtaatatctccatactctttagactttcctactacttcaagataatcatcatattgttcaagatttatattctttccattagaaaaaatatcacaaataactggtatttttttaatgttacccttacatacaatccctacaagtaatataaaaattaaagttataattaatattttatatttcttattattcttaaataatatatcaagtagacttttccacttcatttttctccctcttcaaacatcatgtttaaattcaaaatattaatatatatttttactgtaaaataatataaaagcctgaaaaattcaggctaatatatctaatttattcttataaaagacgtgttccctctttatcttgagttattaattttttcttcatcaagcctccaagagtcatcttaaagtaatttttacttgtattgaattctctcttaatatcttctggagatgatttatcattatatggcataaaacctccattttcatttagcatagcaagaattttttcttctaattcttctcttgcatcaagtctcttctttctagttgttatacctatcattccatcttcataaatcttcttaactcttgccttgataacttgacctggataaacataatcaaaatgttcatttgctagaataagacctttatactttccatcgaccgcaacattcaatgttccattttcattagtgttatatacaatagctgaaacttcatctgaaaccttatatgtgccttcttccgctgtatcaagatataaatcaatctttgtagttcctgctagtctatcagttttatctatgtacatataaattagatatttctcaccagtcttaagcttaaaagtctgctcttttagcggaattaataaatctctttctaatcccatgtcagcaaatgcacctatgtttgtttgtgatactatctttaaatatgctacttcccctgtagttaaatatggtttctttaatgtacagatcattctgtcttttgaatccctgtatataaatacttctaacgtatctccttcatttacaactgttcctttacaggcactgtttggaagtaatacttcatcaccaaatttatctttaagatagtaaccaaactctacttttttacttactactaaattacaatattgtcctaatattatcatatttattcctccatacactataaaaatagtgcttatatttttattccatttctttgcttaattttatataattaagacttgattgactgttactttttatttcttcttctgtaagttttcttataacttttgcaggatttccaagaattaaaaccccatcttcaaattccttattttgagttactagtgcaccagctcccactatactattctttcctattttcactccatttaatataattgctcccatacctattaaagtattatcacctattatgcatccatgtattacagcattatgtccaatcgtacaattatcaccaacaacaaccttttcatttttatcaacatgaacaactgagttttcctgaatatttgtattttcgccaatgactatactttccatatcacctcttagtacacttccaaaccatatattagaatttctttttagtgtaacatcccaataataactgctgtttctgaaatatacacttcttcatcaatagcaggactttttcccatatatcttttaatcatttataatcacctctaaaaatttgtattaaaacatagtataatagcatacttctatctgtcagctaaagttattttatcattagatttagttattgtcattattttagatagttgtttaataagtatatattataaaataatttttagaaggaactattatggcaaagaaaaagatttctatatctaatactatagatacaaataatctaaaattctactttgggattccacacgctcactgtgcattctcaactggaatcggaacaccaatagaggcttttgattatgcaaggcacaacggactagatttcttaatattaacagaccataataactatctcagtaaatcagtgagaataagaggcgaagaattcactaaatggaatgcttctcaatatctttcatctagatataataaaaaacatgaaaattttctctcagtaataggttttgaaagcaaaacaaaccttctaggcgatattaacgtagtaaatcctggaatatttttcactggatcagtaaataacattcagcttttagttttatggatgcttaacaaccctaatgcattcatttccataaatcatccacatagttcaatagaacatttagaatttaatccagtattaaataagataattacttctatagaagtcggaaatgggtcattacctaacaaataccaaagatatgaaaaatattattataaactactggataaaggttggaaattaagtgcaataaacgggcaagataatcacagattaaatttcggagatactgaaaacttaacatgtgttgtagcaaacaacctaactataccttcattaattcaggcttttagagaacatcatacatattcaacagagtctaggagcctggtaatgtactttatgataaacgatttatttatgggtagttctattgattcacaaagtaaggagcttaattttttaatatttgctaaagatacaaataataaaattatagaaatacagatactatcaaacaacggaataataatcaaaaagatatctaatttaaatttaaatagagtccgatatatttataaacatgaacctgaaaataatgaacgatggtatgttattaaggtgatacttgaaaattcaaagattgctataagctctccaatttttagagaataaaaagtcggctatctaaaccgactttcttttttatttatcttttttattatttttcactctatttggctttgctttaggctttattactataggtttttcctttttcttaggaccacctgtctgttgtatttccataaaccatagtaaaaataatactgtcgctactgttatagctgcatttacgtaaccattgatgccttttacaaacagctgacaacagaataagattattgatatagccaaaggtatccatttatttatacgtattttattaaacacatataatctacatcctgcataaagtgctaatataactacaagcataataacataaaataaaattgtagataaaacgttcatttatgaaattcctccttataaagtctataataataatattaagttaatttcttaatattatcaagtagttaaggttttctttttgcttttattctaaatcttgataatgtggaatattttattaaaatattaaaatattaaaattatttttgcaaatttttatattttcctttaaatttcactttttttttgatagaatataaaaaatagaatacataataataagaggtgatataatggcttttgttccaaatggtcatttagatgaattagatttacaaattttagaacttttaataaaagattgcagaactccatatctagaaattgctagaatatgccatgttagtggtggtaccattcatgttagaatgaaaaaaatggaagatatgggcataataaaaggatctagaattgttttaaatcttcctaaactaggatatgatgtttgttgctttgtaggaatatatgttgataaaacatcatcatttaattcagtctttgatcaaatgtctcatataaaagaagtagttgaattacacttaactactggtgattattccatgtttgcaaaaatagtgtgtaaaaatatttctgatcttcaggatgttttactaaataaaataaacaatatcgatggtatatcaagaacagatacatttgtgtctttatcccaacctatagatagaaatataactctatagtcaatataatattgttaaatttcagaaaaggcattttttcattccgaaaaaatgcctttttatttattctgatttttatcttaatatttatgcataaattttatttaataacaaaaaataaattggtaaaggagtgtgtttatatgaaatttctaaatattacggctcttactttaataatcattggtgcaataaactggggattaattggtcttttgcaatataatctcgttgattctattttcggaattcagtccatgataagcagaataatctatgctcttgtcgggttagctggtatatattcaatttctttcttcatgaaaaaataatcagcttttcataatctatatgtttcataaaataaactctataaaatatatagagtttatttttatcaataatttaagaaaatattaatcagaaattaattttctatttattttttttggtatataatataataaattaaatcaaaagtcctattaaaggaggcttaaagatactttgattaatttaattcataacaatatatatgatatagtttttttatttacagtctattcctttttgggatggtgtcttgaagtaggttattatttcaaaaatgaaaaacgctttgtaaatagagggtttctaaaaggtcctttttgccctatttatggttgctgtattgtaacacttatttttttattggaaccttataaaggcaatatcccattattattcttaggtgcattttttataacttcactattagaatatattacaggatttatacttgaaaaagcattcaaggcaaaatggtgggattattcagatgacccatttaatatacacggtcatgtatgtcttcaatattccttgttatggggtgcaggtgaagttgtaataataactgttataaatcctataataagcaatgctatttacagcataccatattactttgcatcaatgtttttctattttattgtcttttactttatattagattttttaattacgctattttcacttatagaaccaaacaagttctcttatccatttgaattagcttctattaatctttcttttactaaagtaaactctatttcaaatttttatagagataaagctgctgataaatttagatcttttgaaaatatttttcacaaattcaaaatgaacaataaaagatttattcggacttttaataataaatcatacaaacaatttaatgaaataattaaaaatattaaagaaaaaataaaaaaatattaagggaacattttcccttaatatttttttattttttcataattttatttattattattcatctttttaatttcatcaaataactctattgctgcatttcttggaccatttttttcttgtccttttacacctaagcaagttcttatctgcccaaccttaactttactatctttaaacatttcattaaaatactgatctataagaatatctgtttcattctgcttttgtgctggtccaaatggatttgcaaagtatgattcaactaaacctttttcagttgttgttcccttcgccattctagcacctgatttaaacacgcttattgcctcatccacagtattgaagtaattcaaatactttccgccgtcttctactccttcataattatttgcatagaagaagaagtctactttattacctttagttatttctttgtatgaagctactggcataactaatcttgcatttactttatctggattcatgaatatacttctatccatttccttaaatgcatatccttgatctaagtcatctaaccttacaaatgcacctatttcagtaccataaccaattatatttccatcttctattttaaatgttcccatatcatcaaatataattgtcatatctgaaatataatcttcactcagacttctaaaagcttcaagactttctgactttccagctccactatctcccattataacaacatttgcttcttcaccactctttagtaatacatttaccattgatccgtgtattggaagataacctctcttaatcataagaagattgtaaagagttaatgtcattttcttcatgtatccaaaataatcaattttttctgaatgattaatatatccaagtactatatcatttttatcatcttcatagaatacagttttaagttcatctccatcatctttagctccaaaaacaaaaatcatctccggctttctgcctcttgtttcctcacttcttgccatttcgaaaagattacacaaagttattccatgttccataaagtccctatggaaatatataaatataatcattcctccaattttggctggataacagaaccaatgatctttattaatatctgcatattttaatggattatagtctatagctgtaaacattccatctcttgtgtttctctttggataagttataaatggtgtctcaagtaatatatggtctatgaaaggaatatcttctaaggcttcatatccttctggtctagcccattctaattcctgaatcataattcctgcatttccacctgctggtatctgtctatatacttttggctgatatcctactacatgcatttcaatctttctatataaatttaatattaatgttgaaaaatttgcatttgcttcagtaaaacttacagctgcaagcccttcttgaaccttgtatctatgaacaattgtatatctttcaagttttctccaaaataaatatacatcttctataactccaatgaatttatctttatcttgtaataaatttttataaacttcacttatattgacaacttcatcagcttccattattgtaagatatcgtatcatttgagttaattctcttcttatatctataagactatctgtatctaagacgttattcaaatatctataagataatgaatttttcttcttcgctcttcttaaataaacttctaaaattcgtctaaatccattgctttctaatactgactcaaaactattacaatattttgctgtaaagtttatcattaccttatcgttactcatcgaaaattcttttttcatattctgccccccgcatgaaatttttttagcttaaatatttcattttttattgtttttccacacattgatatcattataccatattttttgcaatattcaaccttacttttttgcatttattgcattttttcatttaataaaatttcaaaacactaatcatatcaatatatctttcagttattctctcataattatatatatattaatttttttaatatatcttcacttttatgaatattaaatttatatattaatttttcgttcgttttttcaaaaatatggtatatatttcagatttattgaaataattataaaagattatgattttatccaagaagtgtattttcatagttaataattatttttacaaatataaaggatttatatatgtttataaaaattaagaaaagacattttaaacatttaattatatttacattacttttattactttgctttttttcttctctgctaacaaagaaattcaacagttataaagtaaatcctaatcttatgtatgttcattatataaatgtggatcaaggtgatgctattctaattcaagtaaacaataaaaaccttttgatagatagtggacctaaaagtcataaaaaacaacttgtgaaatttcttaatgatctaaatatttcaaaattagattatgttattgcaactcacccacatgaagatcacataggaaatatgaatacagtgttaaattcatataaggtacaatctttctatgcaccaaaggtctactcttatacaaaatcatttgaacaaatgattgattcattaaaaagtaataatttaaaaatcaacccaataaaacgtggatgcaatacaataaatttaggttttcaaacaaatgttgaagttttttcccctataaatgatacctatgataatgaaaataattattctcctgtaataaaaatatcttttggcaacaattcgtttttgtttacaggagatgcagaaaaagaaattgaagataaacttatacttttgaatgatgatttaaaagcggatatattaaaagtctcacatcatggttcatcgtcttcaacatctgattcttttttaaatagagtatcacctaaatatggagtaataagcgttggtaaaaataatatctatgatcatccaaatgatactataatatcaaaattaaatacctataatatagatatcttaagaactgatatccaaaacaatattactctaatctctgatggaactaatatttcttataaacattattgaacttttcaccaataatttataatgcaataatatagttctatatttgaatcaatatttcttacattaaaatataagaaatattgacatcaaatattcattgagatatcatagaagtattgttaatgaactagtgaacatgattaatatatgtaaactgagataaattttataattattttcttaccagttgtatattaattacacatgttcatattatgaataattatttacttttaaataaaataaatttataggagtgaaaaaaatggcaaatagaattagaacaagatttgcacctagtccaactggatatatgcatgttggtaacttaagaacagctctttatgcttatcttattgctaaacatgaagatggagactttattttaagaatagaggatactgatcaagaaagattagttgaaggtgcagttgatattatatataacacattgaaagaaactggattaactcatgatgaaggtccagatgttggtggccctgttggtccttatattcaaagtgaaagaaaagatatatatcttgaatatgctaaaaagttagttgaaaagggtgaagcttattattgtttctgctctaaagacagattagatatgcttaaagaaaatgctgaagcattaaagagaccttttaaatatgataaacattgtgcacatctttcaaaggaagaaattgaagaaaacttagcaaaaggaattccttatgttataagacaaaataaccctactacaggaacaacaacttttgttgatgttatatatggaaagatttctgtagataattcagaacttgaggatatgattttaattaaatccgatggacttccaacttataactttgctaatgttgttgatgaccatttaatgggtataactcacgtagtaagaggtaatgaatatttatcatcatcacctaaatataatagattatatgaagcatttgaatgggatgttcctgtttatgtacactgcccaccaataatgaaagatcaacacaataaattatctaagagaaatggtgatgcatcatttggagatcttcttgaaaaaggttacttaaaagaagctgtacttaactacatagccttacttggatggaatgacggatcaaatgaagaaatcttcacacttgaagaattaatcaaaaaattcgactataaagatataagtaaatcaccagcaatatttgataatgcaaaattaaaatggatgaatggtgaatacataagaaaattatcgttagatgaattccatgaattagctatggaacaatataagaaagtattacacaaggattttgattttaaatttatatctgaattattacatactagatgtgaattactaaatgatattccagaacaaatagatttcttagaagaattaccagaatatacaactgatctttatgttcataaaaaaatgaaaagtacagttgaaacttcattagaaaacttagaaaaagttttaccagtattagaatctatcgatgaaaaagattggacaatggataatatccatgacaaagtatttgaattaatcaaatctttagaaataaaaaatggtcaaatgttatggcctataagaactgctctttcaggtaaatcatttactccaggtggagcttttgaaattgctatcttaataggaaaagaagaatctttaaagagaatgcataaaggtattgaacttttaaaagcataatttaaagcacggttttaccgtgctttttcaattaccgatttacattacagttaaaagttatcttttattcttttttcataaatctctaaaagcatttttctattaactgtcatttgttaaattacacaaaaaaggggacctcttaaaattaagaagcccctttttaaaagtaatgtactgtattacctctagaaagttagtgtttgtttatcactttttatagtaattctttagtttgagatgaagaattatttttattttgctgtgataattgcaattcatcatctattacttcatctatttcatcattttcttcttggttttcattatcaacattaatatcaacagattcagaatcaagattttctatcatgttctcatcaatattatgaataatatactttttccagttaacatagatataataaagattaacaacatcctgctcgttataaagaagaatcttctctattttttcttcaggcatccttttaaaatagctcttgtctttcattactttatgaaaagttttagcaaggtttgatccactaattacttcaccttctcttattatatcaaatatcttttcaagattttttagccctatagatcctatcctgtctttctcgtactctttttgaatatctatagaatcaaattcttcatcaaaattatataatataccattcttctcaaaaagataatttataacagtaaaatcattattgccagaaaaagtaacaatagcttttttacctttatttttcattttcataaagtaatctcttgcaagatataatatatctatagcctcatctttatcttctatcatatattgggtaactaatatagattttatttttggattatactcacacgctccaaaaacacctatacatttaggttttttgtaaacatagtgctctaaatcaaaaaatatcaactcttctggattatattccctatcctgaggttttatcataaattcatcactatattcatctaccttcactttattttcacgaataatcacagtaccactctttcctatacaaattgtatatcttcaatatctaaattgtatattacatcttttctttcaacaataacattaatcttatcaatcagacttctatcctttattaccttttgcaatagttccttagtaggattcatacagtaaggatatcttacctttttaaacatagtataatcacctgctgtatctccataagcataactgctttctaaatctatatcatacttcttcacaaaattttcgatagctttttctttactgttactatcccacatgggaactacttcacctgtataagcattcttttcatcaattatatattttgctccaatataatctgtaaatccatacttattagccatttctcttactaattctgatggtgaaccagaaattattattaaagtatggccattatctctgtgccattttattctatcccttgtaaaagtatagactctatcacctttttgatctacaatttttttagctatatattctattctgtatttttcaagaccctttatagcttccatataaatatctatcatttttaaaaggtaatcatcataatcgccctgtcttttatcccacttcatataatcaggtcttacatcattgtaccatctttcttcacctataatctcgtatttaaccattttcttaaatacttctgttataagaccttctctgtaaagagtaccatctaaatcaaaaaatgcacctacgtttgacattacctcacatcctcatctgttattgtaatacaagttattatactttatttttacacttcagaaaagtatttgcaaccctttttaattacccataatatattatatttaattaaaggcaacaatgggactatataaaagtaattccatacacttatttatcaagattttccttttccacaagttctttattagattccttaaacctatctacaagcttattataataaattcttgctgtagccatagttggagatcctagtatcataccaactggtcctaatataccaccacctaaagtaacaccaaagattataccaagaggacttacaccaacttttttacctattaattttggttcaagataccatgcatcaaattgttgaagtgcaaaaagaagcattgcaactacaactgcttgcagtggtgatgaaaatagagttaccacaaatgatattacaatacctacaagtggtccaaagtatggtatcatattagttattcccactataagagctaataacggtgcatatggaaccttaagtattgtaagacctattaacgctaggcttcctattatcattgaatctatagcctttattcctacgtacattcctatcattttattatatgttcttatgaaactcactaaacgagatccatttttctcttttagactcatatatgttaatgttttagccattttagctatattatctttttcaattagcacataaatagatattaaaaatcccagtacaatatttaccaaattagaagtaagagataataaatataatgcaaaatcctgaagaagatccatagaaacatttccaatttgagttgctatattctgaatacttgataaaagtcctgattgagttattaattcattaattctttcatttgataaactcatattaataagctcttgaaccttaaccatgtaattaggaatttcaccagttatattaagaatgctgtcaattatacttggaattgtaaaaaatagtcctacaaacactattccaaccaaaattaaatatgttgcagctattgcaaaactccttttaatattaaactttctttcaaagcactttaccactggatttaaaacataagcacacacaagtgcatatataaaagggcttaatatagataaccctttattaatcaaactgaaaaaatacttataattatcaataaatttataacctatgacacctattaatgcgaatattaaaatatccctgtattttatatttttatttataaacaaccaaatctcccctttcttagtttactgatattaattatatcatattgaataagttataatactaactattatattaatttaagtttaacatataaaaagaaaaatctcttaagagagtcttattcatcataaataactctctcaaaagattatccatattaaatataataaacctagtttcttaataaatgtgttattacattttttccactacaccaattccaagtaattcaagaccattttttataacttgtaatgaagctttaacaaggtttaatcttgctctttttaattcttcatcttctaagtttaatactgaatgtgcattgtagaatttattgaatccttttgcaacttcaattacatatcttgttaatatagatggttccaatttatccaatgccaatgttataacattgttgaaatttccaagactcttaactaattcaaattcttcttttgacgataatttgctataatcaatacttccgctaaattcaccagctctttctaagatgctgtttcctcttgcatatgcatattgaacatatggacctgtttctccttcaaaagaaagaatttccttccaatcgaagactatatctttttctcttgaattcttaagatatgtaaagataactgctccaacaccaatttttttagcaacttcttctttattctttatttcttctttatcttttattgcttccattgttttttcaacagcttctcttaataaatcatcaagaagtacaattgaaccatctcttgtagaaagctttctatcagcgaatttaactaaaccaaatcctacatgaacacaatctttagcccattcatgaccagcaagatctaaaaccttaaagacttgtttaaagtgaagtgcttgtggagtaccaacaacataaacacacttatgaaaatcgtaagttttctttctgtacatagcagctgctaagtctcttgttgcatatatagaagctccatcggcttttaatacaatacatggaggcatattataatcttcaagcataacaacttgtgctccgttactttcgacaagtaatcctttttcctttaattcatcaaccacaacatccatcttatcattgtagaatgcttcaccattcaatgaatcaaattttacatccaaaatatcataaactctttcgaattcctttaagcttaaatctctaaatctattccaaagagctgtagcttcagcatctccattttctaatgctttaaagtttgctcttgcttcatcttctaagctaggatctttcttagcttcttcatggaatttaacatatattctaagtagttcgtctataggagctttttctaaagcttcttcgtctacccatctattatatgcacttataagcttaccaaactgagttccccagtcccctagatgatttaatccaactgtattatatccttcttttttaaacattttgtataaagaattccctatagctgtagtaaaaagatgtcctacatggaatggtttagctatgttaggtgaagaatattctacacatactgtttttccttctccaatattagaagctccataattatctccttcttctaatactttgtttaatgtatttttagcaaatacacccttatcaacaaagaagttaaggtatggtccaagactttcaattctttcaaaaccttcactgtctataagaccttttaattcttctgctatcatatttggtgcttttctcataactttagatagttggaaacaaggaaatgcataatcccccatttctggctttggtggaatctctattaatttttctatcgcttccacttctaaatctacgtgttgttttattaattctgcaattttgactttgtaatccataattaacctccattttttaattaaaagttatcaatataacatttaacatttttcttatatattcttcagaatatttcaatatttatttaattttatatatcttttttgtacctaacaatagcagaaaatctctctatgataaataaaaaacgcctcttgtaaacaagagacgaattattcgcggtaccactctaattgcatattctaaattaaaatatgccactttaactttaacgcagatcattttttcacctgcggtcatccctactcatttcaggagacttctccaaggttctcttcctattaatctatcctaccaggcttacaccatttcccagctcgcttatggactcaactaaagtactatcctcatcatcaaatctttcataataaaattaacctttatttattatacaaatacataaaattattgtcaataaatattttacttatcatattaaatcatgtatatatacctattcatattaaattctaattattttcatttacttggcaattatcaataaatattaaaatccttataattttcaatttatatgtaaaatttttattatattattgaaagtgcaaagttcataattaagtttttaagcatatacgttattggtgctattactctccacccaaataataacgctaccatgattaataatccttgatatctataacacgcatcctcaaagtttctaaattttcctggttttatatctcttacaagactaaagccatcaaaacttggtattggaagcagattaaatattcctagactaatatttatggatactgtgtataataacatcaaatataatatctgtgctaaatctccaggcataaatctatataaaaacttgatatatattgcaaatattagtgctgccactatagctacaagaaaatttgccaatgggcctgcaagactaacttttaagtcatccttgtagtagttcttaaaggctcctggattgacttgaactggtcttgcatatcctattccaagtaatagaacacataaaaatccaaaaggatctatatgctttgcaggatttaatgtaagccttccttgaaaccttgccgttttatctcctaatttatctgctactagtgcatgagcatattcatgaaaagtaaatgccagtagtattgctggaagtgttaaaattttctctaataaaaaaaccattctttcctccttatttatcactttctttagttatatattatcataatatttatatataaaatattaatttattataaaaatagataaatacatactaataaaacttaatatgtatttatcttatttattatttcttgtcagattttaatgttgtataaaccaactttccagtactatctgttgttgcaataaaatcttcttttatttgaacaagttttccttcatattcaacttctaatcctgtagtgagatttttaacagcacctttaaggttgtcattgatcaatatttcactttcattattaaagtaaatatcttttctatttactacagcttctaaatttacagttttccatgatgatgtatcttcatcaacttttccataaattatacttgatattttttcaccattaagctcaccaatataaatcacatcatttctatcaattccaagaagtgttaaattcttattagaattaaaagtaagttgcttattgggacttgtaacgtaaaatttattatttatttcatcttcatataccaatctatccacatgaggaataacctgcatatttcctaaaacactagcttgaagagaaaccctacttttatcattgttaatatctattctgtaaaccatactcttaagtccacctctataaatatcaacataataaacacttgtaaatgtagattcagttattttcattaccttcatatcatcttcataatcacatatactagtaacataacttacagatgagtctttagggctatatgtaataagctgaattaccgtttcaccatctttaacaactttttctgcaattataagtctatctctgtctgatagccatttatagtacaaaatttctccattatcttctgtcttaacttctgtctttgttcctgtcttgctttcttctatatataaagtatcattttcatagtaagtaagatattttccattataagatatattaacattttctgctccatttggaattataacattaatatcttttgtattctgtttttctatgtctattttgttacttttaaattttgatgaatgtttaaatacaaaattatctaaaacgaacaatccaccaatctgtaatattatagataatattgcccaggcaattatctttttatacaacttcataatatactctctccttaagtttatttaacaataattgctgttgggattgctctttcacccatactattcgaaggtgtatttctaacttctccatcataatataatgttgttgatttaccaccatcaagattcattgcattaacagcacctaattgatacattatctcctgagtttcttttaaagttgctccaaggcttcctacacctcttccatcaataaccaataaaataatagcaccatcttgtctctgtcctattgcagttcttggtgcaataccccatccaccatcaccactcattggtgtcatttttccattaacaactaatgttggaccgaaactcaatgcttcttgaatttttctttcttttaaatcatcaattgaatatttacctacaatcataactccttgtttatcaattgcaagaagttctgttttattaccttctccaagatcattgtgaactacttctccaccactcattactatcccagatggaataccaccatttcctgtccattgagatgttgatgactgatctacaaacgctccaccattaactgctgcaacagcattatagttttcagcaatttgtgatgtagtctgaccttcttcatttaatttagtagtatgacctactttaactcttgttggatcttttactactagataataacctgtaaatttagggttatctgcaagttcataaaattctattgtatcatctttaactttaggtatgtttatttcagatgcatttgtagtttcatctgttgcttcagtagaattattccccaaaattttatttatcttttcctcagacaaaaaccaagttgcaagatattgatgagtcatagatgtcatagcggcacctacatatgtacttttggcattattgaagggcccatataaaagcaaaaaaggaaaagtacacgctgtgaaaataaattcaaataataaaaacataattaaagttttcccggaaacctttttgttttttctctttccttttttaggcttaggtttaggcctgcgcttcatatttttgttacctgtatttttattcataataatatcctctctaaaaatgcatgctttaaacttcttttttaaaaatataccaaatcttattatatattatttatatttaaattacaatcatatcactttttcaatattaatattaaaaactcatcattattctccttcaaacactatatttatccatataaattattatattatctatgttgtaattataagtctacagaaaatataaaaaatcaactttcaaatgcaacatatagtatagtttgctcaattatctatattctaacaatattttattacataattatgctataatctcataaggaggtgcttattttatggaagataaaattttagatatattaaaaaattcatctcagcatgtatctggagaatttttaagttcatcacttgatgtatcaagaactgccatttggaaacatattaaaaatttaaagaataaaggatatcttattgaaggtatatcaaacaaaggttataaactcctttcttctcctgataaaattaataagcctgatttcttttcaaaacttaaaacaaaagaactaggcagaaattttatacattttgatttaatagattcaacaaatttaaaagcaaaagaacttgcaaaaaataattgccctaatggaactataatagttgcagaagaacaatctatggcaaatggacgatttaaaagagtttggaattctcctaaaggtggaatatggttcactttaatattaagacctcatatcccaacttctgaagcccctaaaataactcaaatagcagcggcatgcatatataaaacattacaagaattaaatattgattcaaaaataaaatggccaaatgatattcatttaaataataagaaattatgtggtattcttggagaaatgagttgtgatatggataccataaattatcttgccataggaataggcatgaatataaatcttgatataactttgctagatgaagaagttcaaaaaactgcaacatcgttaaaaaatgaatataatattgaatttgatagaaatgaaattcttgcaaattttttgaataacttcgaaattgaatatgaaaaattctcaaaggatctaaatctagaaaacacaataaaaatttgtagggaacattcaaatatatggggtaaaaaagccaaacttataacatatgctaatgaggaactagttacatgtatttctttatctaatcaaggtgatcttattatccaagatgctgatggtaatgaaagaactgttttatccggtgaaattagttttaaacttgactaaataaaattctaatgttaaaagatccatataataaaggaaatcgctatatatatttcactataaactttacatttataatttggaaaaatatagtaatattaacattaattattacctgtttattgcaatatataaaagtaatatctttaataaattcatttctagattttataaagatattactttcatttttcattctaataatttttacgttctatagctttttttagaaaactatctttctttacagacacacgtacatgctctcctgtagctattaatccattattatcaaatgctcttagtaaaaaagtatattttctaccatcaacattagtaagctctgcttctgcccatacattaacaccctctgctgtagcatttagatgttctacaataatctttgttcctacagtagtataatcatcatctaaaaaagtctgtgccaaatctgaagctgcgccttccataatagcagcaactattggagtagctaatacatcaacacttccacttccaacactacttgctaacaaatctttagtaaccaaacattctctttttgattttttcccaatttcatatttacccatataaattcacacctttctatttaagaataacaccaacttccaattaaaaccataacattctccaaagttaaattaaaaatatggcaataatttttctttagattcatttaagtatttgcacagctttaataaaacaaaaaaaataaaagagataataaaatttatcatctcttctatttaaaattcagtactattaactataataatactattccattatcatcacatatttttaaatttttatcatcccatgttgatgattgaacttctccaatatgcgcttttcttaatagatacatacatattcttgattgacctattccaccacctacagtgtatggtaattcaccatttaaaagcatcttatggaaaagaagttctcttctatcatcgcatcctgcaattgtaagttgcttatctaatgtttcttcatctactcttattcccatagatgaaacttcaaatgctctttctaaaagaggatagtagaatattatatcaccatttaaattccaatcatcataatctggtgaacgtccatcatgctttttgccagattttaatgttccaccaatttgcattataaacactgcacctttttcctttgctataatatcttctctttctttaggagtcttatctggatacttatcttcaagttcttgcgtagttataaaaaatatatcttctggaagaaatttatcttcattgattaattcattacatgtaaattcttctgccgctttaaaggctgagtatatgtttttcactatgctctttaatgtatctatatttctatctttcttatctataattttctcccagtcccactgatcaacatatatagaatgaatattatctaactcttcatctcttcttatagcgttcatatcagcatataatccttcaccaactttaaaaccatatctgtgtagactatatcttttccattttgctaatgagtgtacaatttgcacttccttcttagcttctaataaatcaaaactaacaggtctttcaattccatttaaattatcgttaactccagtattaggttcaacaaataatggtgctgaaactcttgttaaattcaaattttctgctaaagccttttcgaaaaaatctttgattttttttatgtgaacttcagtttcaattaatgaatatttgcttttataaccttctggaattattaatccttcaatgttcatgtgtctgccccttaaatttaatagccaactatattcacagttaacagttagcaagcaacagttatctgttaaaatatacaaacattcttatgtcattattattaactttttaacttcattttatttttagttgcatgcatacaaaacaaaagttaaatttttaagttgtgtaataatatataaaaatagatcaagactgattattacaatcttgatctatagtcagcttttctattttataattttataaaaattttttacatttgtcaatttttgcgtaaaattattttcttattcaaaaataatttctattatttattaagtaccttttgaatattttcttttaatacttttgctgaatcttgtaattttttaagttctttttcatcctttataacaggattaactattcttactgcacctgtactgttaagaactgttggtactgctaaataaacatcatcaatatcgtattgaccttccatcaagcttgaaactgttaatatagtgttttcatctctcaatatagcttcaacaattcttgttgttgcaagccctattgcaaaatatgtagcaccttttctgtttattatctcataagcagcatttacaacatcttttgcaattacttctttaatttcttcatcccattcaagattaaactttttagcatattcatcaaaagtttcacctgctatgcttgcagtactccaacttacaacttcactatcaccatgttcacctaatacataagcatgaacgttattattatttacatttaaatattttccaataacatactttaatctagatgtatctaacactgtccctgaagcaataactctttctttaggaaatcctgataatttatatgttatatatgctaagacatcacaaggatttgatactactaataagatagcatttggacttgctgcagcaatttgaggaataaatcctttaaaaatgttataattcttttctataagatctaatcttgtttctccttctttttgagccgcaccagcagtaattactactatatcagaatccttagtttcgcttatatcgccagcgtatatgtttacaggctttacaaaagatgttccatgaactaaatccattacttcacccattgctttatccatatttatatcacaaacacaaatttcagttgctactccactattcattaatgcatatgctgtagttgctcctacgaaccctgctcctattaccgatactttacgttttctttctatcatctatttttcctcctaaattatataaatataatattattatttacaatatgttagaatattattatttatatattactttcaactattaacaaacaaaatttaatttattattatttagtaataattatttattattatatcgtatttgaaatttgtcgtaaatactatataattaattttaacaagttaataattaattttcttatgtatacataaaatggaggtaaaactttaatgaaattattattttttgatacagaaactactagtatcaaacctgggagcatctgtcagctaagttatatcactgtcgatgcaagcacaaaacctcaagtgactacggggaaaaatttcttttttaccgtagatgaaatggatccttctgcccaagaaatacatgggttttcattggaaaaactttatgaattatctgaggggcaatatttcgaagatttagcttttgattttataaatgacttcagagaagctgactttataattggccataatgtgaattttgatattagatttttaaaacatgaattattcactttaggagaattatttgaacctaaaaatattttttgtacaatggcatattataaagatatctgcagaatccctaaggctaatggcgaaataaaaaatccaaaactttcagaagttatagactggctaaatgtatcagaaaaacagattgccgaaacttctgaaaaactttttgaaggtagcggaaactaccatgatgctagatttgatactgcagctacataccttaccgttatagaaggcttgaaaaaaggtcatattgctaaaggttactttacaaatattttaaaacaacaaaactaatttttaaaagataagtctttatattttatcatagagatttatctttttttcattatcaaattacacaaatcatcatataatattagtaagccttaatgaataaactgtagatacttaaatggggtgtgattagttgaaaaaatatgtttgtgaagtctgtggatatgtttatgaccctgaactaggtgacgatgatggtggaattgatccaggtataccatttgaggatttgcctgattactgggtatgtcctatatgttctttcagcaaggataatttttctcctgaatagtaatttccatgaattttctttataaatcttaaaacgagttttagaaattatattaaatttctaaaactcgtttttctaatatccaaatatgtctttttgatattttttgcacaaatctttatccatagcttcaacattttctaatggatattttattttcattatttcatatttatttataccaagtaaatgatatggaagaagctctaccttttctacattaggtattgtatctatatatttcttaagttccttcaaatggccttctccatccgttatacctggtacaacaacatgcctaatccacattttagtattatttcttttcatagcttcaaggaattttagtgactcatctatatccattaatgtaacattcttatacccctctcttgtataatgtttgatatcatacaatacaagatcagtatattttaatatttcatcataatcaccaaatccatatcccgatgtatctaaacaagtatttatatttctactcttacataatttcaacacttcaagcaaaaattctggctgtcttaatggatctcctcctgaaaatgtaactccacctccacttgctgcaaaataacttttaaacttttcaattttatttacaagttgctctggagtatattcttctccaccactaggagtccaagtatcaggattatgacaaaatttacatcttaatgcacatccctgaaaaaatacaacaactcttattcctggtccatctacaagtcccatagtttcaactgaatgaatttttcctttaaccattttatctccaccttttcttcaattgacagttatggatgaaaactttcagtttccttaatttattaagtatcaattgtttattatcattcatacatcaatttaattatgctactttttatagtaaagtaaaaccttggattaacaaagcttcatccaaggttctacatcatctatattattttatcttttgtaaatatatttagaagttaaaaattacattttttcgtggaatgttctatttataacgtctaattgttgttctcttgttaacttaatgaagtttacagcatatcctgaaactctgatagttaattgaggatattcttctggatgatccatagcatctaataatgttgctctgttaaatacattaacatttaagtgatgcgctttttgaccgaagtatccatccatcatagcacttaagttagtgatttgatcttctttagtctttcctaatgcatctggtacaattgagaatgtattagaaataccatcttgtgaatgttcatatggtaatttagcaactgaatttaatgatgctaatgaaccactgttatctcttccgtgcattgggttagctcctggtgcaaatggttctccagcttttcttccacatggagtagtaccagtcttcttaccataaacaacgttagaagttatagttaatactgattgagtatggtatgcatttctgtaagtcttgttctttctgattttgttcatcatgttttcaactaagaatacagcgatatcatcaactctgtcatcatcatttccgtatttagggaaatcaccttcaacttcgaagtctacagctattccttcttcatttcttattggcttaactttagcatatttaatagctgaaagtgagtcagcacaaactgaaagtcctgctataccacaagccattgttctgaatacatctctatcatgtaaagccatttgtaagctttcatatgaatatttatcatgcatgtaatgtatacagtttaatgtattaacataaaggttagctaaccaatctgtcataacttcgaatttttccataacttcgttataatctaagtattcagaagttattggttccatcttaggtccaacttgcattccatacttttcatctttaccaccatttatagtgtaaagtaaagttttagctaagttaactctagctccgaagaattgcatttgcttaccaactttcattgcagatacacaacaagcgatagcatagtcatctccccagtattcaagcattaaatcatcattttcgtattgaactgaacttgtgtcaatagaaacttttgaacagaaatccttaaatccttgtggtaatctagttgaccataaaactgttaagtttggttctggtgatggtccgattgtatatagtgtattaagaattctgaatgagttcttagtaactaaagttcttccatctaatcccatacctgcgattgattcagtaacccatgttggatctcctgagaataaatcattgtattctggagttcttaagaatttaactaatcttaatttcattacgaaatggtcgattatttcttgagcttcttcttcagttataactccgttttgtaaatctctttcaatatatatatctaagaatgtagaagttctaccaagtgacattgcagcaccgttttgttgttttattgctgctaagtatccaaagtataaccattgaactgcttcttgtgcattagttgctggagcagatatatctattccgtagcttaatgccatttctttaagttcttttaatgcaacgatttgatcagaaagttcttctcttaatctgataacttcttcatctatagtagttacttctaatgttttcttttgagctattttatcttcgattaatttgtcaactccgtataaagcaactcttctgtagtcacctatgattcttcctctaccataagcatctggaagacctgtaactatacctgattttctagctaatctcatttcatctgtgtaagcatcgaaaacaccttggttgtgagtttttctatacttagtaaatatttcagaaatcttaggatttacttcatatccataagccttagctgcattttcagccattcttattccaccttcagccattacagctctctttaaaggtgcatcagtttgaactcctacgattttttcaattgctttgtctatatatcctggtgcatatgcgtttattctagatgcagtatctgtatcaacatctaaaactccaccattatctctttcttttttgaataagtcacttacttcatcccataacttagtagtgttttcactagctccagctaagaaagaatcatcaccttcataaggagtgtagttaagttgaataaagtttcttacatcaacacttttttgccattgtccacttttaaacccatcccattgtttaaacataattgtttcctcctttgttttgtatatatcttttaataacgaaatatacactttaactaaaatcaattattcaaagctttataaaaactttgttaaatcatcttcaatatcattgtaatacataatcgacaaaatgaaaagttttttttgaaaacaattaaaaatttatttgttttttatatttttccaaaactttattttaatatttttgattttatctaagtttcttccgatatttgtcccatgcattgttcacttatagttcctaaagcctaaaagattgttaattttttatcattgttttcttgtttatattttctgattattcattcaaatgtttttatgatttataactttcattttttatttttttctaataaataaaaaacaagttctaaacaaaagtctatcccttattcttctagtttattataaatattaacaagtaatgattatccaaaacaattatctaaataaaatgcaaattgcaatatttctgttaaatactatcattaactttaatacttactatttataattgttgttctcttgtcaatctattcactttcacttctcttcaaatataaaacttacatcagtatttatttcttaatacataaaaataaggtgaagtcactagtacatcaccttatttttccctatatattgtattattttgcaccatattgagaatagtaatcatcaattcttgcttttatctcatcattaataattattttaccattaacttctttattatataaatattctataacttcagccatagttactattgcacaagttttaaaaccaaatttttctcttatttcaactaatgctgattgttctccttggcctctttccattctatcaacagaaattataagcccttttacatcaacatctccttggctctttaatataggcattgtttcataaatcgaagttcctgctgttgtaacatcttcaactataagaaccttatctccatcatttatcttacttcctaacaagatccctttatcaccgtggtctttaacttcttttctattagaacaatacttaacatctatatcaaaattatttgataatgcaattgctgttgtaacccctaatggaatccccttatatgcaggtccaaataatatatcgtaatcatctccaaagttttcttttattgcttctgcataaaattctccaagtctgcttaactgacttcctgtttgataattccctgtattaacaaagaaaggtgtttttcttccactctttgtaacaaaatctccgaatgtcaacactccacattcaatcataaaatcaataaattcctttttgtaagctttcatcttttattcctccgttaacttcaaacttttttattaaataattcctactatatcatttatatccttgattccttgttctttcaaaaatgcttccatttcttcaattatttcttttcctgccattggatttataaagttaattgttccaatctgcaccgcacttgctcccgccatcatgaattcgatagcatcttttcctgtagatattcctccaagacctattacaggaatatctattgccttagaaacttcataaaccattctaagtgcaacaggttttactgctgggcctgaaagaccagcacttatattattaaaaactggttttcttttatatatgtctatcgccataccttttaatgtatttataagtgaaatagaatccgctcctgctttttcacattttacagccatatcaactatatcttcagcattaggtgaaagtttcaccattaatggttttttcactatggattttatttctttaacaacatcatatgccacatctgattttatcccaaaagccattccaccatgttttacatttggacacgatatgttaagttcaatcatatccacatcagcttcatttatttttgtgacagcagcaacataatcctcgatacatcctccacctatattagctataacattagtaccaagttttctcatcttaggaagctcatttgatataaatgcatctatccctggattgttaagtcctactgaattcatcattcctgaaggtgtttcaaaaactctaagtccatcattaccttctttaggattaattgtaagaccttttgaagatatacctccaagaattcctacatcataaaagttattatactcagctccaaaaccaaatgttcctgatgcagcaattacaggattcttaaaatctacaccatttatatttacgttcatcatcttttaattcccccttagttacaattccacatagtatccatcaaatacaggaccatctttacacgttctcttgtttccttcttttgtcttacatgtgcataccaagcaagcacctactccacacgccatatgcttttccatagatacatacactttaacatttttttctttacacatttcaattacttttttcatcataacttcagggccacagcataatactgtatcatatttttcaacatttataagttctgtaacaaaacctttatgtccatgacttcctgtattagtggatacttttatttcatttacataaggcttaaaatcatccactaaataaacatcatctctaaatccacaatataaatctataacttcattattattcttagctcttagtctctttgcaagttcaaacatcggtgctgtacctattccacctgcaactaatgccacttttccataatccttatccaaatcaaatccatttccaagaggacctgttaaatttatttcatcattttctttaagtcctgcaaattccttagttccagttccaactactgcatataaaaaagttaactcatcaccgctcttttcacatatacttataggtcttggaagtaaagttgctccattaagctttagcatgtaaaattgtcctgcttttatttcacttttatcctcaactactaatttgtatatatcttttgaaatttctttatttgaaattacttttgcacttctatatgtaatcgccatttttacccctccgtaggtagttaacagttaacagttaacagttaacagttttgtggatagaaaattgctgagcaattttctaaataaactcttaattgttacttgctgaccataactacagtatcattttttagaaacttatcattcatacaataaaattactttagtaattttattaccaactgttaactgttacttgttaactgctaactgtattgcgtctctcatttttaccgcttcttctcttgcacatattgcaaaatcttcagcaggtcttccagcttttttatatgctaataatattccccttgaagaattaacaacaccgccgtttccattatttaaatataatgccacatcttcagcagtaccccttgagctccatatcctggtatcaagaagaacatgtttttatagtttgctcttattttctttccttcgtctacatgagtacatcctataactccaccaatcgctgtatatccacaacttccagtgcaacttttagccatttcagtaatcttatcagcaactacttcataaactttttttccttctacagtatctaaatactcaatatcttctgctcctggattagatgttcttactaagctaaatactcctttttttccactttctaaataaggcatatatggttctatactatccattcccatataaggacttaatgttataaaatcagcttcaaaatccccttcaaaatgagcttttgcatacatttttgctgtagctgctatatctcctctttttatatcagctattattatttcatctttttctcttaaatactcaagagttttcttatacgcaataagaccttctaagcctaatgcttcataatatgctatctgaactttaaaacaagctgcaacatcatatgtagaatctataatctgtttattaaactcaaatatggcttctcctgaagttctgccttctcttatatgttctggaacataatctaaagctgtatcgagtcctacacaaacaacgcctcttttttctactctgtcatataacttatcaataatattatttgtcattttaaagttcctcctgttttttatttatatattttttataattagtttttcttatatttaattactccgcccttaactgtagctaaaatttccccataaaactccattccttcaaatggtgtattttttccctttgataaaaattcttcactattaatttttatctttttatctatatcaacaagaactaaatccccttcagttccaatacatactttacctttgttcatttctaaaagttttgcaccattataagacataagctggcttaacttgtttaatgagattccgttttctctaacaagtttcgtataacaaattggaaatgctgtttctaatccaaccattccaggtgaaccttttttcttttcctcttctgtatgcggtgcatgatcagtacctattgtatcaaccattccaagtttaatagctgaaattattgcatcaacatcttcttgttctcttataggtggatttactctataatcatttatatctcttgtaagacctatgtgatgtggtgtaacttcaagagtaatattggctccgctcatcttaccatctattatgtactttatactttctttagtacttacatgacacatgtgaagtctagcaccacttaatttcgcaagttctacatctcgaagggtcatcatattttctgctattctcatatctatctttgaaaattctggtgattcagcatgagacattatgatccaattatttttctttgcaattttcatcgcttcaagcatggtattagaattcgaaactccaacaccatcatctgaaagtgcttttatctccaagtcatcttttaactcttcaagatgcgataaagttattccatcaaaattcttagtcacagaaagacattgatgtacatctattaaatccaactctctgcttttatttctaacatattctaatgtttcttttgaagaacatataggatttgtatttgccataaggcacactcctgtatatccgcctctaagtgctgcctttgatcctgtttcaatatcttctttccatgttaatcctggatctctaaaatgagtgtgtgtatctataaaagaaggcataaccactttaccatctgcatctaatatttccgaattctctttatttatatctattcctatttcatttattattccatcttttatataaatatctccgataaaatcttgggataaatctattattcttgcatttttaattaataattccatataaacaccccgcttattcagttgatcattgaaagttgataattaaaagttaaaattattaaattactctgtattttttgttattacaatttaaaaaatccccttaagaatttcatcttaactttcaactatccactcttaactgctatgctatagtcttgttatagtatcacaatattcacatctatatctgccagtttccttgtcaacaagtatgaatgagtgcgttacataatcttcaactcctgttatgcagcttggatttttgcatcttattatattttccactttttccggaagtgtaggttttaccttgtttacaataacctcatcctttacttcacatattgtcatagttggtgaaagaagacctaaaactgtatagtcaagcttttcgcagttttctatttttattatatcctttttacctaattttttactatctgcatttattataagggcaacactataatcatttttatcaagttcaagataattaaatattttaataccctttcctgcttcaatatggtctattactataccatttttaatgcttgttatttctagcatctacatcaccccaaaagttttatcataagagccattcttacatacataccatactctgcttgtttaaagtagcaagctctctcatcatcatctacttcatatgatatttcattaactcttggcagcggatgcataactatcatatcttcttttgccatattcatttttgttttatctaatatgtaactatctttcaatcttaaatattcttcttcattaaagaatcgttctttttgaattcttgtcatatataaaatatccaaatcatttattacatcttctagtttttctacttccatgtattctatgttattcttttgaaggatttcttctcttatatattgaggaatcgcaagttccttaggtgatatcaaaacaaatttattatttgaatatcttgacatagctttaattaatgaatgaacagttcttccaaattttaaatctccgcatataccaatagtatgattattcaatccattttttaagcttgttattgtaagtaaatctgttaaagtctgagttggatgctgatgacctccatctccagcatttataacaggaactcctgaataaatacttgcaactttcgctgcaccttcttttggatgtctcattgcaataatatctgaatagattgataccatctttatagtatcagaaagtgtctcacctttagaaattgatgtagaactcggttctgaaaaccctaatatttttcctccaagtctcatcattgcagcttcaaagctcaaccttgttctcgtacttggttcataaaataaagttcctaatatttttccatcacatatgtgtgagaatttttgtggatctgccataatttgatgtgccagttcaaagatttcatttaattcttctactgtaaaatctctaggttctattaaatgtcttattttttttgtcatttttatcactccttcttaacctctccgtgttaatttaaaggcaggaaattatataaaaaaagcctttcctaatttaaaggaaggcataataatcctaatgcatctacattgttatataacttccttattgatctctctgaatcaaattaaaggttattctttgtgtaagaataacacttattttttactgtgtcaacacaaatattaatacagatactatcaaaccttataatcaacataaaatttactatgtgattagtaattaaaatcagcaatatgaaaaataactctaatttaaaaatatatttctacttacaataatagttttatccttaaagcaaataaagattccattgctggaatctttatttatattagaaattattcattacactatcccacatcatctttccacatttagctaaagttacagttccataaacactattaggaattcccatggataacacagtaaaagtaaacgatcctttttgtagatgtaaaagcgctgtatcattttctactccactcttatctcctgttttacttgatatctcatatttcaaatcatctggaatatataatgctagtttgtttttcatttgctgtctttgcaaaatatctatcaacatagtgctatttttttcatttaaaaaacttgaattatgcaaatgcttccatattttagataaatccaaagcacttgttatgttttcaacaccactacttactgctctttcatctgctgtctttctatttaatttcgtatttctcaatccctggctttgtatatcttcattaatcgtatccattccaacaatatctataagcttatttgctgctgtattatcactttgtataagcattgcaactaataattcaaaaaaagtgtattctctattgttgaattcatgaataatacctgttccgtatactttgtcgtcttcattaattgttattttgtctaaaaatgatccttttccatcttccacatatttaattgccgaaactgctataggaagtttcatacatccagcacttgtcatctgaacattttcgttatatccataacaaaatccactttctaaatcttcaaagaaaaatgcatatgttcctattcttgtttctaaatacttcttaatttctttcatcatacccaccactttctaaaatactaattaatgtcaccaggcatattatatcctcaatgttaattataacagatatcactatttgttaaaaactgttaatcagcaaacgatatacctatcttctttgcaactgttactaattccccttcaggatctacttttttattgtttcctattacattttccaaactatcataagttatttcatttccttttaaacataccatacttccaaattttccttcattaataagttctacggcacctacaccatatcttgttgacaatattctatcaaaagtacatgtagttcctcctctttgaatatggccaagaacagtacatcttacttctctttcttttacaagcttttctaaatcttctgcaagcttatttccgattcctccaagtcttattggatctggactatcttcaactattttagcaaccataacctctccatctttaggttttgcgccttcggcaactactattatagtgaataacttaccttgtttttttctctcttcaaccttttcaacaattttatttatatcgtatgggacttccgggatcaatataacatctgctgaacctgctattccagattctaatgctatgaagcctgcatttctccccatgacttctaatatcataattctatgatgagattctgctgttgtatgaagtctatcaagagcttctgttgcaatatctatcgatgtattaaacccaaatgttatatcagtcgatcctaaatcattatcaattgtttttggaacacctattacattaataccttttctcgcaaaatctcttgcagatgtgagagttccatctcctcctattacaactaaaacatcaacattttctttctttaaattttcaactgctatatctgatacatctttttttaatgtctttccatcttcaacaacctgataatcaaataggttatctttatttgaactatatagaattgtgcctcctcttggtaaaagacctgatacagttgataaatccagtttcatgaaatcattgttatatagccctctataaccaaacttatagccaataacttcataaccataatttaaaattgctgatcttgtcgctgctcttattactgcatttagaccggggcagtctcccctccagttaatagtgctattttcttaatctctttcttcattttaatcccccataccataatctctttaacaaattttcaatattttctgaatatttgttcaaaaaatttttaatcatcccataccttttttaaatagaaaagtcatacaagtatacgattacttctatttattttatgatatcataaacttcaatctatgaaaagtataaattgacaatatatgctttattatataaatatctgaaattatttttttctttttatcatactattattatatagtttttttttagatatataccaataaatatttttacattaataaaattatgtaattctatttttattccatattataaagcaaaaaaattacagcataaatcatagtatgcagattcacaagcatcaatactcaatctaatctgcatattataataaatcactgtaatttacatattaagattcattcctaacatcataagtattgcaaatataataccaatacctactctatatactgcaaatactctcataggtcttttctttaaatacgctacaaatttctccataacaacaagagaaacaataaatgcaacaataaatcctactattaatgttatccacaatgtcatattcatcattgaaaaatcaaattcaaaaagatcttttgcagtagaccctatcatagcagggactgctaaaaagaaagaaaattcagcagctataggagttgataaaccagctacccatccccccataattgttgatgcacttcttgacataccaggccatactgcgagaacctgaaacactcctacttttaatgattgaagtggtgttattgaatctatatttttagttgaatactttctattttttctgaatttattttcaattattattaatagaataccgcccactatcaatcctgccatcactattttaggattgaaaagcatttttatctgtctataaaacactattcctattacccccattggtatgcatccaatgagtacatttattccaaactgaaatcctgtttttccttttttaccttttgtaaatatataagtaaaaaattcaataacactatctttaatctttttccaatataatactacgactgcaagtatagctccaagctgtattacaacttcaaacatatccacaaatacctttggatcattaaatcctataatacttgatgcaagtatcatatgccctgttgacgatacaggaataaattctgtaagcccttcaactatagctattattatagctttcagtatgaataaaaagtctaaccccactatttatcactcactttctttttcgctctgtttcattataataacatttctatatattgtaaacagagttaattatcaactaaactcttattactttttttctataaccacacttgtcattgtattttgtccatctagagataattcaatagtattacttccattttcaagcttaacttctttattattttcaacttgttcatagccttgtccatttatatttagataataagactttaaaactttatcatctttaaatgcagctacaaatatattattttcttttttctctttttctttagtttttttgttattaggatttttatcttcttcttcattatttgatatagaaccacaaactaataaataagccttttcatcgcttcctacaagtttatcaaaaggacttttctcaaataatttagtttctttagtaaaaactgttggtggtgtaaaactattttttatcttatattctacagcactttcattttttatatatgtaacattacaattgctcctcttctttttggaactgttttcaattgataacgtatatgaatcaaaatatttacttatattatttttataatcaagttgagatgtattgcccatataagaaaccttttttatattactatttatcaattctatagatgacaacttattgcttttatcatcttcaaaatatccaccatcactaaaatcaaccataacccatttattatcttctgtactccaatactcaattacataatattctacatcggaatgatattctgtctgtccttttctaaatacaccaattctgcttcttatacctagacaattgagaaaatctcttgcaactatagccatatccctaaatgatgttttatttgactgagttttcatggataatatatcatatccattatttaatcctgtattctctacatttgcaacactaattttgcttcttacaatatcaaatgcttttaagaccttattaatttcagttttttcactattaacttgttcttttataccatatgtagaatttataagatctaatttttcatttatatgatcttcataaaaaaacacaatattattttcattatagtaattatcccactttactatttctacacctttatttgaaataagattcataatagtcagcaaaattcctccagttagtaaaaaaatcccacataaaattttaaatctatttttatttaatatagacatctcataccccctaatttatactctattattatttttcatataataagtattttaggattatatcatattaataaaattaattttgatataatcctaagtgttttttataatagtatatattaataaatcaattttacttctgatactactccagcattgtttgatgaattattatttctagaagaatcataaagaacttttattctattataattatctgttattatctgcttttctgtattacttactgtttcgtcaataccttcaaaagctcccttaatattagtcattgctctatttacattatgctcaacataaatataataatatgcagcattatttaaagttgcaacatcacttttattaagctcataagcttttctaatctcagccattccctcttcattcttatttttctctaaatatatacttcctaatgttctataatatttaggctctttgccatttaatgatatacttttcttaagcaattctactgcctcatcgactctttgattgttatactgaatcaatgccattttataatatacttccgaattattaggatttatttttgatgccattgtataatagtacattcccttactactatcttgaagaacttccttataatattcagccgctgtaatcataaaatcaaaattaaaaggctctttatttaaggctattctaatataaggttcttcttctaataacttattttgtttaaaagcaattgaaggaattaaagaactatatgttttaacataatttccattaagcattatagttttttttgcactttttaaagcatcttcatatttgccttcataataaaatttcatagcttgtgcatattctcctataaatgtaccttcatttatatctattatctcatctaatgctttttctatttcttttttatcatttgcttctgcatttatttttacttttataaataaataatttgtattatcagaaaattctccttcaagctcgttcataatctcctgacattttacaacatcagaagaagataatgaatatattttagctaaaaataacttataactttgattatttttatctttttcaattaatttgtttattgaatctataatagtatttttattatatctagaaacatcttctaaagcgtcaaatatgttaatgttattttcattaattttatacgcctcttctaatagctttaagccatcttcatatttacctataaacagcttcatttttcctgcaattacaagtttatcagaatctgaactttcattcataaaaatatttattatctcttctgcctttgctgtttcattattagctatgtataccgcaaacattgtttttaacaaattcacatcatctggatataattgcataaacatttgtccatactctgatgattttttaaattcaccattcataaatgaattaaacactatactgtttgctaaatccttatccttttgcttataatcttctatatttactttttgagtatccataattttatttcttgtatcatatactttttgaattaattcatttgattttttataatcaccttgaacagaatatatttcacttattcttaaattccaaacaggccattcttcttttccttgtaatgaattatattctgaaatggccacatcatattttccatttaaaaaagcttcatcaccattattagtagttatagaaacttttgtatcctcagttgtcgtattaaattttacaactaatacaatagccattgatatacatatataaataatcattaaaatagtcggtataaaatatttatttttggaaatatttgctttgttatcactcattgttttcaataacaaatccccctttaacttttctttttatttatactaaattctattgtatcaaaaaaactcataaaaatctatacaatactctttttttacattaatatatgagttatttttacatttttcatatagtaatccacacgatttttaattgacagttagcagttttaaacaaaaaatatctcttaggaaatatttattctatacttcctaagagatatttatatattttacatactaaatttactatacattaaatctgaagtttacaacatcgccatcttgcataacataatctttaccttcaagtctgaactttccatgctctttagctgctgcttctgatccacattcaactaaatcatcgtatcctacaacttcagctcttataaatcctctttctatatctgaatggatctttcctgctgcttgtggtgctttagttcctcttttaattgtccatgctcttacttcttgaacaccagctgttaagtaactcataagacctaataatctataacttgtttctataagcttatctaatcctgattcttctaaaccatattcagataatatttcaactttttcatcatcttcaaggcctgacatttcttcttctatcttagcacttactaccattacctctgagctttcgctaattgcatattctttaacctttttaacataatcattatcaaagttaccttccataacatcgtcttctgaaatattacatgcatataaaactggcttagaagttattaagaataagctttttacaaaaacttgttcttcatcagtaaattctaaagttcttgcaggcttatttgcctcaagttgttctttaattttttccattattgcatactcaaacttagcatttttatcacctgatcttactagtttaacgcttttttccattcttctttcaagcatttctaaatctgagaatattaattcaaggtttatagtttcaatgtctcttataggatcaacatttccttcaacgtgaacaacattttcatcatcaaaacatcttacaacatgaactatagctgcaacttctctaatattagctaagaatttatttcctaatccttcaccttttgatgcacctttaactaatcctgctatatcataaaattctattgctgtataaaccttcttcttagtgttatacattttttctaaaacatctaatctcttatctggtacacttacgacaccaacatttggttctatagtacagaatggataattagctgattctgctccagcttttgttattgcattaaacaatgtgctcttacctacatttggtagacctaccatacctaatttcatctatgtacattcctttccaattcataactttatataatatgacaatcactataaaattgttaactagttattgttaattgtcaactaaacaaatacatctttaaaaattatactctagatatattttaatttcaacatttctatatataaattaccatgagttttatttcattaattacaaataatattactaccaagataaatttgatgaattgaaggtgaaatattatatgaataaaatgcttaaatatactctagctttatcattatcattaagtataactgcaaatgtaattacacctatttcagcttctacttctgttggaactgatactatatattctgaagaatattttatgaatgatggtgctttaggtgacattgcagatatggaagatttccaggagatattcactttttcaaatgatcagggtgaattaaattggtactatgtaggtaaaggtaaagataatattgctgaaccaccaaaggaatctgcatcctttttagaagaaaatgctgcttattaccttggaaatacttccgaaaaagtaatatacttaacatttgatgagggatatgaaaatggtaatacaggaaaaatattagatatactaaaagaattaaatgttcctgctgccttttttgtagttaaaccttatatagacaaagaaccagagttagtaaaaagaatggtaagtgaaggacatattgtaggaaaccatactgtccaccatccttcaatggctcagattcatgattccgaaaaatttaaagctgagcttacaggtgttgaggatgcatacaaagaattgactggtgaggaaatgcctaaattttttagacctcctatgggaaaatactcaaaggaatctcttgaaatgacaaaaaacctaggttacaaaacaattttttggagttttgcttataaagactggcttgtaaatgatcagccttctgaatcaagaggaatcgaaaaaataaccaatggatctcatcctggatgtataatgcttcttcatgctgtttcagatactaataccaagatacttaaacaagtaattaaaacccttcaagattccggctatgaatttaaatcattaaatgacttgccatcttaaaataatttatatataaaaatgcagtgaaaatcactgcatttttatatatactattcttttatatatttacttaagttgtcgttaaattttacttctgaattttttgatttaataacttctttaatcattttgaaatcatttgcacaatagtatgaaggacttatatagtattttttaatcttggcatttttatctgaattttttttattacttgtctctctatatgcgattgtaacatattcttttttcttgttcttgtcttcatttccttcttcaactgctaatgtagctatgttactatactttattgttgtaattaaatttttattctgataaaattcaattttattttccttcaaataaatatctctgctatattctacccataaagctagcgcagttactattgctacaaataaaaagaatacaaaaagcacacttgcaaatccctgagtaatcccataaactaatgcaactaaaaattctgcaacaacagccattaccataaaactatttttcttttttattataataggatattttttctcctccatattctccccccatttctttagttaatatcataacttttattattaataattatatcctatctataatatgtttttcaatctttaccctaataattattataaaaattcataaaatgtattaattttaaatctaaacataaaatacttttgaaaggaagtgttaagtatggcaacaaacaaagaaggcagttgtaatcctatgcaaaaaggtaaaagaagacaaaaattacatgataatcagaataatgtaggaaatccaaaaaataaatctcaatacgaaaattttaatggaagtccagtagattaataaaattaaaggagatactaaattattataattcagtatctcctttaattttcaaacaatttatgcgtaaatcactttatcaactatttcagaaattttatttttttcttcgattgatctttctagcatctttatcaattctttatctaattcttcaaaaaattcttcacttcttaatccattcaaatttacttttacattaataatagagctttctattgcgctatgaagaagaattgctgatattcctaagtcagataataacatcttattaccatattcagccataacctttagattttcataaaatattacacattctcttgctaaagctaaaggtgcctccattgattttattgtattctcttttattgcattctttcttgtttctttctcatcatcagtatctttaggcatcttataacaatccataagtttcaaaaaattttctctgtcttcatccataatctcaagacttctttttgaaaattctaaactttttgtttgaaattttcttataatatcttgagttttttcatctaatcccatataactttttttccctacagttaaagaatacaccattgaatttaaagcaccagataaagctgcaataagtcctgcaacacttccacctcccggtgccggcatatcactttctaagtcatttataaacttttttatagtatcatcacaaaatttcattatattgatccccaactttcttatgtttattaattattctatatttctatttcctataatagatacaaggtatccagaatatatccaaaaaatcatagaaataaaactaattatatatattagtgtactttcaaacaagttaactgcaataattccaagaatcattgatgttaatgtagtcatttcaaatttttctttttttcttaaatgatccaatcgatttattataaatacaaataatataactataaaactcaatatcattactaaagatacaattccatttacagttgctgtttctatatatatattatgcaatcttcctgtagataaccctggcaaatcatctgtttctcttgcatttgtcactgcttcaatcatattatcatatccaactccagtaattggattttcctgtattactatggatgcagattcccaaaggcttgttcttccacttgtaaaatctcttatatgacttccttccatatttactgctcctatacaggctactataggcaaagccaagagaaatgctcttaagtatttattactaccataaacaaatatgaagcaataaacaacagctattactattaaggctgaactacgacccttaaatgaaatcatagctaatgcctgaattataatatttaatactaacaataatttaattttataattccttacaatgtgatggagatatatggacataactattgcaattgatgctgcaattgatattgcattagggttttcaaaaattcctgccctgcttccttgaaatacatactcctttatagatatagacttatcaaaaaacttcattaacaaagacactgatgaagaaataaacataaaaatcacataacaataggttattattttcatttcttcaaccatattttttttatttctaaaaacatcaacagtaaaaacagccataaataatatgagattaactatccatattttcaaattttcactgcttctgtatataaaaatattaaacaaaagagtgattacaacaaaaattccaataggaatatcgaatgcaaatatttttctttttttatagtcattaaacaccataaatactattaataaaatcccccaaactaaagctattttacttaagagatttattccagggattacttttaatattgtcactaatgttaaacttacaaatagataaaataacctaaagtaaaatttattgtctaaaaatttatatatttgttctaatttatctttcatatatttctttatacactccttttagcttttcaacaagtacattttctgaatagctaagaattgttttctctcttatttcatttttatcataagttttatactcatttttcattttaacaagtgcatcttttaatttttcaacatctttcttttcaattataattccattataatcttttattatgtcatctgcaccaccattataggttcctataacaggttttccacaagctaatgcttcaatataaacaactccaaaagtttcatgctctgaagccagtgcgaagcacttacaatttttcatctcttttgctacatcttctcttgatagagctcctaaaagaaaaatttgattctccatacctaattctttaatcattccttcaagtttttctcttaatgaaccatctccaccaattcttaagatagcatctttatttttaaaggctaagtaaaatgcttctataagattttccatacctttaccttcttcaagaaaagcacacgaaaacatattaaacgtatcttcagaattatttttttcacttgattttatatcaatattaaatttttttaaatcaaccatattatgaattacttttatatcattattagtataatttttcatttcatttttcagcccatttccaactgctattagagcatcagctttatcataggccttataaatatattttttataactctccttaacatatcttgcatattttaaagaagagtgttctgtgagtactagaggaatattgtatttattgcttatatattgtgctgatatcccccccataaagcagaatgagcatgaataatatcaattttaccttctttttctactatctctttatataatttatccattcttttattgaaacttctgaacattaatggatttttaggaagataattaaaatctttataacggtatgttttcaaattatcttcaattgaaaattcaatacctctattctcctttattcttccaagcatcgttattgcccatatctcattgtatgcaacagttacttttattcctgcatttgaaagtgccttaaactgttccttaaaaaagctcccatgaactttatttcttgatgatgcataccatgatggaattaccattatatgcatttaatcactcctcatttaataatatactatttaatctttcaactatagagttccattcatagttcatgtctggtgcacattcaagatttttttccttaaacatttctaccatattatatatttgattctttatttccataacatgattatttgttgttatacacttttcattattttctactacagacttgattggatcattttcatctccataaataacaaaaatccttccttttgctccaaaataatcataaatttttgctggtatctgttttgaatttttgtttccaaatagaagtaatatatctccattaagcatatatttaagtgcttcatcaaatggaattcttcccgaaacttttgctacttctaaattctcaagtcttcttcgtccatctacatcatcaatatttccaaaaaataaaacattgaacatcttataaacttcataattttcttcttttatctcctctagtgctgtcacaaaaggttttatatctcttaacttggaaaaaatttcacctgtatatatcatattgattttattgctatttattaattcaggtgatttctcaaatgaaagtttataatagagtttagaatcaaatcctctatttaatatatatgtctttttagatccattcttgagtttactatagtcatttagatagtcatttttattagcttctgttacaaaaataaaactatcagccatattaacaatctttttttccatgctgtgttctattatctttttaaaaatcaatgatttctgccttgtagaatccttaagccatggatcactccaatatgtgatccatggtacatttttaaatttactttttatttcataagcgcataaatgagaagatggtggttcatgcattgaaaaaataacatcaaatttttcttgttccattaatgtttttccataagcacctgcttttttagaccatccataatacatatctggaataacaagcgaattttttatttttcgcaatactctttttactgatccattactatttttcccattagctactttagttgaattttgtaattttttgggcattaattttttaaatacaataccgccatctataacatgaagtctaatctctttatccatcatattcaataatgcttcatcataataaattgaatcttttggaaaattaacggttaaaagatgtacttcattaccctctatttcacttaatttatttaaatactgtaaagtttcaattgctgctgaattattaataagcggagaataacaggctataaataatattttcatatgtcctcctatctgtaacttttgctgtacatattattatcatttgtcatatcatgtccattatcatttttttatcttcgccaaaattatattcttcagttcaataagttcctgaagttttaatatataaccaagtataaaatagacgattattccaatagtagttcctaatacaactgtagctactgtatttaatttagttccaataaacattacaaataagacaataactaagcccatgactatagaatttaagcttataattaatatctttgagattaaatctccaatcttaaaattatgttctatctttataacacttctaaataaaagcatcgatgttattatcatagaacttactgatgctattgctattcccaaaacaccaaagtacttagaaagtactaaattaaataatatattgaataacactccaacaactccattaaatgtagttatttttgtttttcccattgaaaacaacgtggaattcaatatgtctctcatacctgtaaagaagattccagatccatatccaataagtgcagcactagttattctaactgcatattcgtcaaattgtcctcttccatatacaatctgaactatatcacgaccaaatataagaactccaacggttataggaattaataaaatggcaagataaattatagatttttttaatgtttccacaaatcccttttcatcaccattattcctcatgttagccataataggatatgctacatttgctatggaggttgttattattgcatttataaaaactatcagcttttgaccataatcaagagctgaaatagaacctaccgcaagtgaagatgcaatttttttatctactatcatattaagtgaattagcgcctgcacctataataactggaataataagtataaggatttcatgaattctcttatcttttatatttataaaaaatttgaacttatatccatgactcaataaggatggtatttgaacaactacccttaagaaatttcctataacatttgctatagttaatcctacaatatcatattttctaaaaattaacaaatatactatcataggtaaattgaaaaacaatcctaaaatagatggaattacaaaatcttcatttacttgaagcaatgatgtaaaacatgcatttatggataggaatagtatattaagtaatgttattcttgttaaccttgtcgcaagaatcaatgcttcctcagaaaatccacctgctaatatatgtacaatttcttttgaaaaaatactactcaaaacgaaaaagatcatagatattacaaaaagaatgttaactacattatttgcaaagttatacatttccttttgaccttttttagctcttattttgctgagcataggaagaaaagcagttgaaattgcaagacctattaacgtaaaaatagtctctggtatagtaacagcaatattataagcatctgtatacattcctgcaccaaatccttgtgctataagcatatctcttataaaccctactgccctgcttataactgacactatcatgattataaatgtagatttaattaaactactttcctttttcatgcttcacctatattatttctttcctgcatttctgttttttaaaactattaataaaaattttggtattgatatgagtctttttattctaaaaggttcttttattactctatacatccattcaagtcccaaggatatcatccattttggagctctctttaaatttcctgcaaatatatcgaatacgcctccaacacccatataaatctttgtacctgtaatatttttaattttttctataaatatctcctgccttggtgatcccatagctactaagactgcccacggcctgctttccttaatacttcctattatatcttcacaattgtttaaatcaaagaatccattatgatatcctgctatttttaaattaggataatcttcttttatattctttacacattttaatacaacttcttctgttgctccaagaaaatatactgatctaccttctttatcagccttaataagtacctctctaacaacatctatacctgctattttttcttttacaggttctttaattaatttagatgcaattacagttccaactccatctggtattataatagaatccttatcattaaaactcttgtgcaacatactgttatttaatccgttaaaaagtacttctggatttccagatattatatttactttatcaagtccttcaacataattcataagactctctttatcttcattaaacacattaaaatcaagtatctttgtaaacatatctactcctgcattcatatccttaactataaattttcttaaagaaccttataatattgttaattaatatctaatttattaacataataaattacttagttctatttatcatcttatctatatctattacaatttcatcatctggtgcaagcttcttcgctatatccagattcagtcttgcctgctccatatcccctaaattataataacacattactatatttgtacatatgtcaacttcatttgaagcctcaaatgcctttttaaaatattttattgcttcttcaaattcatttagacatgcataattcattccaagttcatttactacttcaagtataccagactctatagacatacttttattcaaataatgtatcgctttattgtaatgttgaatctttctataacatactcctaaatagtaatatattaaagggttatctgaaaattcatcacttaatggtgtaagaagttctattgctttttctggattgtctttaacaagttcaacagctttttcatatgtgcttatattttcaacatccttaactatactttctatttcagggctcattttaccacccttatttatgtattcatgtatttctgcctgagcacctttaaagtctccctcatcttttaaaataagagcattatataaatgtggctcaggacatttaaagaatttttctctgcacaaatcaatatcttcactaaataattcagtaaagctagaatctttttctcttaatacttcccctatatttaataattttaccattatttcttcttcttcagtatatctgtaaagaccttttaaaagaatatatgcatcttctaagttatctttttttattttatctgcaataatactcttaacacattcctcactgtctggaatatatgttaatattgtaccataatcttcaatatatcttatgttaggatctgctccaaaagctgtaaacattccttcaacaaaataatatataggaagattactcaatctaagttcattggttgcatttttagtaacatagtctgcactaataggaatatatagatctgaatttttaaattcaacatattgtggcatgcttatacttttcttaaaaccatcttgatctacttctaaaaatagcattttacttaacttatctttatacattgttttataattactcattttgcacctcttgttaattgtcattataaatcatagtgttattaatctaatattatacactttataaattatatcttatattataatctaaattaataaaatttaatacttccataaatataaaattctaattcatgctatattttcatattatattaattaatatccaatattatatactgtaattgacatgtgacaacaaacaaaaaaatactgccaccttgtgacagcatttttaaataattaatttaattttccattaattatttccattactttttctttaaatcttaatatttccgcttctgaattttctaaactcttaccttttacagctaagtaaactttcatttttggttcagtacctgatggtcttactacaaagtatgaatcatctgataatatatacttcaatacatttgattttggtaaatcaatatcagacttaacattatttactgcatcagtttctacacttaacttatagtcaaaattcttaactacttttattccatcaacttctgctataggatcatttcttaaagcttctatacaagatgaaattttttcttgaccttctttaccttttaattctatagatactaattgttctttaaagtatccatacttttcatataactcaattaaagcttcgtataaactctttccatgttctttataataaagagccatttcacatactaacattgctgcaattacagcatctttatctcttacaaaatcaccagcaagatatccataactttcttcaaatccaaataagtaagttttatttcctgcatcttcaaattctctaattttctctccaatatatttaaatccagttaaaacatccataagttctacatcaaagtcttttgcaatagctctagcaccttctgttgtaactatagtcttaattacaactccattattaggtagcttattagtttcttttaaagaacttaatacataatgagttaaaagtaaacctgtttgatttccagttaacaccttgtattctccttgactatctttaacaactacacctattctatcacaatctggatcagtaccaaaaattatatctggattttcactttgtgccatttttaatgctaattcaaatacatcaggattttctggattaggataagatgctgttgggaaatttccatctggtaattcttgttcctttacaacttttacatttgaataacctagctgatttaatacacttcttactggtacatttcctgatccatgtattggtgtatatataacatttaattctgatgcttttttatcaactaaatcagttcttatagttaatcctttaaccttttcataataaatattatctaaatcttcaccgatatattttaacaatcccttttctactgcatcatttttatcaatagtttttatttttgagaaatcatctacatcattaacacagtttattatagtgttagccttttcatcagtaacctgtcctccaaattcatcatataccttatatccattgtatattttaggattatgtgaagctgttactactatacctccagaacatttcaattctcttactgtaaatgataatactggtgttggtcttaaactttcatataaataaacctttatattattagcacataaatttaatgctgctgattcagcaaattcctttgacatatttcttgaatcataagcaattgctactgaaggattttcaaagttttcatttaaataatttgcaaatccttgtgtagctttagcaacagtatatatattcattctgttacttcctgctccaattactcctcttaatccgcctgtaccaaagtctaaatcttggtaaaatctatcttcaatctccttttcatcagatatgtttcttaattcattttttgtttcctcatttataatatctgagttaatccattcgttatatttttctttatagttcattttaagttccctccccattttttctcatttatattatacaatatttacttataattaaaaatagttttaaacttaactccagaattattgtaattgtttccgaaatatcattgtctaaatatatattttttagtgcaaatattataaaaaatttgtatctaattaatttttttcctaaaaataagttttattcaacccgaattatagtatattaaaaaataagtgatttattctttgtaaatatttaaaataaaattatcacaacatggttcttatcaaaacaaaaacaatgccaacattcatctttatttacataaaaattcatgttggcatttattataacttatattattacactaatccacagaaaatagacatattcttaaatttttgcaacttatcacaaaaaaatttgtaaatatttttatttaacttcttctgtagaactttcatcttcttctggaatgaattgttgtgtaactacagatgcacaaacagttgctaaatcatcaactattgaaatttcagctccaacttctaaatcagaaagtttataagtactaccaccgtgtgcttttgatacatctatattaatgctttttggtaaatcctgaggtttacatgaaacttttacagaatccttctgactttgcagtactactcctttttgacttaaaaagtcttttccattaaatttaattggaacttcagctattacattttcattactgcttacttcttctaaatcaatatgcattactttatgtgtcagagcatccttttgtatatccttaatgattgctgtaccattgtatccatcaagatcaaaatttataacaccatgttcacctgtaatgtttagttcacttactaaatccatttctccaatttcaaacattaaatttccaagttttttaccgtatataattcctggaacttgacctttctttctttcctttttagcgctattagatgaatttttcattcttttatttaaaattaattcctccattaatagtcctccttaaatttcataattactaatcattttttaattatttctcatttaaggaatttttattcactttttataaaagtttttaaaaataactaggaatagtcaaagtaattttaattttttactctgactattcctagctttaatctaaattataatctactcttcactttctgtatcatcttctctttcatctgctacaattgatccaataacacttgataaatcatcatcaactataactttatcactaatttttaaatcttttaatgtgtaaactgttcctgctgtcccttctgatacatctaaattaaattctttaggtaaatcagctgctgtacaagttaccttgactaaatctttttgcacttgtaatattaaagccttactttcaagaagtccctttccagaaatctttatactaacttctgttgtcatcttttccttagctgaaacttcttctaaatccatatgaattaccttatttccaaaatgatttttttgtaattccttaattactgctgttcccttttttccttcgaaatcgaattctaataccccatgttctccagatacagctaactctctttccaagtctaacacatcaacatcaaataatacatttccaatttcttttccatatatcacacctggaattgcaccttttcttctttcttttctggcactatgtccatttcctttaactcttttacttaataatagttcattcattgtaaacactctccttgaaataatgattttaataattcttttatgcttagattatttaaatcatgagcgtacgatgaataaaatgtataggcatataacaatcataaggtttcatatgcttataatgattagtcttatctgaagaattgtgaaaagataagattaatttgcaattaaaatttaacattttttctcgcctctaattcatctaatttatattaccttattaattatttacatgtccattatatcacttttttatatttttttgtatttttatttattttataacatttttaattaacttctttctattttaactttactaccaccatttccacattctgctggagaaataattaatttaacaggaactctattttttatactttctacatggcttattattccaactttaagtttatcattatgaatcctctccaatgaatccataactacatctaataaattatcatctaaagtaccaaatccttcgtcaagaaagaataattctaatggcgcagttcccttaagttgaatctgtgcagatagtgcaagagctaatgataatgatgcaagaaaagtttctccaccagataaagtgcttgcatctcttattgcacctccatttttataatctcttattataaactttccattttcatctacctcaagaccataggttccatgagttatttcctttaacctctttgaagcttctattgatatatacttaagctgatgtccagcaacaaattctacaaattttttacctttaaataatttttctaaatctcttaataatgctaacctatgttccaatattcttttttcttccaaaagatttttttgctctttaagcttctcatttatacgatcaatttcatcttttaattttattaagaactcattaagtgtaatcaattcattatttttggaagcttttagaattttatgttcttcgtattgatttttagttatactttttccaccaattttattagtaagattgattatagcaccttgaatgtttgaaatgttctctttataaacttcaacttcttcttttaattccaacaattcttcttttctaagaatattatttttaacatgatttattgattcaaatccttcacgtaatattgcagacttcatctgttctttttcagtttcctttttatcacttagtgttttttctttgctttttgatgaaataagcttttcactatatttattaaatatgtcttctatttcatttttttctttttccactcttatataattatcttttatatttctgatatttatctcaatatctcttaataagtcttttaaactttctgcatttccagctttattctttatggattcaatcttttcaagtttacttttttcataagaattaatttcagtttccttttttataatctcttcacttaatgcttttatatctttattacacttttctttttctgtttcaagatttccaagaagttttctagtcttgcttatttcatttgaaatattgttacgttctatttctatttttcttatttcactatttttttctttaaattgttctacagatatttcactttttaaagtatttattttttgatctagaacatctttttcattttttatactaatcaactctttttccattgttccaagctgattttgataagttcttaatgctgatcttaatgcttttatttcaccttcctgtttttcacgctcaactgctgctttatttatttgaacttctaattcttccttatttttattataactttctatctcagtttttaacttttcaaaattttcctccagaatttctattgatacttctctaaatttatcccctaatttatttatagattctgtattttcttcaatattttttatacatactgataatttagttttatccttaataatatcattatttatgtcttttattatattttctttattttttatatctttttcaattaattctaaatcaaacttaacttcatcaaatactactttatcatttatatgatgatgagcagatccacatacaggacatagttctccatcctttaattcttttctaagctctgttgccattgactttctaatagcgttattttgattttcttttagcttcttaagttcactttcatgtattcttaaaacttcttctccttctttgatacttttttcaagtatagttttttcttcaataaatttatttatatcagctgtaagtctattgtatgattcatactttagactacattctcctataaactttcgcctttctaaaagaatattttgatctccaggacaatttttaataataatattcaacttttctttcttttgatttaaattattatcaatattctgaaggctttcttttaaccccttgccttctcgtattgtgtcatgtatcaatatatttattttattaattttttcttcctcttgagataatgtgttgtttactttacttatattttcttcaagtattaacccatcctgaaccttttctttaaagctttcatctatttttaactcttcatatttcttctcattactaagtatatattcatttttttctttgatttgtctttgtaattctataaaagttatttcattttcattaagcttatttttatatttttcttttgcatatatagattccttcaaattttcttctataattttcaaggatttttcatcctctattgcatctttaactttctgctcatcaatcaataatcctgataatttttcatctttctcattttgcacatgaatccatttattttcaattatttcttttttcttagaaagatcctctatctttactgtaagttcttcaagtaataatttattttccaaatatgaacttgttgtattttcatatgcagttatatatggaattactttttctgccccttccccattttaattttcattttagtctcttctataaaatcaaatttttcatctaaaactttctttttatccatatatttatttaattcattttgagtattccataattcctcattatctctatcctgcttttcaatagcatcaaattcttcctttagctttatatactcactcatattattttttaatagttcttcattttcttccaacttttcatgacttatatcttcatatccttttaactgaccttctaaaacactactctttgtgttttcctcttttattttagaaaataattttactgaaagttcatcaccatacttttcaagattaaataatctttcaagcatttctctcctatctttaccttcaagttttaaaaattcactaaatttcccttggggcagaactacagttcttgtaaaatcatcaatattaagccctattatttcttctactttcttatttagaacttttacagagtcagccaaaacttcttcattatttatatctatcagcttgcattttccactattaatactgccatctttttttcttctaaattctctatcaattgaatatctctttacttctgctccagatatttggaactcaaaactcacattcactctatcacagttagtatttataaaattagaactttttcttgccatgtttccataaagcgccagtgttataccatctagaatagttgatttcccacttcctgttggaccaaatattccaaagagccccctatctgtaagttttaaaaaatcaatgctctgttcttcctgaaaactattaagtccttttattttaagattaattggtttcattttcatcaccttcttcactaataattgatagtaataaatcaacaacttcttcttgcgggtctacatctctttcttttttataaaattccttaaatatctcaacaaaaggtttttcttttaggttttctgaatcaaattctgtctcatcaccttttattttaggtactatttctaaaatatcttttttaaagtctttcatagccttaatttcatcttctcttatatatctgtctgtttctatttcaatgtatacccagcattcatagtctttattttcctcacattttcttaaagcttcttctatactgccacacttccatacttcaatgggcttatacactttcattttaacttcacttatatcacatggtttgtttgcctctgccattatgataaaacattttttatcgtaacttatttcttttttattataatgaataggtgaacctgaatatcgtgcccttttatctgttccaggcacaatttgtggcttatgtacatgccctaatgctatatattgagcttcttttggaaaacatttactatcaacaatatagcttcctccaagctgaatacttctctctgaaccaccttcttcacttcccatggcaaataaatgtgatactgcaagattaatagtatcccttctatagtgtatttttagattattaaacaaatcatatattctgtcactatatgatttagctttttcatcatcatcatccatattattatatataacctcatttaaccttctttcacttggatatggaactgttaaaattacacttttctctccatttatctctatttcaataaaaccttctcctgaattaattactttattcttgccataatctccacatgatacaattgttttaggtgtcccaaccataattattccatgatcccttgcaagaggacctgctgcaataagtctttccggactatcgtgatttccacttatgacaagagtcattctatctccatccttagaaagctgttttaatgtatcataaaacattcgttctgctcttgctggaggatttggactgtcatatacatctcctgctattattatcaaatctattttattttcttcaactatatttacaaaatcttttaaaaacatttcttgttcatccattctgctctggccttctaaattctttcctaaatgccagtctcctgtatgtaatattctcaaaataattcctcctaacaaaaatatttgttcttataaatatgattatatcctaaaaaatcactttattaatatgatttttataactatactcttttatttaaaataaaaataagtgtaaatatgtataattacaattcatatttacacttaaaaattatatacgtttcaaagttatcatcagatttcacttaacaatttcccaaagaataaaaaattcttacagaatttattgaatttatatgaagaatatttataagactagatatattcactataaatatatctaataaagattttgttctaaaatatcaacacatttatttattatttgtaacttttcatgctcactacatgaatcatcttttaaaactgattttacttttgttacagtttcacaaagtttcttatattcatttatttctattcctatagaatccattactttcactcctattaaactttatataaaataagtttttacttaataggtaatgtgtattcatttaataatgttttataaaaaattctatataaataaatctcaattaataaaattaaaatataatatttttactacatactgtatttatatacattcttgtaaagcccatctcttaatccactaaactcatgatatttcattttctttccataactcattatttttaaaggaagtaatggctttcctttttgtaatggtggctgtaaatagtcatactcatttaattccattcccattctctcatagtatttaattcttcttgttgaaatttcatcttccggtaattctacttcaagaacagtcaagttattattattatctaaatatttttttaaaagcttagttccaatcccttttcctctaaggctatcatccactgcaaaatgttcaataaaattaaaatccttaaacttccagaatgctaaaaaagcacataccttatcgtggttatccttatatcctattacattataaatatctttataaaaaagatctttctgttcttcatactttcttctttctatactcggaaatgaattttccataacttcatacaaactatcaaaatcatttactgttattttttcaaatttataattattcattttcttcccccagctgattataatttactataattataacacaaatatgaaaaatttttttcatatttgtgttatggtatttttataacttaataatatgtataactaaaaaaatactgatgcaaatgtttcttaactacttctgcatcagtattttctttattaatataaaattcttaagttgctctatcttgcttggtcactgtttttatgataattataaatataaaatggtattcctataagcatcaatataaatccccacattactgtttctgcacctgaaccatatatagtccaaattgtataaataaaagcaataagaggaattattgacttcttaataaataacgttaatgtaaaattcttttcatttttaaacataagcattatttctgctgctacagttaaaagataaactggcaagaatgataatgttgcaagtattgttataaaggtaaaagctgataccattcccttttgataattcattactagcagtatgttaactaatacagaacctattattaaagaatttactggtgtaccatacttagggtgaagctttccgaagaactttggaaaaactccatcttcacctgctgcatatgaaactcttgcagttgatagtatccatcctattgttgttcctaatatacagattacaactgcaattgtaagtatctttccaacattgcttccaagagcatttgttataatatctgtaagtggtgctgtactcattgcaagttcactattagccatagctcccatgcttcctaaacttattaatatgtatattacagctgctataataattccatatatagtactttttcttacattcttttccggattcttaagttcaccagctgtaacacttgaactttcaagtcctacaaatgcccataaagttgatgtggcagctagtgatactgttgataagccttttccctctggatttaaaggcattaaatttatactgtcaaaattccagaatgctattattataaataatgcaaaaaatcctattttaaatacagtcacaaagctttgtatttttccagcctgttttacacctactatatttagtatcgttacagcccacaaaattccacttgtaaaaagtatagatattaatgggttgttcaaagctggtacaaatgatgatgcataacttgatattgcaactataatagctgcatttccaatccaagaaccattccaatatagccatgcacttaaaaaccctgcaaattctccaaatgcttctttagtatactgatatgcaccacctgttgatggatattttgatcctagatttgcaaatgaaacagctattaatatagaacctattgttgtaagtatccatgctataattgtagacattggtccagatacttgtgcaagtgtagccggcagcataaaaacacctgaccctatcatatttccacaaacaagcatagtagccataaataggcttatttctttctttagatttctatcttccatctttcctcctacgtttataaccaatttaattctatatattatataatatatattatttcaatttacttgaataatattacacttcgaaattatatcatatatgcatattgaagtgatattttttacacaatttatataattagaattttataactcatagcgttgatatattatcatctttttttcttgttttttatcactttatcacaacatattattaatttatcacaacatattattaattctatttataaaaatacagtcatgcttaatattttatttaaaacatgactgtttatattcatttaattattacatttttttaataatatcttctacctcatcaattgacaatcctgttgcttcagctatttcatcattttcttcaaatcccatcaagtccttagctaaagatatcattaatctcttaacatttgtttcaacactttctggaagatccgacatatcttctaagttttccgtcaaatcaaagtaatctgattcctcatcattttcttctttaaataattttattttcttagctttttctctatcatatccattaagatatacaagtttcctattactttcttctaaatcctcatcagaaataacgtctattccttcttgttctaaaacataagctgttattccctttccttcaattttatttcctaaaaatgttccatcataaataaaattgcatccacatgaagggcttccttctttaagtattgctttgcttattcctgcatttttagctattcttagtgtttcatatgctccgtctagaaattgctttgtaacatcatttccttccttatcaatagcttttccttctccttcaacaacttcttttgctatagagtctaattctgttggatttcttggtgtagataaacctccaagttgttcaggacatactagtatagcttttccttcttgaaaaagcttcatacatttttcattcatattatttttaccactatatttgcaattcactccacataaacatgcactaataatatatattttaatcaccccttttttcaattaacagttaacagatgtcaattgatattcatatcattttataatatgtttaaaacacatggttttatcatatcatttagtaatttcataattaaatgataactgttctttgttaaattcaaactaatttaagctttaagttcaaccacagttactccatctccaccttcaccatatacaccaagtctaaatgattttacgtgtggatgtctttttagcattgctgttattgcatttcttaatacaccagtacccttaccatgaacaattgtaacctctccaagatttgctctatatgcatcatcaagatacttatcagttttataacatgcttcttccgaatccattcctcttaagtctactcttgattctatattacttaaattaagttttacttctctttttttcttaactttttcttgtttagttacttttgtttttcttaaatccttcagctttacattaatcttcattattcctgcttcaacctgtacatcacctctattatcaggcattgaaataataactacagtttgatttaatgaaggtagaaaagcttccatcccaagtgttacattagttattggttctccttcattttctttcatattatgaaggcctttttccttatgttcaagactatctttaagttttttacgttcttcttcaagtcttgctcttcctccaccttctattcccattttttctaaagctctcattgcctttaatatttcatcagcttcttcttttgcatttgcaatgatttccttagcctcatgtctagcatccatatatgccttatctcttgctttttccaatttctgaagtttatcttcatatcttaatttaagttcttctgcttcttttttaagagcacttgcttcccttgcttcttttttagcaactatactcttttcttgtaaatctcttataagattttcaaactgcagattttcttctgacatatatgcctttgctctctttattacaccctcaacaagcccaagtctctttgaaatctcaaaagcatttgacttaccaggtactcctataagaagcctatatgtaggtcttaatgtctctatatcaaattcaacagaagcattttctacgccatcagtttttaatgcatatgcctttaattcactatagtgagttgttgcaataattcttgattttctacttcttaaagtctcaattatagatattgcaagtgcagcaccttctgccggatctgttccagaacctatttcatcaaaaagtactaatgatttatcatctacatatctcattatctcaacaatattagtcatatgagatgaaaatgttgaaagattctgttcaatactttgctcatcacctatttcagcaaaaacttcagtaaaaaatgataaagatgaattatcacgtgctggtatcaacaaaccacttaatcccataatatgaagaagtccaaccatttttatagttacggtcttaccacctgtattaggacctgtaatcataagtgtatcaaaatcctcaccaatataaacatctgatggaactactttatcatcatctatcataggatgtcttccactataaatattgaatcttccatcttctcttataagtggtcttactgcatttaatctttcaccatatcttgcttttgcaaaaataaaatcaaattcaacaagcatcttaaaattacttaaacattgttcagagttctctttaactttaaatgaaagttcagctaatattctatctatttcagctttttcttttaatacaagttctcttatttcgttatttaaattaacaagactcataggttctataaaaaatgtagctcctgttgaactctgatcgtgaactattccaggtacagcacttttatattcagatttaactggaataacatatctgtcacctctcatagtatataaatcatcttgaagatatttagaatgacttctgactattgaacttatcttctctcttacagaagaatttttctctttaaggcttcttcttatattgtataatgttgcacttgccttatcacttatttcttcttctgaaactattgatctttctatgtcatcttcaagatttttcactggggttaatatataagctaaatcttcaagtctttcataagctttttcaaaatcttctcttttaaagaattccttcatgtttcttgcagctcttaaagtacttcctattttaagaagctgctctggagttaacgtccctccttttcttgctctttcaacaccttcatgtatatcaaaaagtccttcaagaggaggattccccttatcaagtattacttctaaagcttcatttgtttcatccagcttattgtttatttcataaacattatcataaggagcaaggtctgaaatcttttctttacctgcattggtacgtgcatattttttaatcttatcttttattttattaaattctaatattcttaaactcttttcattcataaaaacaccccgattatttagttagcagttaacacctgtcagttaactgttaactgtctttattctacgcctcttttataatggccttttgtataaatcctattttcatttttcttaccacaattaatctgctttataacatctttaacatcttcataggtctcatctaaaaagtcaactctgaaattctctatattaaaggtctccatttcttcacactcttcaattaagtttataggaagtgaatttaatatatgacttctacaactattatcacataacaccctaaacttctcattcattctatctattaatgtaaaattatctttcatacatggcatactacattctttctttgaagctttgtttccaaatgtgcttcctacaggacagtattcacttaccataagttcagttttaccataaatattcactgcaattttacacttaatatccttcattacttcctttaattcttttctgttaagttctacgcttaaacttggaatatcaatatcttcactatagaattcagcaccttcatgattaaatatattaagtttataatcaccaattataaacattgaattcttatattttcttataattcctgcattggatgttattataccttttatataaggtgataattcatcaattacttttgttatggtttcaaagtcctgtttaattatttctggaactttaaggaaaatatttttattatgattaatgtcttctaatccttttatatctcctttatttaagaagcctttcaccctgctatagaatatatttaatgcaatattatcaactgaattttcttccattaaagccttaaactgatcttttgttgtgcagctatatatatatccaagcttcccattaaatttacacgaaggactttttacctcttccataattctttttcttctataagagcttgtagcatcctttaaaatattttcaaatagttctcttcttaaattatttagtgatgcaattcgtataaaaccttcatcaaaaacatcaaatattatattatcgaatttatacggaatttcacctgatttctttaacgcttcctccactctttctctacttaaaggtttattagaagcttcttctataatttcaccatataccttatattcttttccattaaatacagttttcaatatgataggtgcattaactttaaattctacttctcctgtaagtaaaatctttctcttatagggctttatataatcatgaagttcatcaaataattttttatcagacattttaaataatctgtatccctttttatatcctccagttggaaaaagcttaactctatcacctttattagcttcttttacttcttttccttttagcattattttgcttaaagtaaaaccatcatcatcaaaccttattccatctcctaaagcaacatcagcttctaaaataacttctccgttatcttgaactttgcctataaatacacccgtatttttagcataattaaaactcatcatgtccttacctgtatttttataaagataagctttcgcaaacccctgcctattaaataattgggcaagctgattttttcctttactaagatcaaatttagtctgtttttcaaccttatctatagcttttctatagttttgcgtaactcctgcaacatattcaggctttttcattcttccttcaacctttaaagatgatgttccactttttattattgcatcgatatcttcaataagacatgtatctttaggacttagaagatatcccttcctttcaccagatacttcacctttcaaagtatactgcattcggcagctttgagcacatctacctctattcccacttcttccaccaatcatagaactcattaagcattgacctgaataacaaacacataatgcaccatgaacaaaaatttccgtttctattccaagatcatttgatatatattttatttcatctaaagataattctcttgataaaactattctttgaagacccttttcgtaaaaatataatgcgccctctccattatgtactgtcatttgagttgatgcatgtagttcaaatttaggataaatattcttgattaaattaattaatcctgcatcttgaattattaaagcatcaactcctatttcatataaatatccaacatattttaacgcctcttttaattcattctgtttcaaaagagtattcattgtaacatagactttaacaccataactatgagcataatcaacagctttcatcatagtctcattatcaaaatttgaagcataagctctcgcggaaaacttacttcctccaagatatattgcatcagctccattgtttattgcagcaataagactttccatacttcctgctggagccagtaattctacgtttttcatataatttctatatcctcctaaaataccttataaaaaggtattcttatttatcattttaataatatactaaattcaagaatttgcaaatacaacattaaaagaaggcactaataatatactagtaccttcttattttttattttctatttccttttgtaactattggaccaagttgttctttttttgctttcgcaagttcaatctcagcatctatgacttttgcttgcaattcaaacaatctgtgttggaaagatttagaatcctctatcaattcatctttttcacttagaatttgtgttttttccttctctaatcctaaaatcctattatttaaatcatctattgattctctattatttgcaatttcaatttcatacttatttatctttaaaagacaattattataatcttcttttatctgaacaatttcatttccagtatctttaattcttttttctttttcttcaatttctcgcttaagttttaagaaaattccttgtttatcttcaagttctttttctaatcttgaaactgcccttgtcttgcttgcaagatcctcatttattttctttaattgcgattcccttacttcaagacttgaattcaatgtaactatttcttcatctttcatgataattttatttacagtatcttcttttaatttttctatttcattttttaatcctgcattttcaacttttgaatcacttaagtctttttctaaaatacgtttttcttcttgaattttctctaattgaccagataactcatcatttatatctgttaattcaccaatttcaagattaagttttttctcaatatcttttaatccttctatttcaccttctagtttttttctatcatcatttaaaaggtttatttcacatttcattgattcttgttgcttatttaaattatttaatctttctttatattggttaatttctttgtcagtctcatcaaataaatcatttaattgtttgttcaattgagccttttccatatctccatctttaacttgtttatctaattcagtacacttttgctgtacatcttttaataaattatttaaatctttttcagaagatattttttcttcaatcttcttatttaaaatttgcttttcattttctaattttttttcaagttcattataagatttaacttgtacttctaatttcatcttatagtcttttaaaacagtatcattctcttcatataatttatttaattcactaagctcgagtttacagtcattataatctttagatagtaatgtatttttagatttttcttcatttaaagtattgcttaaatctaatatttgttcttccatgcttaacttttcattgttcagcttttcttttgtattttcaagttcagtctctaaaagaatatttttttcttttaatccttgattttctccatcaagattaactttagttatatttatttcttcaagagctgctgctatttctaagtttgaatcatttatatttttcaattcttctgctattttttctttttcatctgttactgcttttaacttacttgttaaagtatttattctatcattagcctgttgaagttctctgtttaatctatgttccttattttttgaatcatcaatcttcttgtaattaattttattcttttcttttatttcagttaactctttagttaaagattccactacattttttttctttttaaattcttcatttatttccttattaccttttaataacttctcattctctaattttaatttatttatttcttctttaagttcattataagttacttcctgatttttatatctttcatgaagttctgattcctttttcccaaactgtgcttcaatgcttgtcttttctttaattacagtctctaatttttcattatattttgcaatattattttttaataaatttctttctttttctatttcttctttttctttaattattctgtcaagttgatcatcagattcgtataattcatctgcaatatttactgctgcaagaactgttgcagcattcgtgcttaatccagattttttagacattatttccttaattctactgtcaacataacttgctacgcctaaaagatatttctcatctttttcaccctttaaattataactcataccatttatattaactgttaccttaatcatactaatataacacctcgtaaaattctttgtttatttaattataggatatattcagcaataaaacaattatgtaacatactctaattaataaaaaattcctttaattttaatccttttttatttttcttttaaataatatcatttttagattaattgtgacacaaactgactttaattaatttagcaccattacttattataaatttatagtttatgatatactaaacctgattattgtgataataatatgttcatacttaataaataattacattatctgttttacttattaagctaaatatattaatatataatttgatataattttattaggtggtgagtacaataaagattaaaagcattttaagtatatttttatctaaaattacagctttccttgcaaagcatatagtaaagggaggaagtaactttccaggtaaaattgctttaaaaattgatagatcaatcttaaaaacagtaagcaaaggatataaagtaatacttgttacaggtaccaatggaaaaactacaactacaagtatgatttataacattttaaaagaaagtggccttgatgtaataactaacaatacaggtgcaaatttatatcctggaatagttgcttgttttatttctaactattcattctttaaaaaaccaaaagactcatatgctgtcatagaagttgatgaggcaaatgtaaaatttattactgaatatgtaactccagaaataataactgtaactaaccttttcagagatcaattggataggtatggtgaagtttatacaactttagttaaaattcttgaaggtgttcataaggttccagaatcaactttagttttaaatggtgatgaatcattacttggaaaacttaatatacaaaataaatgtgtatattatggatttaatactcctattaaagaagataattctttagatttaaatgctgatgctaagttctgtaaattctgtaaggctccttattcttataaccttgttacgtacaaccatttaggtgatttctattgtcctgaatgtggatataaacgtccagagctttcatatagtgtaaataaaattttagatttaaaaccagaaagttcaactgtacttattaataattctgaaatttttataagccaatcaggtgcatataatatatataatgctttatgtgcattttcaattgcaaaacagctaggtattaatgatgatgtgataaaatcatctcttcaaaaccaaagttcaagctttggaagacaagaacaaataaaaatagatgacaaaaatattcagataatattagtaaaaaatcctgcaggatataatcaagcattagatactttaaagttaaatgacgatgcattttctgctctatttatgcttaatgataattatgctgatggacgtgatgtatcatggatatgggatgttgactttgaaaaaatatcagaattaaaacttcaggacatatttatttctggattgagaatgtatgatatggctgttagattaaaagtagcaggacttgataaagataagtttatccttgaagaagattatgagcagttaacagaaaaacttaagaaatcttcatcaactaaaatatatatacttgcaacatacactgctatgattaattatagaaaatatcttcattcaaaaggctatattgataaattatggtaataaggaggatttaatattatggaattaactatatgccacctatatcctgatttattaaatgtttatggcgatgtaggtaatgtacttattttaaaacatagagcttctctaagaggcattaatgtaaatattgtaaattgttctcaaggtgatattttagataaagataatactgacattatcttctttggaggtggtcaagattttgaacaatctattgtatctgacgatttaaaaaacatgaaaaaacaacctttaacagaatatattgaagaaggtaaggttgtacttgcaatttgtggtggatatcaacttcttggaaaatactacactgcacctaatggtgaaaaaatagacggccttggaatacttgatatttatactgaaggtggagacactagatttataggaaatacagaaatcattaatgaagagttcaatgaaacatatgtaggttttgaaaatcattcaggaagaacatatatcaataattacaaagcactaggaaaatgtattcacggatatggaaataatggttctgacggatatgaaggatgtatatataagaatacttttgggtcatatttccacggttcatttttatctaagaatccagaatttgcagatagacttttaactttagcccttcaaaaaaagtatggtcaagaagtaatcctagaatctttaactgatgaatttgaattaaaagctaagcaatcaataattgaacgattaaaaaaataataaaatactcccttgttttttacttgggagtattttcattgaatctttacctgttaattacctttctatttatcaaataatcaaattcccatggttccatggattctattgttttaaactcataacccaatctcttataatcatcaattattccttgcagtgcttctgttgtggtttttttattttctaaatcatgcatcaaaacaacttctactatattctttccacacatttcttctacattctcttttatagtattacaagctacacatgaccttcttgtatcaccacaatctatcgtccagtcaatataatttatatctctactttttaaatatgattttatattacttaaaacgtctctcgtacatacagtgttagttgagccaccaggcatcctgaccatattataagttctttcttcattaataattccatttattgttttcatacacttgtttaaatcatttacataattttcagtggaactatatatttcggtataatcgtgattattgcagtgtggtaatattcccataccactgctgtttattcttctcatagtacccttatttctaactgcattattaccaactacacaaaatgtagctttaacattatttttgcataatagatctaatatagaatctgtattactaaaagaaggtccatcatcaaaagtcaaataaactactttcctttctgctgcctcaggtttaattttcacacctatataatttacacttataaggctaataataattgcaattaatatattttttatatattgtttcataaaatgtcaccccttcttcatagttcgtatatagtttgttcaaaaaaacaaaatctatatctattaatgtaaaaatatatttaactttttcataattttaaatggaatatatgccttcaaaaaccatcttagtaaattaattatttaactatattcattaatcaaaaaaacatatgttattcttatttaataatttctttagtattttaaacctaacatttattgttattagtttgtataaatgttatactaaaactgttttaagatatttaataaatagaagcggagagatttgacttgaaaaaaaattttattttaaaaacacttatactaactctttctatttctttattcagcccattagcatctattaatgcaaaagctgctacaactgcacagccagatataaatgctcaagctgctataactatggatttagaaactggtgaaatcatctattgtaaggatgcagacagcaaaagatatccagctagtacaacaaaacttttaacaggtttacttttagctgaaaataaacaaaaaagtgatgaaattgcatttacagaatctgcaaaaatccaacctgaatattcactgaacataaactttatgcacaactctatgaaagttggagatactatgtcagctgatgatgtcatgaaaggtttattgctattctctggaaatgatactgcatatatgattgctgacaatgttgcaggaaattctcaaaagtttgctgatatgatgaatgcaaaagcaaaagaaattggtgctaataatagtcattttgttacagcaaatggattacatgatgaaaatcactacactacagcatatgatctttccttaataacaaaggctgcttttcaaaatgactgggaaagagaaaccatggaacttgcagatgcttctattcaaattaatggcgctaaagtactgttagaaaacagaaacttaggtcttggtaaaaatggaaacatagcaggaaaaactggtttaactaatgctgctggtggatgtcttgctgctgtttatgaagtaaacggaagaaagcttataggtgtagttcttaagagtagacaagtagataatgccgatatgactaaattcaatgacatggattctataatgaattatagttataatacatcaaaaactgtttacaaatcatctggtgaggaagttggtactacagatgtacaatataaatcatttggattctttggtccaacaaagacaattacagttccattaaaacttactcaagatgtgacttattacgcaaatgcaatcaatgatgctgaatctcaaataacttatgataaaactgattcaagcgcatggaagttactatttaataaagatgtaacactaacttattcaacaagaaatcataatgaaagtgttgccggtagtgttgatatctcatttggaaatatattaaaagataacataattatttatatcgcaactttagcaagtataataattattattacattaataatattaataaaaaatatggcttcaaactcaagacgtagaaaaagcagttattcacgtagaagaagacgttaatatgcaaataaagaaatactgtatctaaacttttatttagatacagtattttttatttaaagattaaaattgaaatttgtaaatatttcactgatagatactattaaaaaaacatggtataatcagaatgttgttggtatggtaatatatcttaatatttacgatccataaaaataatcgtttatctaaggagtaaaaattaatgaataaagttgaaatgaaaggcagcgtaatattaaatcccgtacctgtcgttttagttacttctaaaaacaaagaaggaaaaacaaatgtgtttacagttggatggactggtacaataaatacaaagcctccaatgttatatatctcaataagaccagaaagactgtcttatgaatatataaaagaaaccatggaatttgttgtaaatcttcctggttctaatctagtaaaagcagtagactattgtggtgtacgttctggcaaaagaaatgataaaataaaagaattaggatttacactaagtgaaagcagtaacatatcggtgccttatattgatgagtgccctattaatattgaatgcaaagtaaaagatatcattccacttggaactcatgacatgttcattgctgaagttgttggatctcacataaatgaagatctatttgatgaagatggaaagatacattttgaaaatgcaaatatgatggcttattgtcatggggaatacttccctcttcaaaagcatcctgtaggatcttttggcttttctgtaatgaagaaaaaaacaaaaaaaagaagacagcttcaagcaaagaaaactaaataagttttctttgtatttctgaaaggggaaaaaatttgaataataaaatacgtgataattattttgataaccttagaggatttttaataatttgtgttattgttggaaattcacttgaatatatatctccatcaagtgttaatcctcactatttaattctttttctttatatgtttcatatgcctttatttacttttatctcaggatacttttgtaaaaaaagcaaacgaagcactgttgaaaaagtaattgatacaaccaaaatttatttatttgctcaaacattctattttatctttaacagatatatattagatagaacaagtgttaaattccaattgttatatccaagctggactttatggtacctcatggcattaataatctggtatgttctttctgattatattaaaaattacaaaattgcctttgcactatctgtagcagcatcattaattattggatttgatggaagtattggaacatatgcaagtgtatcaagaatatttttcttcatgccattttttatagctggtatggcttttaacaaagaaactttcttagaaaaatataaaaaatactctattcatttaggagtacttacatgtgtaattcttattatattatttgcaataagagaatttacagatgttgaatacttttttgaatatactaattatactttctattctgattctgccatttatccatttatacttagattattccactatataggcggtttcattatatgtagtttcattttaatggtatttacacataaaaagactttatttacttggtttggtaaaaattctttagttctatatatttcacatgcagctgtaatccaactgcttacattaagacctatactaaaatatggttcatggtcacaacttattttatctgaagcatttattgttacagtgttattagtacttgccatgataataaaaaaattacgtcatatgcaaaatctatgcagattcatgatattaatgacttaaatcaacaagcataataattaaaatcaacactttcaaaagagcttaatgaaaattttcatcaagctcttttttatactattcaattaaactcttgaatccttttccaagtacttcacttgtatcattaactgttacaaatgcctgtggatcatttaattttataaactgttttaatttcataaattgtcttcttgttaatattgtgagtattacacaattattttcaccagtatatccacccttaccgtaaaatacagtacatcctctatctatatctttcattatgtaatttgaaacaagcttttcttcctttgtaaataccataacctgcttagatatatttaaaccatctacaaatttatcaattaaagttccagttagatatacacttaaaagaccaaaaagcccaagttctattccaaaagtatacattgctaatataattacaatggagtctgatattaataaacccttaccaaaatctatatttgcatatttatttaataattttgctgtaatgctagttcctcctgtagttgcatcttgtgttaacattattacacttccaaatgctaataatgcacttccaaaaattgatgccaacattaaatcatcagttaaagctacaggtgtgtagttcttttctaatatagataatgcaattgacaaactaaatgctgcatacatactttttattccgaagtttcctccaataaaaataaacgcaagtaaaaataaaatcacattacatattaccataattattcctggttcaattccaagtatattattaataacaagtgccaaaccagatactcctccagatgcaatctggtttggaaaaaagaaaaattcaaatgcaaaaattactattgctactccaagtgttataattccatattcttttaataatttcatatgtacctcctcaatgttagttttgtatttgtatatttatcgggataagatattacatttgtttaatgcaaattattattttaaactcttatttttattacaatatatattaccatagatatatctttgttctattttttattttgcttcaaatactaataaattatctaataatttgaaaaacacttaaaaaacaaagggttttttatataatttcttataaaggtatattttaaattactttctaatattttcatcatcatatttttaaaaaatttataatatatatgttcttataagtataatctaaaaatcgcacagtaaattcaaaattaattgtaaattgcaatatataatagctgctatgaagatatattcatagcagctatttttcactctctgtcccctactaactttttttgaagaattgcaacaatttcatacattaaaaatgctataactgataaaataactatgctcatcattactgtatcaagctgtgctacctgtcctccataaacaattaaaaaacctagtccactctttgccactaaaaattcacccattataactcctacccaagataaacctacatttatctttaatgcagaaataaaaactggaattgaatatggaaatattagatatcttaatatctgtaattttgaagctttaaaagtcttcataagcattattttttcattatcaatctcattgaatccacttaaaacacttattatagttgttacaattgaaataagcagcgctattactattattgctggcattccgtttcctatccagaatattataataggagcaagtgcaaccttaggtagtgcatttaatactactaaatacgggtctaatatttttgaaactgttggataccaccataatattactgcaattattactccaagaatagttccaagtgaaaatccaagtatagtttcataacaagttatccctatatgcttaaacaaagttccatcctcatatagacttatacatgactttattacacgacttggactggatgtcaaaaatgggtcaatccatttcaaatcagcagcaatctgccataatccaataaatactataagaattagtattcttgatactgtcaccttgattttatgtgcttttacacattttaaatataacctgtgttcatcacttatactgttatccttattaatttcatttagatgtatattattctttatgctcattatcttcatttaactccttccataattcattgaaatatccactaaactgtggttcttttcttctttgaaaaggagtcaaatcttcattattaaatttcataacagcttctttttttacacttgcaggccttttggaaagaacaactactttttgagatattgaaatagcttctgcaatatcatgtgtaaccattattgcagtctttttttccttttttattattttatatacatcatcacaaaccattaatcttgattgataatctaatgcagaaaatggttcatctaaaaataatatttctggatttaacgcaagtgttcttattaatgctaccctttgtctcattccacctgataattctcttggataatgatttttaaatttctcaagaccataactttctaatagattttcaactctttcttttgattcattatttaaaatttttttaattttaagacctaaaatcacattttcccatacagtattccattcaaacaaatgatccttttgaaacatatatccaattttatcaagactattttttatatcttcgcctctatataaaatacttccttcagatggttctaaaagaccacttattatattcaaaagtgtagatttcccacatcctgaaggtcccaaaatagaaataaactctccttcattaactttaaaattaatactgcttagagcttttgtttcacactttgcagaatgatagttcattgatatattacgtatttctaataaacacaaatttaattcaccaccttttcatctatataattatctaaccatgttaattttgagctttttgagcatacgagttatcaactattttagaaaattgtggtcttgtagttataagactgctgtcataatcctgtataatatccataagtctatttaaatcttcttctttaatttctggactatgagcaagtgcatctatactcctataatttttaactactgttattatagtatctctatctgttcccgggaaataatcaattatactatctgctacttcttcatcagaatgactgaaaaaccattgctgaccttcatatatagcttttgtgaatttttctataacttctgggtttttatccatatatgattttgttgaaaaataacatgtatatgggattaatcctgtttcttcacctactgatgcaagaatatatccacttccatccttttctatagttgaagctgtaggttcaaataatgcaacatagtctccagtaccacctttatatgcaccagcagttgctgaaaaatctatatttgttaccatatttacatctttttgtggatcaatgttatttttcttcatagcatactcaagtgccattgctggaacaccacctggtctgcctccgataacgttactacctttaatatcgctccacttaaaattatcattcttatctcttccaactaaaaaagatccatctttttgggtcaattgtgcaaaaagtactggataatcttctcgtccctgattattaatgtaaactacttgttcaggtccacaaaatccaatatctgctgaattacttaatacggcctgcataaccttatctgctccttgacctgtctgaagatcaatttctataccattatcatcaaaaaaaccctgactcatagcaatatacattggtgcataaaatactgaacgtgtaacttcattgagccttacttttactttaccatccttagttttactactactcgtacatccaaccatagagacagcagtaaccaaagccgttaataatgcaattaatatctttgattttttcttcattaatcaaagcatctcctaataatatttacactttatactatgattaaatgtaaaagattgttctatttaacttttacctataatattaataaagagcaagattaaaaaatatcttaatcttgctctttactttataaaattacttatttcaaactatttattttttcaatacatttttattctcttattaatcctaaataaattctatcttccaattaaaatatccgctttcttcatttttctcatatctgaaataagccgaaaaagtattaccttttttacttttcaaatttctaaaacctacttttccatttttcaaaagaagctcaaccatctctcttgatacttttttcccaaatgaattaatatatttatcatctttccatatagtaaacttgcatccattcttccagttactacatccaaatcccttttcaccttcaattataggatttccacatacaggacatggcccaacactctcaacatctttaggaagctcaaccttaaatcttgataaagcacctgtatcactctttattgcatcaactgattttactgtaaaatcttttattagattcataaaatcatttttttcaaactttcctttttcaatatctgaaagtgtcttttcaagccttcctgtatactcaaggtctaatagatccttaactgggaatatttcaactatatttcttccaaggtcagtacatataagactcttgccttttgtttttaaataacctatatcttttaatttctttattgtttcagcccgtgttgcaggcgttcctatactaaatccactaagtattgatgccatcatttcttcagaatcttctttaccctctaccccttttccacaggtttccattactcttagtaaagttttttctgtatgatgttttggtggctttttagttactgaacttacttttgattttattacatcaacattttcatttacttcaactttaggaagtattacatctttactttcaatcttctctacttttttccaaccttcaactaacttgactttaccttttgatataaatatacctttaatttcagaattttctcccttcaatgtaacttttgtttcttcaaattcagccacaggcataaactgcattataaatctgttctttatagcttcataaactattttttcatctccgtttaatcccgatggttttatgtatgtaggagttattgcactatgactttcaacttttgaactatcaaatattctttttgatgttgtaaatttgatttcaccttcataaggcaatccaacttttaatgtttctaaaacctttttggctctatctttcaagctttcctctaaaactacacttgcagttctaggatatgttgtaagcttcttttcatataaggattgagctacttttaaaactttatcagatgtccatcctttatatttacttgttatatatccttgaagattagataaattaaaaagatatggtggatattccttttttaattctgtctgcttatctttaatatttactctctcagcttcaagtaatggtaaaagcttgctcaaatcttcttttttttcaaatttttcagaatcattttcataatacaatccttcaaattcttcatttttatcagttttaaagttacatattaatttataatatgtagttgctgtaaaattttctatttccttatctctatcatatattatttttaaagttggtaataaaactctacctatatttatagttttattttcttcaaatttatactttaatgtacttactgaagtcaaatttatacctataatccagtcactccattgtctcccaatacctgcatcctgaagacattgcatttctttattattttttaatgattccattccctttttaacttcatctggagtccattcatttaacaataacctatatataggcttctcaactttgaaataatcaaatatttcatctgctataacctgaccctctctatcaaagtcagttgctgaaataattccatcaacatcttgcctatcaataagattctttattattccaagctgtttctttgcacctttatcttcaatacttctatttgcactatcacatttaactttatataagaagttctctggaataaaagggaatttttcaaatctccatcccttcatactttcatcataatcttttgcatcataaagctgcaaaagatgtccaaatgcccacgttatataatagccgttgccttcaaaatagccatctttcctagtttttattttaaacgcatctgcaatattttttgctacagatggtttttctgcaataatcactttagccatgctatttcttttcctcctctcggttattactcagcactatctatattatcactaatcaaaaaataaaaccagtttagctttaaactggttttataataaaatataattacatctcattaagcatccaaacaaagaaattaagaataccagcataaataagccatattaaataaggcatcattaatagtgctggatactttccccctttgctataaaatctttttattgttaaaataacaaaaaatattaaaactaacagttctaaaaaagctaaaccgtacaaacgtaatccaaaaaatataatgctccataaaaaattcaaaagcaattgtatataatatacaaacattgctgggcttgtatctatattttcgtatttcaaaatataaatcttatatgcagcaatccccataagaatatacagtattgtccacatgactggaaatacataagctggtggagcaaatactggcttttgaagctgttcgtatacttcttttatatttggtagaatcaacgcaatgatggctccacttaaaagaggtaatcctatgtttataataagtggtataattcttatcttggcatttttttcattcatatttaagcacctcataattaataattttcatatcaagatgctatattatatgctacataataaaaaagtatgtattaacaaattttattcatagaaataatttcctaggtaatatatatatctgaaaattcaatatcaactttttcatcaattgaattcatttcaaaattttcatattgtatctgctctttttcaacattgtctaaatagttcattgtgattacaaattcatttccttcattattagatattaatccaatacttccaccttgaatctctactaatgcttttgtcataaataatccaagaccgcttccctcttttattctattgaaagccttatttaattttgtaaatctatcaaatatatatggtattatctctttttctattttaggtccgtcattttttattattatgcacactttatcatcttctaaagctaaattaacttttatcataccaccctttttgccatatttaacactattagataataaatttaatataattcttgtaataaagtccttatcacaattaacatatatttcttcttgctgcgaatcaaaaataagtgtattttcacttctttttatatacttattacaagccagtactgtattttctataatatcaacaatattatatatttttttgtctggaattacatatccttctgatattttatttgaatctataaagttatttattgttcttataagtctaagacaattttggattattatttttctattattgtctactaaatcaattttattttcctttagatatattttgttaagctgaagtacagatgatattaaattaattggtgtttttaactcatgagatatattagcaaaaaattcttttttattcttatcatcagctaaacattcctcaaattctttccttatttttttattttcctctttataactaaaatcttgtacatatattaatttattttcatcatccggacaactaaaaaacatatcaaatactatattttcatcaataaaaaaagaataatgtttactcgtatctacttcatctagtgataaattgcaatatttttttaaaaatactccaatatccataccaacaaaatcagaacttttcatattcattttttttatcatagtattatttacatgctgaagcttattacctacaaataaaaatactcctccgtaaatggaatctaataacatgctataattattttgcgttctatttatcatagtattaatatcatttaatatcttatttctttttagtagaattgaatttaaatgctttttttctttaatagcttgttctatatttaaatttattatattaaagcactcatatcttattttatctatcatatagccataaaataaagtgaatgttgtacattttaatattaacaaaactttagatattatatttaaatcaagttttataaatattaatccagataagtttaacattattgaagttatataaagaataacctttttaaattcatttttagaaattttttttctattagatagtatttttcttaaagtagataaagccacacataaacttatcaatatacttatatatgcaatttcctttaattttaagtcgctgaatatggcttctattgaaatatttttaaaatttataagcgttataaatacatataaaactatagcaattatatgtatacctatattacttatatacttattttcaacgttaaatatattttcaatctggctatactcaagagtagctcgtaaacttaataaaaagaaaacttcttccatactatcttttttcaacaatgttagtataactaacacaataacgacacctattattaaggataaaaaatatattttctttatattactaatctttttaactagtattttatttttaacagtatttatatatacaaagcccactgttattcccagagaaataatgcttatggaaaaaataacaaactcataactgcttcttatacatacatatcctcctaaaacaacaataaaaatcaacaaaaagttaaaattcgtattgcatttttgcctgaaatcttttattttataaaaaaattctttagtcataagtttctcctttttcaaactcaataactatacttgttcctaataatactttttcatccaaatatatttttcctttttgcaattctactaatctttttactacaaacaaacctaatccagtgccactttttgaatctgatattgttttgttagttgacgcatatctattaaaaatcttgtttctaatttcttcatttattccagatccagtatcccttacttttacaaaaaccttgtccattttttcttcaattattacatatatctttccacctttagctgtatactttactccatttgatattaaatttaaaattattcttcctataaattcaatatcaacttcaatcatgcattcttctgtatttgtatcaaaaatcaattctattccgttccagcttacataatcaacatatgacataacataatcttctacaatttctactatattaacctttcttaaattagcagtaagaaattgagaatatattttagaattatcaattaaattattagcaaatcttattaatgatatacagttttcgctacttatggaattatatttttttaatgagtctatatcatctttttctatatatatttgttcaagttgaatagcagagtatataacatttataggagtttttaaatcatgacttatactagataagaattgagttcttgtgtattcctgaatttttttctcttcaacttcttttttcaatttttttatcataacattcgatgtgttatcttcaattaaaataatttttttatcatattgcattaaattcattaggtatttagttttcaaatacttttttttcccatcagtatataatactgcattataatctttttctttatcttcattaataaactctatatatgtatctattttcttatttattatttcttttatgttatgtatttttgctagttctaaaaacttactatttacatataaaattctgctattttcacaatttaaaattataaatggatgaggcataaattcaaaaattttattacttaatttttctttttgtttcataatataatttaattgttcaagttccttatttttcaatataattttattagttatattgtctaagtcttcattttctttttttaatacattcataaaaaattcaccaggctcttcaatttcgctagtaatagaaaaagtaaataacataaggaaattaaataatcctagaatttcaagtatcatttccaaattaatcatactatttataataagaaataataattgaaaaattcctattattaacgtatatatgtaggcttttctaacctttgttttttcttttataaatcccttatacctttttatatctttatacagtgtatgacatatgtcaaactgcattaatatacaaaataattgaaataagaaaagcataatattacaattcataaaatttatatgtatataaaaaacaaatatgtatatgagaaaagctgataaaattaagtttttatatatttttctctgtaagtaatacttaattatcacataacaaagcattacctctattaaaattataatttgacaactaattaatagatataattttaatgaacaaaatgtactgcttcctgtcataattgatattcctgcaaatcctattatatcaatcaaaaccaaaaaagttttaagataatttgatatatattcatcaataaatccttttgttctacttaatatcataaaaagtacacaacttaatactatataaataattcttatagtaattaaaatatctatactatttttttgaaaaaataaatagagcaacatataaataaatactgttgtaaaaaagaccttcagtgtatagccctttatccaaaaaaatttctcatccataattaattttttccttttttacaatttttatcttcttatatattactctattttttattcattgtatacattaatttcctattaatgtcttaatattccactcttcaacaatttgttcattataatatcatttcccttatttaaaggacctttaagagtgattcccaacactaatgaacatatcatatatatgctcaatacttttatatcttttattaacagaggataaacaattcctgctaatatttgtctcataccatttgtggcatatgtgaatggaagataattatatatgttatgaaacacagatggtgtaacttctactggaaatgttcctcctgttcctgccatttgaataacaagcataactacaataattgcctttccaatgtcgtctaaaagactggctgctgtatatataattaatgtaaatacaatagatacaaaaatactatataatataaatattataggatgaacaacataaacatcaagccataacaatgctccacaacatgctaatatagttgctattgttgttagtgttataaacgtcaagagttttcccaaataaacttcatatggctttaattcaacaccatcatctaaattttctgctttaaatgataataatgcacttgctattaatgctccaacccatatacatagtacaatgtaaaagggagcacttgatgatccataattgggccaagaaaacaatctattgtcttctatttcaactggactcgccataaagttactttgatcatcccaattatttgtaatcatatctattatttcattaaaagcatcatcttcatccatttctctaagtttatcggctacttcatgtactttatcctttacttctggaaatttatctttaaggtcagctaatttatcacccgaaaaattaatagtatcttgtgaagcacttaaaatttcctctaaattaggaagtacatcttgcccatccttcaaaatatccactgtaatacttagtatatattttatcgaatcaaatccatcatttattccattcataatttctgaatcataactgtcaataacatcactaattaatgtattaacatcttttaaacaacttcttaaatcagttagtgtctgtaaatcaagacctttcccatcctcaaggtcctgaatcttttcatctgttcttgaaattagtatatcaagtttttcttctacatcatcaagtttatccattaaaattgtgatacttttatttattgttttaagattatccttaacatcatcaaaaatatcatactgatcctttaattgtttttgtatttttgctactccatcatcttctaatagagaatcatctatattaatatgtggaagttcataatctattattttctttaaaaacgattttgtacttttaagcattccctttatttcactaactgttacttttgaagatgtagcagtttcagatatggttataagtgatttttttgcagtctctggaagtatattttcatctaaattatctaatgttacagatgcattatcaacaagctgttgagatagcaaaagatcatcctttattcttggtgaaatttcatttatatcactttgcatcttatctacaatataatcactattatttataaaatcatttgttgaatctaataaatttgacaccgttggcagcatatcattagttttaagcaaaagtgaattcacatcagaaactcctccaattgtatcatttaaaatgctttcaagttctggaagttcttcatcaagttcatatattttgtttattatatctcttatgtcagccctttttccatctatctcaactccagtttcatttataagcctaaacataactcctgaaacagttttgactatattttcatctagctgatttttaacacttttagctcctgcatctgtcaattttggtgctattgcatttatcttttcatttacagtgtatatcagtttgggcttgacaacttctttctccataagtgttgttacacatttagagaaatcttctggtattactatagatgcgtaatattgctcctttacaagtccttctgatgcttcctcttcacttacaaacgtccaatccatcttatcattatcttctagcttttcaataagttcttcccctagatttaaatcctgatccttataaatagttcctgaatccttatttactactgcaatttttattccacttgtgttagcataaggatcccaagatgcttttatatttgtcaaggaatataaagacggaattagtattataactattgccataatcatagctgcccaattggtacatattctttttatgtctcttgcataaattctaaatatattcttcatcttctttatccctcaatattatatgactaacttactttctttcaatttatctacaaatggtttaataagtctattgcttgcctttttacatgtaactcccattataatagaagccaacatatatattgataaaatagcaatatccttaaataatatagaataaacaacacctgccattacctgtctcataccatttatagcataggtaaatggtaaaaatggcgatataatttgaaacattcttggattaacttcaattggaaagtttgcactacttgcagcaacctgaataacaagtaatacaattccaatcactattccaccatgtccaaataggcttacagctgtatatataatcgtcataaatactacacttataaacacactgtaaaatacaagcattgcaggatgaacagcataaacttttaagatatacagcgctcctaaacttgctacaatagcttgaaaaattcctataactacaaacaatgccattcttccaaaatatacttcatgatgcttatattcttcttcaccttcatgtgcatgtacttcagttcctaaaagcatagaaagcatatatccaccaatccataaacataatactgtataaaaaggtgttgctgtcgaaccataattaggccatggaaataacctgttatcctcaatttcaactggatttgccataaagtcactttgtgtttgccaatcatttgttattaattccaatacttcatctatatcttctttatcatcaaattcctttatttttgccgctagcttatgtaccttatcctgaagatctggaaaatcattttgaagatctacaagctgatcatgtgttctattagatatatccataaatgtattaagtaaattatctatctctggtaaaatagctttactttgacctattaacgtcaaaccattatctccaatatttcgtataagatctatttcgctatttatatcttttacaatatcagtgctataatcgtcaattatgtctgcaacaagaccatgaacatcatttacaagtgcttttatatcagttaaaaactgaatatctaatttttctccattatcaagatcgttaattttatctttaactctttcattaatagttgctaatttctcatcaatagtatccaatctattatttatcattgttactattttactcatttcttttaaattcttctgaatactttcaagtgcttcaacttgtttgttatactgatttaataaatccttaaggttatcatctatctctacatcattacctatttcaattttaggaatatctactttagatattttattaagcactctagataactttttcaactgatctcttacaccttgagttgttatctgcattgcatcaactgtatctgatacagttaataatgttttttttgctgtttcaggtaatatattatcatcaagatttcctaaggtaacatttaatgaatctaatttttcttctgcacttacaagcttttccttaatatcaggagacagttcatcaagttcactttgaatatcatctagctcactcaaattatcatcaataaagctttcacctgcatcggaaacatcctctacaaatggaagaatcttttgaatctcagtcataagctctgttgcacttatagttccatttaccgtgctatccaataactttccaagctttggcatgttttcatctaactcataagttgcatccattattcttctaagttcagttctattatcttcaatatctatacctacttcatcgcacattctaaatataataccagttatagtctttgtaatattttcatctaactgactctttacagttttgacagcagaatctgtaaatttaggtgcaataggatttttcttttcattagccgtataaattagcttaggtttttcaacatttttttcaacaagagttgtagtcttttgtgaaaaatcttctgggattattattgatgcataatattcttccataagaagtccattatcagccgtttccttatctacaaattcccatccaattttatcattatcctttaatttatcgactagttcattgcccaaattaatatccttatctctgaatgtggtacctttatcttcatttactactgcaacctttattccagatgtacttgaataaggatcccacgatgcaaatatattaacaagagaatataaggatggaattgcaattaaacctaaaactatccctaatgcaatccaatttgtaattatattcttaaaatctttcttaattatttttattatgttcttcatgctacatccctctgaatagttattaatattttatatagattatatcacaaaaaatgaccataagtcatttttataaattaataaaataattaaatataatttcttcttaaaatacttatatttaattattttattatatttttattgtacataattcatatattaaataaaatatttgcaaaaaaattaaaatattatttttagctaaatataatattttaagtaagtaccttataaaaaattaaccaaaataaaaatataagccaaaatttaattatgcttatatttttataaatcacgaactttaattattcttatttcttctatttttttaactatcctatcattatcccaatggaatcatcaaaaatttttatctctacatttttatttcctaaaattaaagatttgttttcttttattccatcaatttcattaaacaacctttgtccattttcaggaaatacacattcaaaaatttttttcaaattctcattaaatatagttccgttttttcttaataaaatactaatagaaccactatcaaatatatttacagctgcatactctgaattatcacctttgccatcacaccatgtatatctgtaaagagatgaatacttatcatttgaattttcatagtcaactacacgttctacagaactatatccaagtttttcaattagcgatttaacatcattgctgttaaatttatcatctgacaacacattatttgtccatgctccatcatcattcaaataataatctcctatataacagctgtgagccattactccattactgtataaataataccagttattattataaagaatccatcctgactgcattattccattactatcaaaataataccattctccatttttatccttaaaccaacttgtccttaaagttccattatcaaaataactccacttcccattatttaaatgccaaccattagaataatcaactgcatatactccaattgcaccttgtgaaatcatcatagttaacgtagataataatactagcttttttaaatgttttttcaattttaaatcacctcaaattcataattagtatttatatcaaaaaaattcatcatatgtacttatccatactattatagcacctagttaagaataatcattacattattcttaattttaagacctgcttaagattataagcaagtctttgtttttaaatattcacttaaaatataatcagatttttttctcgatttaaaaatatgctcttcaaatttataaaccggcattatacccataagcgaatttgttacaaacatctcatcgaaagtacttacttcgtatggataaatatatttttctacaacatcatacttatcaagaatatattttcttattgttccattaagaagcccacaggataatttaggtgtaacaatttgattgttattaacaaaaaatatattagttgttgctccttcagtcaactgacctttcatgtttaaaaagacgggttcatcataacctttttttgctgcctttcttttttctatgatattatcaccataattcaaagattttatataagtaaacggagaactttcatttctcacaacagaacttatttttattgtaaacccttttttatacttatcatcagtataattattttctctgcattgaaatattgtatttttttctgaagctattatttttagcacaccattttccattggattatttgttatataatcctgtattttttcttttgtaacatttaaatttattcccaaaaaatttgaaccttcactaagtctatctaagtgataatccaatagaacaagatgattgtctacaactgatattgtttcaaatattcctaatccaaatgaatatccttcatcgaatataatgtccattttatctacctctatttcattgcttctaataatgcttttgctttttgcaaagtctcctcatattcaaattcaagatccgattcacaagtaatacctccacctactcctagataatacatattattcttatgaagtgctgttcgtataattatatttaaatcacaattcccatcaagagaaatatatcctaaagatccagtatatattccacgtcttccattttccaattcatcaattatttccattgcccttattttaggagcacctgttattgatcctccaggaaatgtagcctttataagatcaactatatttaaattttccttaagctttccacttatatctgatacaagatgaaaaaccgtagcgtatttctcaacagtaaataattcatccacaattacagatccttttttacaaaccttatttaaatcatttctctcaagatcaacaatcataagcagttcacttttgtctttttctgaactttcaagttcttttcttaatctaaaatcttcttctatattaccgcctcttggccttgttccttttataggtcttgtgtttattacagaatctctcattcttaaaaaacgttctggtgatgcacttactatttgaaaatcaccataattcatgtatcctccaaatggtgatggattactaattcttagacttttaaaaacactatatggtggttttttactataaactttaagttgctgtgtcatatttcctatataaacatcaccttcatatatgtaatttatcattttatctattgcatttttatattcctctttttcaaaattcgaggtaacttctatattataatctatattatttctttcattattttcattaaaacttgaatttattttattttctatttcttttatggatacgtgtgaatctttaatcattccatttgcaattatataagttttttattattaatatcctcaataataaaattatcataaaaattaaaaataacttcaggtgtatcaatattttcatcatgtcttgtagttatatcttcatttcttcttccatagtcatatgacaaatatcctatagcaccagaaactattggaagacaactttcattttcactgctattttctctaatatattgatttaaatactcttcaaaagataaattatttttttctccatccacatacaatatattatcttttacagtaatatttaaatatgaattcaatcctataattgaataattccccatattattttctaatgaagaatctaaaaatactgcatccttttcattgtaaaaaaaatcaaatatgtcacatgcttttctatattcttttaattcaactatcaatctattcatgattattccaccattcttcacttaaatctataaaattttttaaaatttcatgcccatactgagtaagtacagcttctggatgaaattgaacaccataaactgggtattctttgtgtgatattgccattacagcatcatcttcacttcttgcatcaacagtaagctcttctggaatagtttcttcttttataacaagagaatgatatcttgttacaacatagggactttcaagatttttgaaaagattagatttattatgaaaaatctttgatacttttccatgcattggcttttctcccttttcaacagttgctccaaattcatacccaattatctgatgtccaagacatactcctaatataggaattttaccagagaattttcttacaacttcagtacatattccacaatctttaggactttttggtcctggcgatattattattccccttaaatttttcatcttagcaatttctttaattgtaagtttatcatttctaataaccataacttcctcgttcaattcgtcaatatatgctttcagattgtagacaaacgaatcataattatcaatcattaaatacatttttatctccttatgtaattaaatacttcgtattaaatatctatacaaaataatctataatgtaaattaatacttgttcctcttaagtattgattataacttaacaaagaaaattataaaagaaaatatatagcatctaatataattttctatacaaataaggatgcactaagcctttaatatctaagtacatccaattgtttttttaattttatttcatttatatacaacataaaaattcatcgttttatagtttcttgattttataacataataatatttctttttatgaaaactaattaatattataattagtttttaaagcttttataaataattttacaatttcaggatcaaaatgtgttccactgcatctttgtaattcttctatagcttctttataagtttttctcttattatatggtctatttgatgtcattgcatcgaaactatctataacggtaagaactcttgctaaatacggaatttcatcacctttaagattattaggatatcctgttccatcatatttttcatggtgacttattatgagtggaattatcatatttaatgatttgactgattttattatttctactccattagctggatgttgctttaaaacttcccattcatcatctgtaagtttcattttctttattaaaacatccttgctaatattaatttttccaatatcgtgcatataggctccataaatgagtatattcttatctctctcatttagccctaaactctctgccaacattcttccataaactacaactctctctacatgtccataagtatatctgtcctttgcatttataacacttattaaagtttttattgatgttacaagttcaatatcttcttcatcaatatttgactttatttcgtccaatattgatatataagcttcaactctatttttgtaaaaaaactttgccctatatagtgcatcatctgcactttttatcaattcaatatcacttctagctttatctggataaacagaaacccccattgagactgtaagctttccattaggctgattttcttcaccttcaaaatatgtattctctatctttttccttaaagattcagcgatctttactgccatatcctctgttgtatctggcaatattattgcaaattcttctcctccatatcttgctggaatatgttcatttcctatacttgatttaattatttcacctattctttttaatacataatcacccttttgatgaccatacatatcattataatttttaaaataatctatatctataaaaatcattgatacaggactgttctccttttctccgattttaattttctctgataacgaatcacaaaaatatctatgattatatagttccgtaagaccatcaatatttatcatattttctaatttttcaatatgctgcttttctatctttacataaaaacctaatggtaatgcagtcaaaaaaaatattcctgataaaatcaagtcatcttgaaaataagcactcatttccgaattaggcataaagagaatatccataatcaatataataaatgatgaaagtattgatactattactccattattcattccaaattgaattgtggttgttattattataaataaatataacactttatattgactttgatttattccgcaaatcaaagttattatagaaaatataaatataaagaaagcaatctcaagattatctaaaatattatttttatttttaaaataaatatcttttttatttgaaaatgtccatatacaataaattaaaattattattatcattggtacacagaaaaacaaatatttattacatttttttaattccagcaatactgaagtaatatttgtattaaattgtcgacatagaattatacctacaaataaaagtgatgatacttttactattgatactatatcatttatctgcttacttttataattttctacatttttcatttttataattcctcataaagactctaatctatttttcttaagttatttaatattatttcaatataatttataaatataaaactataatgagaccataaaatggtctctctaattattattcttctcttaaagattttggttcttctggttgataatgtgcccaaaagcaggctgaagtagatactattgaagccataacagttgctactgtagctatccccattaaaattttagtcttcatttatttcaccccctttcaataataaaaatatctctatatagtatttaattttcccaatattctgtgcccattttgtgttaatgagaatacctgccacaataatcccatataaatacacattgaataagttaaaaatacatgttcttcaactaagaaatatagtactatatccactattgaaattcctaaatatatgctagttgtaataatcgatgctctttttaatttacgtattttctttatatttttaataggttttgatacactatctacaggtgctaatttatatataatataatatgaaaacataaaaatgatactacctatgaatatattcataatatagtttaaattacagttttttactatcaatgctaatccaactgaacttattgttcctataactgcacatttttctggtgagtttgcatgtactcctcctgaactttttcttaaaatacttgtagtaaatgaaattataagagcttctaccataacattaaatataaatccaacaataataactaacaatatacaaatcatcatatgtataaaagcaaatataccatagtttattattgattttttgtcttcattaaaattcagttctctactaatataatctgaaatattttcacatattttttcaatttttaccacgtttaaattcccctttttttaaatgataaaccatagtaactattgcaaagcataataatgatggaattccaacaattgtttttaaaactacattactcattatttcttctagtttatctttaaataaaatatttatcataaatacattcacccattcacaaataaataatgcaattgttactattaatgaagactttatagctaatactgtatctgacttatttattttatacataattataatcataacaaatattgcaattattgtattaacaccatagtttattggtaaaaatcttattgaatactcaaaaatccccaataaaacacttgatataatatatcgatttttattaatttcaatattacataatgtaaataatgcaaacattagtataaatgattctggaattactctaattaaaaattcaaaaactgttaatttcaacaactttcttttctcctttgattattaatttttttattgcaccatatattattaaaaatacaaaaattctcatcaacacatctcctatactaagaattgtatatcctaaatctataaaatcagttaaaaactttaaatttgcttccgaagttcctaaaatatgtatattatcttttattggactttcgtcactaataaatctgcccgtcaagtatgatattgattgataaacaggcataaaaccaccatttgcttttattactatattatttaatgctccacctaatacaataaaaattgatcctattattgaaggaatatatagttcatatttaaatacaagcaataaataaaatattaagtatattgaagtcaatttattaatagattctataacagtatagcttccataaaatgacataacctgtcctataaacgttattatttcaaatataactaaaggatatattgtccaagaataaaataaaacactcactttgtttccttttagttttgcatataaaaatgccaataatatcgtctctggcatatttcctcctaaatgtttattttaattgtttattcacgtataattatattatcttttttcctattattccacctttttcatataaattaacataatatttgtcaaattaattatattttccagtagtttagattgaataattacatttttatctttttaaaaaataaatccaacattttataagttaaacaaaaataacacataaatttcatacattgtacaaaacttatgtgttatttctttacctattatttttggtgcagatgacgggacttgaacccgtacgcctcgaaagcacaggctccttaaacctgcgtgtctgccgattccaccacatctgcatatttttttgttaagttaataataatccatatttagaattatttcaagtactttttctcaatattgtaaaagaattaatacaatttgattaatcctttcacaattatattatacattttatacaaaaaaatgaacattccaaatactttttattaaatctaatattttgtttacatcaaaaatactttcatcttcactataaagatattcataaacgctataatacgtatttaccttatccacatacttttttgtttctccaaaaggtatgtattcaatatttttcccattacttgaataattcttatctttaagccagttttgtacattagttggacctgcattatatgctgcaaccataagatctctgtcattatcaaacatgtcaccaagccatctcagataccagcatcccattctaatgttatactgttcatcatataaatcatcttttgaaaaagttgtatatcccatttcattagctgcccattcaccagtctctactgttatctgcataagtcctactgcatttttatgtgaatgagcattatcatcaaatttactctctgttttcattactgataatacaaatagaggatctaaattatattctttactgtacatatcaacatattcctgatatttataagggaaaaacttttctttcacaacatacctagatccaactacgacagctaataaaattattagtaaacaaaaaacatatcttaggaatttcattattttctccttatctagcttattaattttataaaatcgattaaatcatatacctgtttctgtgtatctattaaatcgccattattatctattaatatatttgcaaactcttttttctgctcaacaggcatttgggaattaattctgcttactgcatccgactttgtaagcttatctctgcttattatcctctgtatctgaaccgaattgtctgctacaacgagtattacataatccatctctaaatgcaagttattttctattagagtaggtgcatcaagaatcactatcttttcaccttttttctcatatctttcaaattcagtttctatttcttcttttatataaggaattattattccctcatatttaattctctgctttggaaatctaaatatatgatttccaaattcttttcttctgaattcgcctctccagtcgaaaaaacctgaaccaaactgtgttcgtataatatcaagtattctaggattcttctcaagaacatcccttgatactaaatcagcatctataatcctaaatccttcagctgaaagtatttttgatactgtacttttaccagtaccaatgccccctgtaagtccaattttaatcatttctataccacctttttttactccttaatggacaattaacaattaaggaatgaaatcatatttttttaatatgatttttatagctttgctatttttccttaattgtaaattgttaatcatcaattatacatttgttactatttagcttcataccatgtctttcctgagtttatatcaacatcaagtccaacacttagcttaattgcattttccatttcatctactactatttttttaacttcttcaaattcattttcctttacattcaaaataagttcatcgtgaacttgaagtattaatttactctgcatcttactttctttcaatttattataaacattaatcattgctatttttattatatctgctgcacttccttggattggcgcattcatcgctagtctttcacctaatgctttaacaatcttatttgatgcatttatttccggtatgaatcttcttctgtttaatatagttaaaacatatcctttttcttcagcttcacttactatgttttctaagtaactctttattttaggatatctttcaaaatatatattcatatactcttgtgcctctgcttttggaatctttaaatcctgtgataaactaaatgcactaataccatatactattccaaaattaacagctttagctctacttctcataagagatgttacatcttcaacaggtactttgaatacttccgatgctgtctttgtatgtatatcactatgatgcttaaatgcatcaatcatgttttcatcacctgcaatatgggctaaaacccttaattctatttgagaataatcacatgaaactagagtgtcaccttcttgtaatggtataaacacctttcttatctctcttccaagctcatgccttattggtatgttctgaagattaggatctgtacttgataaccttcctgttgtagttacagtctgattaaaattagaatgtattcttccatcttcatcaataacattttttaaaccttcaacatatgttgaacttattttggttatctgtctgtaatacattatctttggtattatttcatgtttatccaaaagtttttctaatacttcttgattagttgaatatcctgtcttagtcttttttatgattggaagatcaagcttttcaaataaaattttaccaagttgcttaggtgagctaacattaaattcttcgtcagcaagttcatatatttctttttgagttctttgaatttcactatcaaattttattttaagttcatcaagcatactttggttaatattaaaacctatactttccatagatgataatacaaatattaatgggtgctcaacctcataataaagtttatccatcttttctttttctatatttgattttaagatcatatataatttaggtatatatgatccaagaataccttcattttctgactcaatgccatcaatttctttatttaaatatttttcgattaactctgttaaattatacttactttgagctgaatctaataaatatgctgctatagctgtatcaaaatcaaattctttcactgttatgttattcttatttagaaaagtaacaagattttttccatcatgtattaccttttttactttatcattttccataatatttttcaaaagctctattgattttatattatcttctctagaaattttttcaaaatctataacattacttatgtcttcttcactaataattattatgtgcttaagatcaagttttgaataaatagaactatcatttaaagtataacttatataaattctatctttcactttattcataagttctgaaaattcttctatattatctatactatttatttttatattacattcatgtttttcctcattattttcgtcttcattctcatgagaaattgcatcttttaaatttagagatttaaattcaagctttttaaattcagcatttccattttctatatctatatttaattttagagaatccctatttaactctccaagatcaatatctttttttattattgctagctttttgcttataattgctgatttttctcccacaatttcagtatcacttgtctttagcaaatatgttaatggtgagcgttttattcctaatttagtcttccaataatcctttatttctttttcttgtttcttgtcaagatttcttatatgttcatataaattttcaacagttccatattcatttataagtggaactgcacttgcttctccaacaccagccacaccttttatattgtcagatttatctccaacaagactttttaaatctgcaacctgttcaggtttaattccatactcacttttaacaagttctggtgtaagttcaaaagctttatctggaatattagctgttgacttttttatttcatatttcttaaataaatcatctgctttctcctgagtcgtaaacatgagccataattttgtattttcactaaccagctgtaaataatctgtatccttagtaagtattcttactggaatttcaccttcaagcttagatgttatacttccacaaaaatcatcagcttcatatttactgtccataaattgcataacattcattttggctaagatttcctgacataatttgaactgttctttaagtggagatggtgtctcccctcttgttcccttataatcactatctatttctcttctgaatgtatctctactcaaatcccatgtaacagcaacatgtgtaggcttttgctctcttaatatttttaaaaaagttctcataaatccatatattgcattagtataaatccccatagaggtttgcattatcttcccgtaaaaagcttctctttcttcatttgtctttgcaaacattatttcacgtggtaaatttccataatattgtgtactaagcaaacttgatccatctataagtaataagtattctttatccattcttccatcttccttttcgtaacaattatatataatagttttctctatcatataaatattaattctctttattcattataaactctattatatcaaatttaatcatccattatctgaaaaaagtattattagttttattttttattattccttgattattataaactaattattatactttaattatatcagtcaattgataatatttctgattaatgcaataatattatcaataatagaataatgaggtgaataaaatgtttaaagatttactatcaaaatatgcaaaacttgcagcattaaaaggcataaacatacaaaaaaataaaatgcttgttataaacagccctatagaatgtagcgagtttgcacgaatgattgcagaagaagcatataaggctggtgcttctgatgtagtaattaattacaatgatgagaaatttaataaaataaaatatgaatacacttcagcagaagtattatcatttacacctgaatttgaaaaagataaatacaactattatgttgaacaaggtgcttcatttttaagcatatcagcttctgatccagatcttttaaaagatattgatgcttctaaaatagctacagttcaaaaaagtcgtcgtgaagctttaaaacgatactatgaagcatgtaactcaaatgaaaatgcatggtgtatagtttcagtgcctacagaaggatgggctaataaagtttttaaaaattctaattcaaaagaagctatcgaacaattatgggatgcaatttttactgttatgagaataaaagaagaagaccctgttaaagcatggaataatcatctagaaaatctaaacaaaaaacttattgaattaaataatcatgctttcaagtatatacatttcacaaattctcttggcacagatttaaaagttgaacttgtaaaaaatcatatatggtgtggtggtaaagatactactaaaaatggtgtagaatttattgcaaatatgcctactgaagaagtatttacaacacctaaactagatggtgtcaatggtactgtatacagttcaaaacctttaagctactgtggcaatcttataaacaatttttctataacttttaaagatggaaaagttatagactgtagtgctgaaacaggacttgatgttcttaaagaaattattaaaactgatgaaaattcatgtcgacttggtgaagttgcattagttccttatgactctccaatttctaattccaatattatattctttaacacattatatgatgaaaatgcatcatgtcatttagcacttggttcttcttatccttcatgtattaagaatggtgaaaacatgaataaagagcagcttttagaagcaaaagcgaacttttcattgactcatgtagactttatgataggaactaaggatacaaatatagttggtgtaaaagaagatggaacaaaaatatcaatatttaaagatggaaactgggcttaataagaactttattaaaggccaaaattacagtttagccattaacatataatatttctttttaccaaaagaacaatgtagcattaataaaataaaactacattgttctttctttttaaatttatttataaaatcctaactgtgttttttctttgatctttcaagattttcaaaatgtattcgaagttcattattcaaaacattaatgatatttttaaatgaatttttaaatgcacgtctcgctaaaaatctttgaaaatataaagttgtgagttgaataaatttctgtgttgtctgcttttctgaaatggtcaatctagtagttccatcttgttgacctaaaaacgtatatgttgatatacatgttgagtattcgttagaagttgttatctcatattttttatttttttcgtaatctgttatttcaacagtacattttattggctttggacctcctgtagttatatctttttcaactttacatccaactggattttcttcattaaaatcactaaaatctctttttgcatttcttataaaatgattgaaaacatcttcaacctcataattaactgttcctgtcatcttcatattaaaaccctccccaattccttctataggaatttaaacgtacacatataatgttatgtgaatgttcttattgtgtttttattatatcttatcactctataaaagtctattaatgacatattaaaaacacattatatttttaataaaagtaatatgttttgttttcattttacatcaataaaatcattgatataattatccatataacttagttaataatttaggacaaaaaaaatactaacaacaatctgttagtattagaaaaagaatggctaccgtggtaagactcgaactcacaacatacagaaccagaatctgtcgttctaccattgaactacacggtaatattctcttgtctttcgacatcatctattttacacaaatttttcataaattgcaagtatttttattaatttaaatgtttatcattaggaattaaattaaccaaaaacttatttgcagctctttaaactatatgatttaattggaatatagaattataaatatgaccaaacaaacaaataagctgtaatgtctgatgaaagcatcataattacagcttatatattataatatttcttctaatgtttttcttatttcttttataaattcaaaggtatcagctttttgaatattatcatgtactgcaagtacagctaaatcacctgtcattattcctttatcaattgtctttaaacatgcttcttctaatttattagcaaaattgactaattcatcattacaatctaattcgcctctttttcttaaagctccagtccaagcaaatattgttgcaactgaatttgtagatgttttctcaccttttaaatgacagtaatattgatcttgaactgtaccatgtgcagcttcaaattcatattttccatctggtgaaactaagactgatgtcatcattgcaattgaaccaaaggccgctgctatcatgtcactcataacatcaccatcatagttcttgcaagcccaaagcattccaccttctgacttaataacatttgctactgctgcatctattaatgtatatttatatgctataccacacttttcaaatttttctttatattctttttcaaagatttcttcaaatacatctttgaatgtatggtcatattttttagaaattgtatctttagcaccaaaccataaatcttgttttaaatctaaagcataattaaaacagcttcttgcaaaactttcaatagatttatttatattgtgcattcccataacaacgccactactatcaaagttatgtactaattctctttgaacttctccattttcagaagtaaatacaagctcacactttccttttccttctatcttcatttctgaagctttatatatatcaccataagcatgtctagctattgttattggtttcttccagcttctaacatatggcttaactggtccaactataattggtgctctaaatacagtaccatctaaaatagcccttattgttccattaggacttttccacatttctttcaaattatattcttcaactcttgcagcattaggagttattgttgcacactttacacccactccatatttctttattgcattagctgaatctacagttacctgatcatttgtttcatttctatattctaaaccaagatcataatattctgtttttaaatcaataaaaggatttaataattcttcttttatacttgcccatactattctagtcatttcatctccatcaagttctactaatggagttgacatctttattttttccattttataattgcccccttaaattgcttatttaactgtaattaacactgttaattatacattatgattgtatttttttcaatttttatgctgaatatataaagcataaaaataggatatataatactgtgcaatactatatatcctagtcttaactataaaaatatttttattaatgttaccgctattattatctgacatgttcctactaaaagcccatatgctaaagatctaggtccttctttaactaaatcagagaatttaacttttaaaccaattgcagctaatgctattatttcaaaattgctgcttattattttaaatccatgctgaatacttacaggtattaatccaaaactatttgcaatacataatataaagaatcctattatataccatggtatacttacatgcgacttcttttctctttctattatttcttctttaggaatatgttcttcatgttttatatttattcttgaaaatcccattacaacaaacactaaaaatattattcttataattttaaatattgttgccattgtaactacatcttcattaataaatttagctgacgcaattacctgtcctacagattgaagaatccctccaatcatagcagaagtttgtgttaatgaattcttatataaaagtgcagtaatcataggaaggacaaacattaatattgtccctgtcaaattaacgatagtaactgaaatagctttatccttatcacttgcatatatgcatggcgctgttgcagcaactgctgaagaaccacatacagcatttcctgaacacattaataaagaatacttctgagaaaaacccattttctttcctatgaaatatgtaattaatattgttaatgtcatttgcatagcaataaataatacgccattaaatcccaatgtagcaatttgcataaaattaattgtagctcccataagaacaattgaatatgaaagtaaatccttttccgaaaaattgaatcctttattgtattttgatttattaaatatagtatttcctaatataatacctgcaataattgaaaaacttgatgcccctagactaggtacaagagtgcctaaaaatttcccaatcaaagctacaaatactgcaataataaagcctggtattatatcttttatttttttcataatagtatatcacctcttaaatctttttgtattttcatagtaaatatttttatcagctttatattatttttttcctttttgctgagttctactcttaatacaaaaataattataatctcaaaatattaataagtgaaatactagttatttatataatctataactatttagttatgattgttttctatttatattaaatctttagtaattctatctctttataaagttcttaaaaatttttattgtaaattttcaaatcaatactatatttaaatactaatacccttctatacttcaactaaaattttcttgaataatctataaacatttttatattgttgcttaaaaatttatctttatgataaataagactaagcattctctttatttttttatctttaattctcaagccactcaaacttccattttcaattttttctattacgcttcttttagaaagacagcttacacctaaattcgcttcaacacttttcttaatagcttctgtatttccaagttccataaatacattatattcaatattattattttcgaaaaaactttctacaacttctcttgttccacttccaccttctctcattattaacttttcctttgctatatctccatcttctaaattctcttttctattccatgagtgtgacaggctgcatatgaatataagttcatcttcccacatctcttctttaattatttcttcataagaacatctaccttctatatacgcaaagtcaatttcgttttcaagtatcatcttttctattttttctgtgttagcaacactcaatgatacctcgatacctttatgttcttgtaaaaatcctttaattatatccggtaaaatatatatgccaatagttgtacttgctcctatttttatttttcccttttcatttttgctcatatcacttactgtttttaatccctcttcatataaattcaggattcttctaacataacttaaataaacttctccttcttgagttaggaataattttttacctattctatcaaacaatttaacatcaagttcttcctctatttcatgaatagcctggcttatagatggctgacttatataaagcttttttgcaacttttgtcatattaagttctgtagctgtttcataaaatatttttaattttctaaaattcatatagcatttctccctatgtttttatttaaatatgttattatttctcaatggattaaatcttatattatttttattatatattttatcattaatcttataaaataataataaaaataacagaatcagtaattcaaccaattctgttatttccatttatctatctacttattatcaacatcttcataatcaacatctataatttctccgttagtgtaatcatctgaagaagtatatacatcttgtgcattactatttgtactgctattactgttatatatatttctatttacatcttcatctcttttttcgccttcaatttttcctttaagcttaaccactgcataaattataattccagcaacaattagaaatggaagaagcttaataaacaaagttgctactacaaataaaacacatactgttccaattatatatatatatctattcatacactcatcctcaatgtctactattttttcttatattataccttaacatatctaaatttacaatgtgtaaaacatgtttctatttttatacatttctttttatattatattgataattacaaatgtttcgctatttaattagatctcaaaattttactttacacaaattttattctaagttatgtattataaaattataatttttatactttattcctgtagattcatatataattattaaattaaaagttttataaacaaaatctaagaaaaattaacatttattactaaaaatagtttttattaaaatttctcaaaaaatttatgataaccttatcatgatgatattaacataatttttaaccaataagttacaaaaggaggagtaaaaattataaaaactcaataaaatttatgttttatcataaatgctaaagataagtttattagcttacatcatctcttcaatacacaaaagtaaatataaaaaaatcaaaaaagggggattaataaatgtgtaaaattttcaaaacctttaaaaaagccctaatagctggagcaatagtaatggcacaaactattgcttttatgatgcctatgccaattacagcgtatgccgcttcaagtaatggttttcaggtaagtggtactaaattgtatgatgcaaatggtaaagaatttgtaatgagaggaataaatcatgcacacgcctggtataaaggtcaagaatctactgcaattcctgctatagcaaagacaggtgcaaatactgtaagagtcgctttaggtgatggcgatcaatggggatatgatgatattaatactgtaaaaaatatcatttcactttgtgagaaaaataatctagtagcagttttagaagtccatgatgctacgggctctgatgattattcaaagcttgataatgccgtaaattattggataagtatgaaagatgcattaaaaggaaaagaatcaactgtaatattaaatattgtaaatgaatggtacggcacttgggatggtcaaaaatgggctgaaggatatgaaaaagcaattcctaaattaagagcagcaggtattgataatactattatggttgattctgctggatggggtcagtatccaaaatcaatagctgattatggtaaagctgtatttaattctgatccagataaaaatacaatgttttcaattcatatgtatgaatatgctggtggagatgcaaatactgtaaaaactaatatcgatagtgttattaatcaaaatctagcattatgtattggtgaattcggaataagacatactaatggcgatgttgatgaagaaactattatgaattactgccaagaaaaatcagtaggttatataggatggtcttggtatggaaatggtactgactggatatatcttgacattgcaaatgactggtctggaagctcatttactgaatggggtaataaattattaaattataaaaatggaataaaaaatacttctaaaatatgttcagtgtttaatggttcaaccggtggaagtgatcaaggaacatctggaaataaaataactgttgaagctgaaaatggatatttaaatggtgttcaaaaatcaactgaacgttctggatactctggaagtggatatgttactggttttgataataatagtgattatatcgaattaaatgtaaacgttccttcttcagggacttattacttaaatgtacagtatgcatcacaatatggtgacaaatatacaaaacttattgtaaacaactctgaccacggagataaactattaaaacaatcaactaaatttaccaatggataccttgatgagatatctttaaattcaggaaataataaaattaaactccaaaatgattggggatattacgatattgataatatcactgttactaaaaaataatatcgattagatccttatacaataacaattaaaaataatcggaaacttcaaaatgtagtacatacatttctagtgtttccgattattttatatattttttaatatattagatttaacttcttaagaatttatcaacagcttctcctgcttctattccatcagctattgctcttactactaatgattgaccgcttcttgcatctccagtagtaaatatttttggaacgtttgtcttatatgaaccttcttttgtctgaacattacttcttgcatcactttcaacagcaaatgcattttttaggtaatcttcagaacctgtgaatcccatagctaataatattaaatcagctttgtaattcttttctgatccttcaactggaataggagcaaatcttccattttcatctttcttccattcaacttttacagtatcaacactttcaacatttccatctttgtcagcatttacttttgtaacagttgttaaatattctctcggatctctaccaaataattctataaattctttttggccataatcaaccttaagaacctttggccattctggccatggattatttgcactacggtttttagatggttctcccattatttcaaattgaactaatgattcacatccatgtcttaaagatgttgcaacacagtctgtacctgtatcaccaccaccaattactattacattcttaccttcagcacttatataattcttatcttttaaattagaatctaataggctctttgtacttgctttaaggaaatctactgcaaaatgtattcccttaaccccttctctgccttcacacacaagatctctaggctgagatgctcctgttgcaagtactacagcatcatattcatcacaaattctttgtgcatcgtaattctcaccaacatttgcattacatacaaatttaattccttcttcagccataagatgaattcttcttaaaacaacttccttatcaagcttcatgtttggtataccatacattaataatccacctggtctgtcgcttctttcaaaaacagtaactttatgaccacatctatttaacttgtcagcaactgcaagtcctgcaggacctgatccaatcactgctacagtttttccagttctttttgctggaggattagcctttacaattccagtttcaaaagcagtatctattattgctctttcattttcctttatacttacagaaggcccattgataccacatgtacacgctgattgacatggcgatggacatactctgcttgtaaattcagggaatggacttgttttatgaagtctttcataagctaatttccattttcctctataaacaagatcattccattcaggaatcaggttgtgcaacggacaacctgtaaccattcctgaaataataactcctgattgacagaaaggaactccacaatccatacatcttgcaccttgaatttgttgttcttctaaagtgagtcttgtatggaattcatcatagtcatttaatctttcttttatatctctatcttttcctacttttctttcatattctaaaaatccagttggttttcccatatttcacaagcctcctacttacctttaacttcttggaatgttttaattaacgcttcatcttcgtcacatccaagattcttgtatttttcaacagtttctattacctttttataatcactaggtattatcttaataaaattagatttttctgtttcaaagttaaatagtatcttgttaccttttggtgaacctgtagtatttacatgttcttcaattaaatctttaagaatcttttcatcatctaagtttaattcttctaaaagaaccatatcttcatttatattgattctgaagttttcatcttctttgtaaagataagcaactccaccactcataccagctgcaaagttgattcctgttttacctaaaacaacaacttttcctccagtcatatattcacatccatgtgctccaacaccttcaacaacagcagttgcaccagaatttcttacacagaatctttctcctgcaataccatttataaatacttttcctgatgtagctccatataatgcaacattaccaattaatatattttgatctgcaataaatgatgatttctttggtggatatactactaatttaccacctgataatcccttaccaaaatagtcattagcatcgccttctacttcaaatgttaaaccatttggtacaaatgatgcaaaactttgaccagctgaaccattacacttaattgttatagtgtcttctggtaatcccttatgtccatttactcttgttacttctgaaccaagtatagttccaagtgttctgtctgtattagttatatcaacttccatacttgtcttttgaccattttcaatggcatctttaaacttatctaagaatattttttcatcaattactgactgtaatttaaaatcatatttcttttctggattaaatttaacaacttttcctctatatttatctggagtataaagtacagaacttaaatcaatatttttagccttccagccatgaatattttctttttgcttaagtctatctactctaccaatcatttcatcaatttttctaaatccaagtttagccatgatttctctaagttcctgtgcaataaaatacataaagttaactacgtattctggttttcctttaaatctctttcttaactcttcattttgagtagctacaccaactggacatgtatctaagttacatactctcatcattacacatccaagtgttactaatggtgcagttgcgaatccaaattcttctgctccaagaagtgctgcaattgcaacatctctaccactcataagcttaccatcaacttctactcttactctttctcttaattcattaagaagtaaagtttgatgtgcttcagcaagacctaattcccaaggaagtcctgcatttttgattgagtttctaggtgatgcaccagttcctccatcataacctgaaattaatattacttcagctccaccttttgcaacaccagctgcaacagtacctactccacattcagacactaatttaacagaaactcttgcacctgtattagcattctttaaatcatagattaattgagctaagtcctctatagagtaaatatcatgatgtggtggtggtgatataagtcccacaccagtagttgaatgtcttgtttttgcaatccaaggataaacctttcctcctggaagctgaccaccttcacctggttttgcaccttgtgctaatttgatttgaagttcatcagcattaactaagtattctgaagtaacaccaaatcttcctgatgcaacctgtttgattgaagatcttctgctatctccattttcatctaggttccatctttctctatcttctccaccttcaccagtgttagatttaccaccaattctattcattgcaatggctaaagcttcatgagcttcttttgaaattgatccataagacatagctccagtcttaaatctcttaacaatttcatcaactgattcaacttcttctagtggaatttcattagaactatagttaaattctaataaacctcttaaatttatttcagcctcttcattatctattaactgtgtgtattccttaaataattcataattattagtccatgtagactcttgtaatttatgaatagttaatggattatataaatgctcttcctgaccattgttaccacttcttaatttttcatatccaggtgtatctaaagaaaaatctgccgaataagttttttctttaaatgcattttcatgtctgatttcagcttccttttgaatttcatctaatccaataccttcaattctgcttacagtattagtgaagtatctatctataacttcttttcttatacctatagcttcaaatatctgagcgccttggtatgattgaatagtcgaaatacccattttagaaagaatcttagttattcctttaagtactgctttattatagttataaacagccttatcgtagtcaattccttctaataattcatcttccattaatcctcttattgtttcataagccatatatggattaatagctgatgcaccaaatccaagtaaagttgcaaaatgatgtacctctcttggttctccactttcaagaattaatccaactgaagttcttgttcctttttgaaccatatattgatgaagtgctgaaacagcaagtaatgcaggaattggaattttatttgctgaaacatttctgtctgataatattaaaatagtatatccttttatatatgcatcttgagatttttcaaataattcatctaatgcatcttctaaagatgttcctttgtcatatactatatcaataacttttgattttaagtttcctttattatatgctttaatttttgctaattcatcattatttataattggtgaatcaagtttaataagttcacagtttgaaggcttatcttctaaaatatttccttctggtccaagataaacatttgatgctgttactatttcttctcttattgcatctattggtggatttgttacttgtgcaaataattgcttaaagtagttaaataaaggttgtgcttgcttagataatactgcaattggagtatcaacacccatagctgctaatggttctgctccagtttcagccattggaagcatagtagacttaacttcttcgtatgtatatccaaaagttttttcaagtcttcttcttgtttccttatcatattctatcttaagctttttgctttccttcatcttatctaatgtcacaagattttcttcaagccattcaccatatgcattttcgttagcataagcattctttaattcttcatcacttataacttcctttttagcagtatcaactaaaagcattcttcctggcattaatctatctttcttttcaactatttcagctggtatatctaatgcaccaacttctgaagaaagaataagtcttctatccttagtaatataatatcttgaaggtcttaatccatttctatctaaaactgcaccaactttttcaccatctgtaaatacaatagacgctggtccatcccatggttccattagtgtagcattatattcataaaaatctcttttttctttactcatagtcttgctcttataccatggttctggaatcgccatcataacagctctagttagatccatgccattcatatataagaattcaagattattatcaaaaattgctgagtctgatccttccttatttattataggaagtactctatttaaatctttaccaagtactcttgatttaacatttgtttctcttgagtaaatcttgtttacatttcctcttaatgtatttatttcaccattatgaatcataaatctgtttggatgagctctttcccaacttgggaatgtattagtactatatcttgagtgaactaatgcaagtgaagtttctaatctttcatcatcaagatctctatagaattctctaagttgtgttgataaaagcatacctttatacacaattgtctttgatgaaaaagatgctatatagaaagtttcatttaaaaatttgcttatccatccagctcttttttcaatatttcttcttacaatatataattttctttcaaaatctcttcctctttttgtaccattaggtctctttacaaaagcttgcataatatatggcatagcttctaaagatgcctttccaagtattgatggattagttggtacttctctccatcctataagtccaaggttttcttctttacatatatcttcaaaaagacttacagcttcttttcttgccttttcttcttgaggtaagaataacattgccactgcataatctccctcatcacctagaccttctcctttagagcctaattcttctttgaagaattcatgaggtatattaaataatacccctgctccatctcctgtattttcatcagcaccagttccacctctgtgctttaatttttctaatattgttaaacaatctgatagaatttcatgagacttttcaccatcaatgttaactatagtcccaataccacatgcatcatgttcaaaaaatggattatataatccttgtgcatttggataattattttccatctaatttcccccctgaatttataatatattgttaatattatgctactgttagcccctactaaaaagaggaagcaacattaccataacttttaacatgtaaaattttaatacttaatttttaatacttaatttttaatacttaatttttaataatctattttatatgtagtaagtaacgagtaaattaatatttgcaattcatttactcgtattatttattaccaaaacttaaatctattattttaaagaaatatgttagaatttagtctaccatatttctttgattttattcaagttcttgtaatatcaaactagcaatatccttcattcgtctccctgaatccatgcttattttttgcatatatctaaaagcttcattttctgtaagtccagacgttgacatcaattgtcctttcgctttttcaataagctttctgtcttcaagcgtatgttccagcttttcaactttttgttttaacttcttaattctccttttactttggaaaattaaatctattgcatttgttaaaagaacactagaaatcttagttcccatacagtatatatctgtgtcttcttctatatatgacctataaggttcattaacaagagctaaaaaactggtatagtccactagattttcataagcatctagtagactcatatccttaaatttatatccaactaagacaaggtcaggggaatattgcataactaatctaattaattcattgcctgatgtgcaaagggctataatatcatatccctcttgagttaatagggtttttaattttgttgctgtttcaatattacctactgctataataatttttcctttttgcatcattgcaatccccaccttaaatgataatcagagctactagattaatatctatttaaatagttctcaatttcccaatcatgtactttagttctataatcatcccattcagcttctttagcttccacgtaattttcataaatatgttcacctaaggcagctttagctaattcactttctttcatgaaattaactgcttcatataaattgtttggtaaattatctattccagcatcttctctttccttatcactcattgcaaagatattagcaactgtttctggttcaacttctaaattattcttaattccatctaaacctgcttgtaataacactgctaacactaagtatgggtttgcacttggatctggacatctaagttctactctagtccctgccccccttgaagctggaactctaattaatgctgttctgttgctacaagaccaagctaaataaactggagcttcatatcctggtactaatctcttataagagttaactaatggattagtaacagccgataatccttttatgttctttaataatccagctataaattggtaagcttctttacttaatccatttttatcacttggatctgcaaaagcatttttaccatctttaaataatgacatatttacgtgcattccagaaccatttatcccaaatattggtttcggcataaaagaagcatgtagaccgtgtctttgagcaattgctttaacaactaatttgaatgtcataattttatcagctgtttctaatgctggtccgtatttaaagtcaatttcattttgtccttcagcaacttcatggtgagatgcttcaatttcaaattccatttcctctaatgctaaagtcatatctcttcttgcattttcgcctttatctgttggagctaaatcaaagtatccagccttatcttgagttatagttgttgcctgaccattttcatctgtttcgaataagaaaaattcacattctggtccaacattcatttcaaatcctaattctgctgcatcatcaatagctcttcttaatgcatatctaggatctccttcaaatggtgttccatcaggtctgtaaatatcacaaattaatcttgctactttaccttgttgtggtctccatgggaatattacaaaagtatctaaatttggtcttaagtacatgtctgattcttctattctaacaaatccatcaatagaagatccgtcaaacatcatttgattgtctaaagctttttctaattgcttttctgttattgctacattttttaatgctccgaagatatctgtaaattgaagtcttataaatctaactccattttcctctactaattttaagatatcttcctttgtatattttgccattgaaaattccccctttttcttactaaaaaaagacgcacaatagataggttttaaccatctattgaacgcccttgctcaattcatatcttatattcaaattatatagtattttttgttgtaaatcaacactttatttaaaaaaatatattttttatatatttttcttaataaaaataattataatttgaaaatacttaatttattaaagtcgttttaaaaataacttcttcaattcattatattcaacgcattaatatttggtgcttaattttctatgctttttatgttatttatatgaaattattagtttttatattaccataaatttaagtataaaaaaatagatatttaatcagaatccttaaattctaaattctgaccaaatatctatttgtattaataaaagcattattatctattattcattaattaaagcttccttacctgttgctcctgttcttattttaactacatctttaacatcataaacaaatatcttaccgtctccaatttctccagttcttaatattttagttgcaacatcaataaccttttgaactggtacttcacagacaatgatttcaattttaattttaggtaataactttaattccattggaacacctctataatattgtatatcacctttttgagttccacatcctaatacttgagttacagtcattcccataatacctatttcattaagtgctgtctttaattcatcaaaattgctctttcttgtaattatttctattttacttatactatctgccatttttaaaacccccctcttttcagttgacagttaacagttttcagttaacagttattggtttatattcttgcataatatcttattacttcatattctcaaaaatttctttcaaatattcaaactaaaaagttaactgttacttgttaactgctacttgttaactgattacatgtttatatctacactttggaaatctgcataactgctttcaagtccatgttcttctatatcaagacctctaatttcttcttctcttgttacccttaaaccaattgttgatttaattcctttaaataagattgttgctgtagccacagaccaaattgcgactgctgcaacacctaagcattgaactccaaggaatttgaagcctccaccatagaataatccaccatccatagcaaatacaccagttaaaattgttccaacaacaccgttaatacagtgaacaccaactgcaccgactggatcatcaacttttaataccttatcaacaaattcaattccatataccattgcaaatgctgaaataacacctataattgctgctccaagaggtgaaacaacatcacatcctgctgtaatagcaaccaatcctgcaagaacaccatttaaagtcatgctgacatctggctttccatatttaatccatgtaagaaccattgttactgttgctgccgctgctgctgctaagtttgttgtaataaatactctagaacttaattctaatgcaccttcacctgtaataccaaggcttgaacctgggttaaacccaaaccagcccatccaaagaatgaatactccaagtgcaccaagtgttaaactgtgtcctggaattgcatttgatttaccatctttagaatatttaccaattctaggtccaagtattgttgctccaactaatgcacaccatccaccaatagagtgaactgctgttgatcctgcaaaatcatggaatcctaactgcgctaaccagccgccaccccatatccagtgacctgcaattgggtatataactgcactgattattgcactatatatacaataagaaataaatttagttctttctgccatagctccagaaactattgttgctgctgttgcacagaatactgtctggaaaaataaaaatgcataattattaactgaagtagctgcattttcagcagttccatctgtaaaaaatcctggaataccaattattccagctgcatcttttccaaacattattccaaatccaataatccaatatataagtgatcctaaagcaaagtccattaagtttttcattataatgttaccagcattctttgaacgagtaaaacccgtttcaaccattgcaaaacctgcttgcatccaaaatactaaaatccccccaagtaatacccaaagagtatctatagccatatttgtatccatattaatatcctcctctattaaatgtacaacaagccaaatatactttaattcctatttttaagaatttattacattaagtagttaaaaacagcccttgtccattatttaataataattacaaattaattactatctcctataaattctgcagaaaattattttggataataaaaaacgaagtcatagaaagttaatacttctatgacttcgtcgtcaaacttatttaatttatgttttcattatatattgctatttatttcaagtcaatactttttgtaagcttttttacatgaaaatgttatcaatgaataattttcccatattattaagttataattaccattttatataatataattatccatatactataattccataacataaacaataaccaaaatacttttcaataatataatttgaaatttttacattatatataacaaattatttttgaaatgaatttcatataatcttcattatatattatttttaatttttaattaaaatctttaaaatcaatctatcttcactataattaatcaaatcacctaaatgttctttatgaaattattaataatcaattattattaataattttcttgaacattattagataaattgctacaatttattatgtaaaaattataaatacatataaatattgggggctataaatatgaagacaatcgtaacaaaatttggtggcagctcactggctgacgctaatcaattcaaaaaggtaaaagaaataataaacgctgatgctggaagaagatatgtggtaccttcagcaccaggaaaaagacactctaaagattcaaaagtaactgaccttttatatctttgccaatcacacatttctgttggaatatctttagatgatgtttttaatttaataaaagaaagatatttaggaattatcaatgatttgaatctagattttaatattaacgaatacttagaaattatcaaaaaagatcttgaagctggtgcatctaaagattatgcagcaagtcgtggagaatttttgaacggattaattttagctaactatttaggatttgagttcgttgatgctaaggatgtaattgtatttaatgctgatggttcattagatgcaattgcaacagacgaagctttaagagaaaaactttcaaaagtttcaaacgctgtaattcctggtttctatggtgcagataaagatggtaacatcgttacattttcaagaggtggttcagatgtaactggtgctttagtttctgcaagtatagctgcagatctttatgaaaactggacagatgtttcaggatttttaatggcagatccaagaattatagataatccaaagccaataagtagaattacttattcggaacttagagaattatcttatatgggagcttcagttttacatgaagatgcaatattccctgtaagaaaaactggtattcctataaatattaaaaatacaaacaagcctcaggattctggaacatttatagtacaaaattctgactgctcagataatccaactataataactggtattgctggtaaaaaagactttactgttatttcaataacaaaagcatctatgaactcagaattaggattctgtagaaagcttttatcagtattagaacaaaataatatctcttttgagaacatgccatcaggaatagatactgtttgtcttgtaatttctgattcacaattaaagaataaaactcagcatgttgttgaagaaattaaaagaacttgtaatcctgatacaattgaagtacatccaggaatggcaatgattgcaacagttggacgtggtatggctaaacaaagaggaactgccgcaaaaatatttgctgcactttcacaagctgatgttaatatacgaatgattgaccaaggttcaagtgaaatgaatattttagttggaatagaaaatgataatttcgaaaaaggtattgctgctatatacaatgcttttaactaatggtgactgtcacctaccgaaaaatgtctaattaaaaggaactgttgcattaggaatttaaactacttatttagtatgtttaacccttttgtaacagctccttttttaattttctattaaattctccacatattttttataatgttcacttgcattgtcattttcaaaaaaagataatatcttttcacgatgtattatattatcttttcttttatccatataaacattataactactccataaataatctgccggattttctacaatttttgctctaactggattaaggtgaatgtatttacttaattcaatcatataggaactactatcaattattttagacagatatcgttcttgaaaaagatgtcccacataattatatttattattaaaatattttgcgtacaatccatttaatctctgcatgaatattccaatatgcctttccttcgtttcaatctgtaaatgtatatgatttgtcattaacacatagctaataatttcaaactcatttgaatacttatctagcgactctctaagaatattcatataatttacatagtctaagtcctctctaaaaatagtgtattttctattacctcttatagttatatgcatagttgaattcggacaccattttctacttgttctactcacattctttctcctatataagttttttctataattattgtcaacttatacagattttattctcgacatatttcggtaggtgacagtcacctaaaacaaatctggacgttccttatttttattaaatcttatatttggagtttctagctttatagattcttcttttgaataaaaaatatcattatatctaaaaaatgcttcattattactaaatgtaaaatcttctattatattataattaggtcttatatttaaggtcataattggttcattacttttattgaacgatatattttcatattcacctgtactagaattaaatttatatgaaattccaggtatttggaattcaatcacattgttatcattattaggaatatcatttatgccattcaaagtatatgacttaccatttaatatacatttattttgcaaatcaaatgaaaatttcatattatttattttaaactcatcagttattgagccaataaatttgtttgctatttccggcgatatttgattgtttaaccaattagtagaaaaattatcctgttgattccaaaattgattcatttgactctcattttttttagtttcattgaatttgtcataattaatcttcaaaaaataattatcgtcttttttctcgtctaaagtttcattgcctggcattattatatcacttaatttgcaatgaacatcttttagattattattagcatcaataagtccttcctgactatttgtatatccaccttgatatttccaattatctcgtataggtatatctcctaagttcaaagttataattttatatccctctgcttttaattgtcttgcaatattacctaattgattactatcgtctatactattcttaccaactattactatatacttgtctactgtgttttttctattttgatctattaattcagtaatattagaatctgatcttccctcagcattaatctgtcttactttattaagagcaggcactatactatacttacccatgacagatgtttgactgctagcataatttattaaattagtaatatattctccatatacaccttcattctctgtccgcctaaaatctagtgttccattataatatttaataccttcagcatctccattactatccccatatgttatgaatgaatatcttgcctttaatgcctttaatttgtcatcacttattattttgttaaaaatattattacctatattaaaatttttcatagcatcagaatctataacccaatatatatctttagcattaagttctccatatatatcctcataagaaaacgaatctgcatttattttatatttaatatcaatattattaccatcataatttacatctttaggagattgtagttccacttttatatctggaaatcttttgttaattattctaagtttatctattggtaattctttacttaatctattgttaagtatactatcataagaaacctgactatcatttccgaagttaacattccctgcattactattatttttaacttttaacttaatagtaaaatatacaggatctgcactatactttgttttatcataatttaaatggtaaattatattgggtaatgatttctcatagctagaaccaacatcaataatatttgaatcattactagataattcaaattgttctggtatattaaaatttagtttaacattttttatgtcataatcagataatatagaatctgctagttcatcaaatatactttccatagaatttgaatcatttgcactaaaataatctccattcatactattgtttacttcttttgctaaatctacggtactttcatttaatgcacatcctatagtcattacttttaattcaggaatactttgtttaagttttcgtcctatatttgttgcataatcagttgcctttttaatttttatctcattcaatctattatccccaaaatctacgtatcttgtattttgaacgttattaaaatcatatattggattaacatagaagctacttccattattaaaataaacaatatcattataataatcatcaatatatcgtgcaccataccaatattgccttgacaccaagtcaccatttctaaaagaaaacacattattagcccaataataagcactatcattaataataatgttagttttttctattgtaattgctgtagcttcaccatcagtaattagtatgacatatttttttgaatttccatctgtattaagaagcatttttccagcttctcttataccatctccttgatttgtcgcaccttctacttttatgttatctatatacttctcataactctttttattattatcatttatttctgtaagttgctttatattatttgcatatccagaataatatgaatatggaataattccaattctaatattatccttattattgaatttattaataaattgttttgcagattgttttaacgaatatatccttttatctctttcattatatggaatactatcattataaaagttaaaattcatacttcctgaagtatcaagaattaatactatatcttttttaacttcttcatttatatcttctatctgtaaatcttctgcgcttattttataggtaaattcaatttcatcaccagaacataaatttgaataatttttagtttcaacattattaacttttagtctatctaattttatacttatttgaggcttatcgtttgttccaattcttactattggtgtttctaagggaaattccctatttatctctgcatttcccaagctttctttatatgaaaatttacttaagtcttttccatcagaatcttttccaaaggttccacctgcacctattgctgtaacatcaaatgaaacaacaatattatcatatgtaggtttaaatccataagcatcttttatatacgttataaattctgatacatctatattaattttattatttcctactgtattaatattgacatatttcttttgtccattatattcaattaatgctctatcacctatttgaaaatttccacccaaatcaaatgttaatttagcattttctactttgtaagaattatctgatacattattcccaacactaccataaatagctgattgcaatgcaggtctccaaactgatgaatcagcatagtcagtatacttaggaataattttaaaatatatattcttgttcatagcaattttttctttatcatcttttgataaacttgtactatcactaggatgaatttctttaaataaataattttcatctcctgataaattactaattacagatttcaaattactttcactttccgaatctgttgaattgtcatcactgctacttacatctagaattataattctatatccactattctttattttgttcattgttgatgaatttatgttatttatttttccacttgatattataataatagccttattccggtttttttccgtattattatttgaatcttgaaatagcaaatcagctttttccaatgcattattaatatttctttcttttgaagacatattatttattgttccaataatattatttgctataccatctatattattactttgcctcatttgtacattattcatatctttgtctaaattctgattaatcaatgaatatgcatcatcagcaaaccctattacagttcccttaatgttcatacttatccctagatttttttcgctattattaacaaggtcattaatatttacaggtacattttgtgcaaattgccctcttcctctagtcccattatctttgtctttcatattgttagagacatccactaaaaatacagcttcatctatacctgttgtatattcttgtggttttacactatattttatatttgtagattcgccttcttttactgtaacatctgtattgctagaaagacttactttaatattactaccatctatactagacattgctgacactttctcattatctgtaaatatattacttaaaatacacatgcaaaaaatagagagagcaaataaactaaattttaactttacttttgaaaacatgctttcaccccccattttgaatttatcatatattcctaaaagtaacagtaaaatcaatagtatattctatagtttttccagatttatttttctctaaaataatgttaaatttcaatcctttcgaactagaaattttattattgttatcattcaaatttaatggctgaacatagaaatacttaacatcaacaactgtctttttagagcctatttttaatatttttgtattctcatcatatgatatattaacattttctaaattagtgatgttgttgtaactattaacaccactatttttagtcagcgattctaaacttaattttgatacttgaagccatttcttatctcgtgtttcttcacctgaaatgcttatgaatttatttgacataatttctccattataaggctcttcagtcacattatcactatctatttcacataatattatcttgcttgaattcatacatatttcacttatattttcttgaatatctttagcttccatttgaagagtggttttaatatctgattcagaaaataccttgtttcccgtcataaaaacagataatgcaattcccattattaaaactgtcatccccattacaatgatcatttcaattaaagtaaagcctgtttttttctcatttccacttcctcttcattcctatttattaattttccataaattattttttataaatattgttgaattagattctgtcgtaaaaccatcagaaccacttgattcctcactatatccataccccatattagggaagatttgattaaaaatagtcaagtttttattttgaatgttttttgtataatctttgttatattttaacgtaactttagcaccatctttaacagttaaatttccggaaacaatcaaatcaccttctatttcataatctgtacttattgtcaaatcaccatttacaaccattactcccttaaatttatttgaatttacagaagaatatattatataatcttcatttttatatttaaatccatctgtatccacatcatcatgattttcttttgttactattacattctgtattttttcaaatgtactatcattaatatcttcaacataatttttatcttttttattttctatatttaaattatacatattgattgcgtaatttttctttaaattatttatttttccattaacctgcgcatcaccttttatgtaatttgccttttgtacttgtgcttttaaaacaccatctactttttctccataaacgatatccccaattgacttcactttattattatcctttatgctattaaaaataacacctccataatccaatcctttatctaaattagaaatccaatatttatggaaatgatctatttttttattaatatcatctgtatctaatactttaagtggtgcatcatttttaaatttatcatcattctctaccggcatagaataagcatcataatttccttttacagcaacagattcacctgtttgatatccattttctgtctttatatttgccacaccattaatataagcttcattttctattgtcaaaaagctgtttctattatcatcacagttattaattattatgctgcttgatttttttgctttttcatcttttcctgaagcattatctattgtcttatcatttactccataaaaatttttcatattaacgactgtatttttagcattcatttctaaatcattatccaatacaacttttgagttatcatcattatttattcctatataggttccagtattttgtttgcttgtatttacataaatattttgagcatataaatctttattcatatttactattacattattttgaacattaaatgtttttctacaataaacattgttattaaaattaacagtactaagtgaatttgacattatatcaccattaataactattcctgaattatatttattttcaaatgttgatacatcacttccattactttcaaccaatatatctccataaacatctaaatcagctgcatttacactcaatgttccgccaactgtaagtccaggtatatcattggtaaatacactttttttaaaagctgcttcatcataattaggtactatcatagtatatacagattctatttctctttcattttctcctacattactctgttctttaaaattagatatcaaattaataggcaaagtaattttttcataataattaaaatttaaatcataggtttctttacgaattttatcttcataatcaaaataatattttgttactagattatctccagaaattacttttgagtctttttcactccattttaattgactgttttcatcaagactttcaagtttaaaacttattctagcattattgtagattacttcttgcaaattattttcgtcattactagtttttcttccatctagagcatattttcctttacctgagttttccccttccggacatatattactatatagatttgcattaatataatccttaaaataaatcctaaacacatagttaattagttgatctatctttttattatcttcttctattttacttttgttgctatcttcatttaattgcaagtaatctatatctgcatataatgcataaagacgtgctttattttttattttttcatcactattctcatctttaacatttaaaaattcagtataattcatatttttaacttcatctttaaaaatttctgttttattataactatactcattagcattatctatagtcttggcgattacattataagcaatatcaagtccactttccgctccatacaaattctttactcgcttactttcagtgactcttccagcatagttactactaaccatggacagcatagcacttgaaacaataataacaaacataaacataataaccacaaatattaaacttgaaccttttctttttcttttaattctcatacaatcatctccgttcatactatggtgtgtttacattttcaacaaaacctgtttcaaacaatttatcttcatttattcctttgctgttttttcctgagactgtaaccttcacattataaagcgtacctgattttccatcattatcacttctacgacattcagttaaaacacccagtttgttgtctatatctacattccaatctccatctgattttttaatgctatttagaatatatagatttaactgttttttagatgcattttcaacttcaaccactatactctctgcaattccataatatttaaaatctaatgcaacataattcatatctctaattgaaatttcgcttgaagtatcgttgtaaaattttatattccctgctgttccagaatcatttatatacactattatttttttgctttcattaattaaagaatcagttttaacatcactttctgtatatgataatctattttctcctacgaatattctatttttatattctccattgttaatggtgatgttttctccagtttcagtattcttataatttcttttaatctcagctaaataaaatgcttctgattcatttgttataatatttccatctttatcaaaataaatttttgtattatcagaacttctttgtccactttttacttcttcaacaatcttcttaccaataagagcagtttcctgttttatttcgccatcttttgtgtgccttataagcattaaatatgcattgtaaacaccaatagaaagaattccaattaaagccatgcttattattacttcaagaagtgtaaatcctttatgctttttggatatttttctcataataacacctactttttattaacgcttatcttactactgtctccatcaactgtcactcttggattaactgtatcatctccactaatatttatattaaaaagcttgtctgtattatttataaccttaatattaactccagatttatcatcagaatttactctcttttcactgaatacatccagagagatacttgaggatgattccggcgcaaactgtgctccttctccactataatcctttgggtatgttcctcttgaagttttatatttataatagtatttatcaccatgctgatttaattcaatttgaatactttctgctgaatttttgtctgcatatacataagttattctgccatcatcattagattttcccataacaactgttggtagatcagaatttattgaattcgcagagataacaaaatcacttgtatctgtttcacttttcactgctcctgtcgctgctcctggtgaaaatggaacttcttttccatatgtgttatttaatatccatttcaagtaattttcaagttcatcatctattcttggtacagcatatatttcaaggccaagtgtaccacttactccatctaatgatttttgagttatattaattgagtttacaacaattttcttttcattgttacctatcttatttaaaaaagtatcaagtgatttataagttccatcaaaatttactacacattttatatattgaattgtattttcttttttctcttctgcatttgcttcactattctgatttatattattttctgaagttttctcttctacatttgaatttttttctatattactatctttattttttctactatcttgactattttcttttccatttacactatcataattgtctacaaacttttgaagagaactttctttaatatcaactcgttcctttgtaacttcttcaacagttgatgatgctataggttcaaaagttataccacccttaagactactatcatttaataacttatctagttctaaaattatatgctcctggcttattgtaggataaaatttagctgtacagtctgatatttttgattttaatattttaatatcaccttttctatcttctaatgcattaatagttgccatggtctgattgtattcctcttctttttctgttttttcctgttttttaacttctactttattaatcataggagtataaacaaaattgtaataaccaattcctattaatataattcctaatataaatagcattattttttctctattgctaatattcataattaatcaacatcctttaacacacattttatatcaaaggagtattcccctctacagcacctgcgttttttattgagttcacataagtatcatccattatggtaagctgtttcaagttatgttctaattcagcaatacttgttctatttgatgctgttccctgaatagataatgtattatttacaaccactaaatttttaaatgtaatttcacttggtattgttgaatttattttatttaataattcatccgaaacattatttctgttttttatacttttagctacatcagataaggctgtatcatattgagtcagcacttcaatctgattgtttatactatttgcctctttaagttcagtttgtatttcagaatctcctaatttttctgtgaaattgcttatttccctgtttaaaagaaataacttagcactattaaatattaacgtacttaaaatgacaaatcccactaatccagctgcaccatatatatacatattagtattagtcttttcttttttctttccctgatagggtgcaaaaaaattcaaatctttcatttttatcagctcccctctaaagtcttataacacttccaataacatttataaaatcatcaataggttcaccatcatcattagatttaaatgtcattttggatacttctttaattcttcttgtctgtattccaattttctcactcatatatttatcaaaaccttttaactttgagcatccaccaaaaattattattttctctaaatttgtattcatatttttatttctgtaaaattggattatcttttctattttatcaatccattcatctgcaatttcccttgctgaatcattttcctgactatttaaatttaataaatcaattccattaattttaaaattttcgcactcttcaaaatttctatgatatagattatataaataatcattaatatcatttccaccggcttttattattcttgtaaagtcgagctttttatctttgtatatattaacagtaataaagcttgcccccatatcaataaaagcaactgcatcattactgttgtattctaattcattttctatataattcactaatttatttactgcattataatttacatctaaagtatagggttctaattctaattttttcaaaaggttataatatccctttgctattttatccggaaacgctataactcgtacatttagtttatctgatccattcatatctttttcttcatttaagactgttacctgaataacatagtcatctaaatttataggtaaatactgttgtatttcatatcttactacagtatccatttcttcttcttcaaccttaggtattaatatttccctgttaataattaaagttgaatttgtagtacatattccatgtttagcttttatattgtttgattttaaaacttcacttattctaatagctaattcatcgtctttttttatttctccatcaataactgcatctttaggcgatggaattttaatgtatttatctattgttaattcatttttatagtatgttccttgaactatttttatagtactgcttcctaagtcaaaagctactacttttttctttttttctggaattactttattaaaatttatattttgtggtaagttaaattttaaatcttttaggtctgtattcaatatagattttaagttaatagattttttattttcttcttttttatctaataaaattcccataaaacctccattttatttacaattctatgccaacaatttatctgtattatattcaagcaataatatattttctatattattgcttgttcttaatattttattatttttgtctgcttccttatctgcttccttatctgctggatacatatattggtcaccaacttttacagtcacaccatttccaccatcttcatcatcataattaactgtccatgttccgttactaacacttttaacatttggtaagttaccaccatctatatatttagtatatacagaatcagttgctggattttcatctccattagcaacagctgttgctacagctgttgctattatctttgcattagcttgatccgctgcaacattagaatttttcttaactgctccaaacttaggaatagcaactgctgctaaaacagcaataatagcaataacaataataagttcaactaaagtaaaacctttcttctttttcattaattcatttttctttttaagtactaattggttcattataaacccctcctaatttttatattatttatgtcaatgcgctctgtatctcacattacgcattgcttttaaatttgagtataagtatcaaacataggtaacattacagaaataactataaatgcaataataagtcccataattactattaatattggttctaaaagtgcaactgaagtttgaattgttgtctctagttcttcatcataaaagtctgctgttttatttaaaatatcatctagagaacctgtttcttctccaacctttatcattgaatacaacatagctggaaacatattgctttctttcattgaagaatataaactgtcaccacgcattacactatcttttatctttatcatggcattttctacaatcttatttcctacaacttccgatactatttctaatgcctttattagcgataaaccacttgccatcaatattgataatgttcttgtaaatcttgatactattatcatttcatttaactttttaagtatgggaagctttaattttaatttacttgaaactaaaataccttgctcacttcttaaaaatatcctaagtcctaaaattgctataataagaacaaataacattacaatccaattgttctgtataccactactaagtccaagtaagaacttagtagaccatggaagctgtgttccactttcttcaaatatctgcataaatgttggcattacatatactaatataaatgtaactgcaacaactgatacaaatccaagaactattggataaatcattgcatttttcactttattatttattttattttctttttcataatgggtagccattctcagcattacagaatcaagacttccacttgcttcaccagatgctgtcaatgacactagcaaatctggaaatacatctgtatgctttctcattgcatctgataaaacctcacctgtttcaacatcttcattgactttaactatggcttctttaagttttttattttgaatctgatcggataatatttttaaacaagtcaaaatcggtacacctgcatcaagcattgtataaaactgtctacaaaatattgataaatccttaagttttactttttcattaaaagcaaactctatattcttactttcaactacttcttctactaaaagaggataatatccatttcctgaaatataatcaataacttcttcttttgaattagcttcataatttccattgattttttcaccatcagaattcattattctatatttgaatttcgccatactctcctcctcatttttattgatatttctatttcaacttaatattcatacttaaaaaattaatacaaagcatcatagttaaaattagacttttaattattgattgaatattctgaattattttttctaaacttctgaagttgttattgcttcaaactcttccatagtagtcacgccttgcaaaacaagttttttgcactctatttccaaagtattcattccattttcaatacctatatctcttaaaacatctgaagtcacttcactatctatagcttgtctatgttttcttgttaactccattatttcatatataccaattcttcctgtgtatcctgtttcctgacaatatccacatccacatcctttatataaaattaatttatcatttatatcttgtcctaaaactcttttttcataatcacttgcttcatatgatgttttgcagttactacatacctttctaacaagtctttgtgcaattatccctgcaactgatgttgatacaagataaggctttattcccatatctataagccttgctattgatgaaggtgcatcatttgtatgaagagtactcaatacaagatgccctgttattgctgctcttattgcaatttctgctgtttcttcatctctaatttccccaatcataacaatgtcaggatcctgtctaagtatactcctaagaccacttgcaaatgtcagtcctgctttttcatttacatttacttggtttattccattcatagtaaattcaaccggatcttcaactgtgattatatttaattcatttgaattcaattcacttagtattgaatataaagttgtggacttaccacttccagtaggtcctgtaacaagaattattccatgtggatttgaaattattctgttcaccttttttatgttttcttcatccataccaagatcttcttttcttattattccacttcctttattaagaattcttataactaccttttctccaaacactacaggaagaactgatattctaagatctacttctttatcatcgactcttatcattatcttcccatcctgtggaatcctcttttcagctatattaagtcctgccataatttttattctggtaactaaaggagcaagactttcaattcctaatttattgatagttcttagctttccatctattctatatcgtattcttatttcattctcaaatggttctatatgaatatctgatgctttaagctcaattgaatttttaaacatataatcaaccattcttacaacaggagcactatttacatcacttatcacatcaacattttcttttgccttttttaaagcttttgtgctttcttttgataattgaattgctgcattatcaacttgctgactactgtaatatattccaatatatttatttatatctgcttttctagaaataaacgattctatttcaaatcctgttgatatggcaacatcatctattgcaaatatgttcaaaggatctgcaagtgttactttgattctattattttcaaatccgaaaggtataagcgtatattttttacataaattttctggaattaaacttatagcttttctgttaaattctatcgtgttcaaatcaatctttttaattccagtctgttgttcaattgcctcaattatctcatcttcagtaattatcttgctatcaacaagaatttcaccaagctttttcccaagggatttttgagcttttaatgcttcttgtaactggaagcttgttattttgccagcatttacaagaatatttcctaatcttctcttctcaatcgccataataaagctatccttcccctctattattactaattaacttttatcataagtgaaaattatttaaagttattatttaaactagtaaattaaaataccaacttatcaatgcatttccatacaaaatagctattaatgttcctatagctataaacggcccaaacgctatcttatctttaatattttttaagtttaataaaatcacaattattccaactgctccacccagcataattgctaaaaatagtgctaaaataatttgtttgacacctaaaaatagcccacatactcctgctatttctatatctccttcacccatcccctttgtcaaatatactattgctcctattattgctgctcctgttactccgcccattaataaattcataacttcttgtccatatacaaacttattaatcagtataaatattactccaactattgctccaaacacagttgttaatgtgtaaacttcttgtgtattgtaatcaatcatactaattacaatcaataaagatattagaatacaaaattcaactgtatatatcataaaaccatatttcatatatattactaaatataaaatacaatttaatccctctatcataggataccttatagaaattttctccttacaatatctgcattttccttttaaaaacacataacttattataggaattaaatctacagggtgtagattatgaccgcagtttccacaatgagatggtggatacgaaattgattcttctcttggaattctataaatacaaacatttaaaaaacttcctataaccaatcctaatattattactaatatataatccaagtttataaatcctcctatatctacataaatctcataataatctattttttcctcttattttttataaaaaaaccaacaaattaatactaattaatttgctggcgggttgcaccactaactcctagttcccaaggtgcccagattgagagaactattcttcgtttccaactacatgataatctattttattttcacttatatataatctaacacaatgtaattatataccatttttttctatttccatatatataatatcatttttaacttaatataacaataatattttcttacatttatcatgttaataacatatattttaccttttttctaatattacacaataaattcttaaatttcatgaattctataataataaacttttattatagaagatgtgaaattcctatattcttatcagtgttttagtattgtaataatacctactattacaactccaagttttacaatttcaaaaaccaaacctccaagagctttcgtcaattcaaaaatttcagcaaccatctataacatcattttttgttttcttatgttaatattttatcatataatggaatattattcatattgtaatatctttcaacaacaaaaaaccatcttctatctaatcaaagatagaaaatggtttctaaaatcaacatacatcaatccaaatacataaaattgaatatatatcataatcaatattagtctttcaaaatttttaacaactctgttaagcgttgatttatctaaactaacagccctattcttcccaaccttctgggaactcagcgttgtggtaaacttcttgaacatcatcatcatcatcaagtaaatctaacatcttttggaacttcttagcatcatcttcatttattgcagtgtatgtatctggaatcatcttaactgctgcttctaagaactctattccttctgcttctaatgcttcacgtacagtaccaaaatcctctggagctgtagtaactacaaatacttcttcttcatctgcattaaagtcttctgcacctgcatctaatgctaacatcatcatttcatcttcatcacggtcttctttttctataacaagttcacctttttcttggaacatgaaacctacacatccttgagttcccatgtttccgccacctttagtgaaagcacttcttacattaccagctgatctatttttattgtcagttaatgtttcaactattactgctactccattagggccatatccttcataaactatattttcaaagtttacagaacctaattctcctgatgctttctttattgatcttgttatagtatcattaggcatatttgctgcttttgcctttgctacaacatctctaagcttagcatttatatcaaggtttggtccgccattttttacagccatcattaattctttacctattttagtaaagacttttcctcttttagcatcagctttacctttcttcgcttgtatattatgccattttgaatgtcctgacatgttatttcctccttaatttaagcatctaaatttttattatttattaaatgactctttatataagtctttttgctttattttaaataaaattcatgaaaaattataccacattttatgttaattcacaattatccttacattttttacaatttacacattaaatctgtgcatataatctatttccttctttaaaataaattccttcttcactttttctaacgattactttaccgcttgtagcttcaacaatttctccttcaattgtatctgctatattttcctcacaaagtatatgaactataactttatctgtatactctgtatcttcaatatgccatgaattttgaccacatatatactgtatttttccaaaaagatcatattccatttcaaagctgatttttagtcctttaactttttctacaattccagctgcttttattgatatactagcaccttttgtgtaagctcttgtaagccctccagcacctaaaagtatcccccaaagtaccttgttacaactacagcacaatctgtaacattactcttcttcattacttcaagtataggtattccagctgtcccttgcggctctccatcatctgaatatctttgtatattcattttttctccaataacatatgcccagcagttatgtctcgcctgcttgtgaagactttttatttcattaacaaattcctttgcttcttcttcattttcaactcttttagcataacctataaattctgacttcttttcttcaaagctgtcttctcctctatctcttatagtaatataagccattaattcaactcccatcttttcagttgacaattgacaatgaataattggcaattatcgttgacatttctaaaaatatctattactaatactaatacattttcaaaactctccacaaaagatttatactcaactatcaattctcaattgccaaaatttcttctcttaataagtccattcctatttttatcttttcttcattaacttgataaaaagaaattttcagagaatcttgtccttcatttgatgctgtataaaaaacatttcctggtgttatatatatgttctttttctttaatcttctaaaaagtacctttgtatctatttctttattaataagagtcagataaaaattcaatcctcctcttggatccacatatgacacaatatctttaaaatcattatctaaaatgtcttttatcatattatatcttttgctgtattccatgttaagttccttaatattatttttccagcttccttttccaatatacatatcaagtgctctttgcatcaaacttgaagttgtaatatctgtgttgtgcttagaactttgaagaacctcattaaacacttctggtgcaacaagatatccaagccttattcccggaaggaatatttttgaaaaactctttatatagataaccctatcatacttatcaagccatttaaacggcatatactctaatgaactttcatatataagttctgataaataatcatcttctataatataaaaatcatatatttctgcaagatccaaaatacgttttttcttttctatactatagcttactccagtaggattctgaaaataactcatagtataaaaacaccttatttcatttttctgtagaatcttctcaaatgcctttaaatcaattccatcttcttttattggaacctcaaatatattaacttttctccatttaaatacagataaagctccaacatatgtaggtttttctacaataacattatcatttatgttaagaatacttttggatgcaatatcaattccttgctgtgcgcctgaaacaactattatatcatcatttttcaatttatttttccaaaatacttcatttattgtgtatattaaatttgaatacccacttctattttgagacattaaagccttcgcaccatctctttcaaggacttcattaataatttcttttaattcatctattggaaacagtacttctgcagaagtttcacctgtaaaatcgattatctcatcatttttttgtgaatctatattttttaaactattggaatactcttttctaaaagttgaaaatacttcttttcttttagcataacttccacttcctattttctgataagcatacccctcatttttaagcttattatatgcacttactacagtaacattattaactttcaacttttgagaaagcgctcttattgtaggaagtttatctccatctttaattttacgtttatcaattaaagacttaatgtattctgcaagctgaatatactttggtatttctttttcaaatttaaaatcatcatataattccataattacaccccaaattcaactatttactctgaacgttcaattaaataagttatttatactttctatatgcataaacattttcattaagaagtttttctcttgctggaagctcaatctttcttgagttcttctctataaatccattcttaaataattcttttaatatatcctctatctttatatcaaattgactaaatatttcatcactttttatttcatatgaacttaaatatgtcttcttttcctctaaataatttaaaagaaactttgcagcaatgcttatgttatcagctaaatagtcatcaatatattccacaatggaacttatatattcttgttttaattctttttctataagattttcaacaagcatattaaatttgttgtttaaattcattgtcattttaattgcatccctgcttactgtatacccactgatattcaaatataatttagcaaaactatctaatgctcttattaagacttcaaatgaagtaaataatctatcattatataaatatttcttggtaacacctaaatcttttatcagctttccaagataaacaagattccatatttcaacaaacttatccatactatactttgctttattgaacaatatatctatttcttcatctcgtgaaaaaacaagttttgatgatgtgagcatgtttcttatctcaccttttttcccattattctcatataactctaagaatttttccttattaagtatcttcatatgtacaggaatatctagtatttccgaatatacatctctcatgttataaaattgatctttataaacaacaaaaatgtcaatgtctgattcttcccaaagatccccattaacaatgcttccaaaagcaaaaaccgctaatactttcctgttagtctgaagtgaattaataagtttttctgatgctttctgataattaagtattgctttcaacatatttttattcaccttctttactcaaataattattatccctttatcgtaaaacacatacattatacaatattttctgagcatattacaaatataccccgggaaatattccggggtatattaaaataaactcaatatattatttttatatttaaactcttaataccataaactatacttaagatatgaaattttcatagttacgatactgaatttttattgtttaatcattaaattaattaactactgatatatgtcaaatacaacatctatttaatttaattttattttataatatactcttgtgttttattataaacttcatcatcaacttctacacacatgtatgttccattatctctataatcttcttcgaaaactcttccatttctatgtagaaatgattgaatatcacctttttcatatggaattaaatattcaacttttctataattatatggaagtttttcttcaataacttctaaaaattcttcaaggttagttccaaatgctgctgatacttcaattattttattatttccttctaatgcttcttttatcttatttatttgctcttgcgacgctttatctatcttgtttaaaactataatagtttctttatctattgctccaagttctgtaagaacttcatttactgcaatatattgttcaacagatgtatcacttgatgtatcaatcacatggcataaaagatccgaaaaaatcacttcttcaagtgtggatttaaaagcttctactaaatcatgaggaagttttcttacaaatccaactgtatctgttaatgttattacacccttgttctttaatgtaatagctcttgttgttgtatccaatgttgcaaaaagcatatctgcttcaaatactttttcttttgttttattttcctttttagctgcaagatcacataatgcatttctaagagtagacttacctgcatttgtatatcctacaagtgatactttaggaatattttccttatttctcttttctctttgaatttcccttgtctttttaatctttttaagttcagctcttaagtcatatatagtttccattatatgtcttctatctgtttcaagtttcttttctccaggtcctcttgtaccaatacctcctccagttcttgataatatagttccaagtccctgtaatctacttaatctatatttcaactgagcaagttcaacttgaatctttgcttcttttgtctttgctctagttgcaaagatttccaatatcaaagtagttctatcaataacctttgcacctattgcggcttccagatttctaacttgagatcctgataattcatcatcaaaaatcactacatttgctctttcaacctgtctcatggatgcaatttctagcaccttacctcttcctatataaaatgctgcatctattttgtttctactttgaaaaactgtatttaaaacaggtatgttgcaagcttctgtaagttcttttaattcttcaagactttctcttgtatcagaaccaaccaatattgctttttcttcattatcctctattacatcatttgtttttattaaattttctataaactttattttatctaatatatttacagacattatagcatctagtgacaaattactcttttcttcatactctaatttattattgtataaagtaagcattcccaaagaaaagtctactatgcttccatctataactgcaacagaaacgattgcatcaagttttaattttaaaagtgcagtaagatccagagctgaaaggttacaataaccatttggatgagtatgaattactcttactcctgcaagtcttttttcatctatgtttataactggaacttctactgatgttgaatctccaattgcaacagctgtaacatttccctttctgtttattgctacactaacttctctttcaattaagcttgaaatcctagaaattatatttaaaatttccaaattacatacttcatctttaagagtctttattgaatgaatactctctaattcatcaatcagagattttttaataccttctatatttccatctatcataaaatcacctcatataagctatcttgacaactttcatataattttatactattaattcattaattacaacttaaataaaatacactctttaaggttgtacatgtgttttttgtataatcttaaattaatttggtatttttagttgaaatttttccaacgatttttttatgtgaattttttgtcgcatatattactttcaaaataatatttattttttatttcttaaaatatatgcattttctacaaaatttttttcaactataaaatactatatttcaataaatatgtacaaaatataatatacatattttatttagtttaatctatgtttttgttgtaataataaatagatactttaagtataaaaatatatataattatattgtaaacataaaaataataaaataacaaatatttttaaaggagtttttaacaatatggaagataagaaacgtaatattcttttttctgaagatcaaatcagttctagaattaaagaattaggagaaattataaacagagaatataaaggaagaaatctttatgttttatcattattaagaggaagctttgtttatgctgctgacttagtaagagctattgacttaaatgtaaaagttggctttatgacaacatcaagttacggacacagtgaaacatcatcaggaactgttaaaatagttaatgatattcctgataatattgaaggatgggacgttcttattgtagatgatattgttgacactggtataactatggactttgtagtaaaccatgttaaaaatctaaaacctgcatcagttaaaacttgtgtacttcttgataaaccatctagaagaaaagtagaaataaaacctgattactgttgttttgaaattgaagatgtatttgtagttggatacggattaaactatggtgacttctatagaaacatcccttatgtatttaactgggaagcttaattcaattgacagttgacattggacaattgacaattcgtattaaaatttctaagaaattttttatattttaatataagttaaattaattcatacttaaataacttaatattattgattaatgttatttataatcaataatcaaaaatcccctattaaggggattttttgtttcacttgtcgcttgtcacttgtgaattgtcaattgttccaactcccaatgtcatgttaggaattttaccaacaattattgtatcacttactggaacctgtgttgttaccgtagtttcttgatcacttaatggtaattttaatcttatctgagccgtgatatttaaatagattttatgtcttgtctgatttatacctgcactttcaaaatttgattcatagcttgttgttatattacttataggttctatatgcatctttatattaggtcctaacttatagaaaacacttctgcttgtaacccaacctaatggtacatcaattgtattatccttcatgtcttcaagtgctgcattacattcattagacaattttgctgcaatgtaattcagctttacagtatcagcctgtataagatttatgtttccctcttcatctttttgaatttttatcatttcatcatatttaaaatcttcatttaatatctctaagctcttttcattaataatgtttaatgtctgtgttttcgccattatcttgcttatttctaccactgatggaaacactcttttatcaaaaaacactattaataaattaaaaataacaattatacttacgataactaaaataaacttaatatatctgtaatttttacgttttgtatagtactccatatgaacacctttatatcgagttaatgatttactcatactataaatatgctataatggtataaaatattattatatttacaaccttaaatttttaggaggataaaatggcagttaacaactcaacaaaaacaaaaagcactcctcatagcaaaaagaagccaaaacaaagcaataaaaaaaagatctttaagggaatttcttttggtattttattttgctttttagcactatttgttatggctgcaggttacgcttttgctattataaaaactacgccacctttagatgttgatgctgtgttatcgttaaatcagccttcaagcctttttgataataatggcgattttatggataatctacatacagatgaagaacgttatgttattgactctagcgaaatgcctgcaaatttgaagaatgcttttgtgtctattgaagatgaaagattttacaaacataaaggaatagatgttcaaagaatcgtcggagcagccttattggatgtaaagaaaatattaactggtcagaggggacttcacggtgcttctacacttacacaacagctacttaaaaatactattttaacaaatgatgtttccattgaaagaaaagtcaaggaaatttatttagctcttaatcttgaaaaaaaattgacaaaagatcaaattttaacagcatatttaaatacaataccactgggtggtcaagtttatggtgttgaagctgcatctcttttatatttcagtaaaaatacatctgacttatcattgattgaatgcgcttaccttgctggtataactcaagcacctacaacttatagtgcttataacgaaaataatataaaagatcctacaccatatattaatagaactgtaacagttttaacaatgatgaaaaagaataactacatcagtgaagaagaatgcaataaagcaatagaagaagtaaaaaacggaggacttgtatttaaaaagagtaagcaagattatacattgaattatgaatggtttgtatatcctgccgtttcacaagtaaaagaagatttaaagaaaaaatacaattatactgatgaagaagtttctaaactagtagtaaatggtggtcttaaaatctatacaacaatggatagaagcttacaagatttcacacagaaaacacttgataactacaataatttaggacttggaaattctgaaacttatgacagtaatggtgttcctttacttcaagcatcagctacaattgttgactacagaaaaggtcaagttcttgctatggttggtggaagaggtaaacaacagcctcaatctacaaacagagcatataatgctttaagacctataggatcaactacaaaaccattaactgtttatggtcctgctataaacgaaggtgtaattaccgctgcaacgcctattgatgatgcaccacttcctgaaaacaaactagacggtggtaaaaactataatccttcaaactctgattttagttatcaaggtcttatgacagcacgcgaagctttaacttattctaaaaatactgcagctgtaattgttgaagatatgcttggaactaaaacaggtattgaatatggagaaaaattaggattaaaatacaatgataaatcaaaaagttctattgccgcactagctttaggacaattcaacaatgatcctaaagatcctgatggaggtaacacttatagattagctggtgcatttggtacttttggtaatgaaggtgaatatgttagacctttactatacacaaaggttgtagatgcaactggaaaaacaattttagataatgaaaatttagataaaacagatgtattctcacgtgaaacagcatatattatgtacgatatgctcaaaggaccagtaacctattactcaagtacacctgctaaatggggggaaatgcctgtatcaggaaaaactggtactacatcagattcatgtgatttatggtttgctggacttactccttatctatcagggtcagtatggcttggatatgacaatccaacaaaacttataggtggatcaagtgcttgtgcaaaaatttggggaacattaatggaaaaagctcatgaaggtcgttctgtaaaagaattagaaccaccacctggaatagtaaaagtagctgtatgtaaagattcaggacttttacctagcgcagtatgttctcaagatccaagaggaagcagagtttacgaagaattatttgaagaaggaacagaaccaacaactacatgcgatacacacgtagttacaaatataaatagattgaataataagctggcaacacctggtaccccttctttcttaacacgaaaagctatatacattaaaaagaagcatccaaattcagccacagcagattattatatggttcttccatcaagttatgatacaactacttcagaaactgaagaacaatcaactgaaataggtgaaaataataattctaatgtaaaccatgaaaataccaatagtgataacactaataatcacaataataatcaaaacggacctgttgtagatcctactcaaacaccagtagattctccaggacctcaaacaaacactcatccaataattacaccaattcaataaagaaactctgggaatcttcccagagttttttatttagtatatagatatacgaactataataatgttacataattattaattcgtccttatattattcacaccagcctcttatatgaattttcataattaacttctttcaacttttgtattttttaataaataatatgtgatttttactggtttttaatatgaaaatttaattttatgaatttttatttatatctaacttgcatttttatattctttagtataaaataatatcagttacaattttcgtcattttatttcaaaaattttattattaactagggggttttaagcaatgttcaatacttttattgaaaaattaaatacaataatcaacgtatctaatgatatcctatggacttatgtattaatagcaccattaatattattaggtttatactttacttttaaaacaagatttgttcaatttagatatataaaagaaatgttcagacttcttactgatggtgctacagcaaaaaaagaaaaaggatcagtttcatcattccaggccttttgtattagtacagcatcaagagttggtactggtaatttagctggaatcgcaattgccatatctgttggtggacctggtgcaatcttctggatgtggttaatcgctcttattggttctgcttcaagtttcgtagaatctacattagcacagatatataaacaacctgatggaaatggtgcttatattggaggacctgcatactacatggagaaagctcttaacatgaaatggatgggaataattttctccatattaattacaatatgttttggtcttgtattcaattcagttcaatctaacactatttcacttgcacttaatgaagctttcggtgttaacagaattcttgttggtgctatacttacacttttaactttatcaataatatttggtggaatacatagaattgcaaaagtttctgaaataatagttcctattatggctagtgcttatatattagtagctctttttgttgtaataacaaacataagcgaacttcctgctatgtttgctttaatatttgaaaatgctttcggtgttaagcaagctgttggaggaggaatcggtggcgctcttctcataggaataaaaagaggattattctcaaatgaagccggaatgggtagtgctccaaatgctgctgctacagctaatgtatctcatccagttaaacaaggattaattcaaactttaggtgtatttactgatacaatagtaatttgtagttgtactgcctttattatacttctttcagatattgatttatcaggtggtcttactggtatccaattaactcaaaacgcattaagttctcaaataggaagctttggaagtattttcattgctatatgtgtattactttttgcattcagttcaattgtaggtaattattattatggtgaagcaaatatagaatttttaactaagaaaaaaatataccttactttatatagaatctgtgttgctataatggtattatttggtgcaacagtaagtatggatatcgtttggaatctagctgatgtattcatggcattaatggcaataacaaatctaatcgcaattgcacttcttggtaaaattgcatttaaagctcttgatgattatagagcacagaaaaaagccggaataaaagatcctgtattcaaagcatcttcaattcccgaattaaaaaatgttactgaatggaattaataaaagcgtggcctaaggccacgctttttaattaacagttaaaactttactttcaccattctcttttataacattatatatttcaccagaatcagcattaacaaatattttaattaacacttgtgattcatcggaatttttagcttttacactaactacataacatacttctaaatgattgttttgatttttttctgtttttgtatttcctgcatatactagctctgttgtttctaaaagttcatagggtatattattttctataaaataattatttgcaattgtctcagcttcttcttggcttatatttattttaggttccatacattttttcaacattgtagtattagaataaccatcaatataaccactatccctatcaatatttatttttatttcatcaaaatacaatcgatatccattttctttctttttatatacaaaagaataatacggcaaatcatcttcattttttgtatcttcataaattaaatcgtttccacagatttccataagatatctttctgctattatcctagcttgactctctgaaagcttaccagaactcattttcatatcttttttagcaaaaccaaccacattgttttccttatctaaatctataccataactctgagttactattgttttattaactaattcattttggctatttataaccttaagcctttcatattttaaatttgttaatttttctgtagtatctactgcattcatggaatataacttagacataaactgttttgatgcatttatttctttagatgattctccaaataatttataaaatgctactccaacaactataacaagaaaaatcaagataatactactgttgattataatccttttattcttcattaactcctcctctttaacgttagtacatttatattaattttttaattactattactatatgttaagcacattaaatatattatatcacaatatacttagtaaatactgtttatttttccctatgaaatattgtaatcctacatattaaatacaaattttctttgataatttcaaaaagatattgatttttctattcaaagtatatataatatcattgtttgtttagtaattttaaacttattgtttagtaaaagtgattattataaaaattgttagtgggtgaattttatgcaaataggagaaaagattcgtattctccgaatggaaaaacaactgactcaagaggagcttgcaaatagatgtgaattatctaagggatttatttctcaagttgaaaatgacttaacttcaccatctattgctacattaatagatattcttgaaatcttaggaactaatcttccagatttctttagtgatacaaaagaggaaaaagtaacatatacaaaagatgatatgtttgaaaaagatgatgacgatttaaagtactccttaatgtggcttataccaaatgctcaaaaaaatgaaatggagcctattatgattacactcaaacctggtggacaatatatcgaagaagagcctcacgaaggtgaagaattcggatatgttttagctggaacgataattcttcatttaggaaaaaagaaatataaagtcaaaaaaggggaaagcttttattataaagcaaaagtaaatcattttatcgaaaatactggtaaatctccagctaaggtaatatgggttagtactcccccatcattttaaacaatagaaagaggtgtttttgtgagccaaaacattatagaattaaaaaatatcagcaaaacttatggtgataatacagtattaaataatttatctttaaatattaaaaaaaatgaatttttaactcttttaggaccaagtggatgtggtaagactactacattaaaaataatagctggttttgagagcgctgattctggtgaattaatgtttaaaaatgaagatatttcatcattaccaccatataaaagacaggtaaatactgtgttccaaaaatatgctttatttccacatatgaacatttttgataatatagcattcggtttgaaattaaaaaaattacctaaagatcaaatcgaagctgaagtaaaaaaaatgctacatctcgttgccttagatggttttgaaaaaagaaaagtagagtctttaagcggagggcaacaacaaagagttgctattgcaagagctcttgtaaataaacctgaaatattacttcttgatgagcctttaggtgcacttgacttaaagcttagaaaagaaatgcagatagaattaaagaaaattcaaaaagaagttggtatcactttcgtatttgtaacacatgatcaagaagaagctcttacaatgtcagatacaattatagtaatgaataaaggtataattcaacagatgggaacacctgaagatatatataacgaacctgccaatgcttttgtggctgattttataggtgaaagtaacttacttaacggcttaatgataaaagactttgaagttgaattctgtaacaaaaaatttgaatgtgttgataaaggttttgaaatcaatgaacctgttgatattgttataagacctgaagacattaaaatggttaatgcagaaaatggcatgcttaaaggacatgttacttccgtagtatttaaaggtgtacattacgaaatgactgttgtaagtgatgattatgaatttatacttcacaacacaaaatctgctgacgtaggatctactatagggctagatatttatcctgaagacatacatattatgaaaaagagtgataaaaatggctaagaaaaaaacgtccttagcggcgtatccttattttgcttggagtgcgctatttatcgtaattccattattaatagttttattttttagctttacggtacaaactgattcaggctattctttttcattagaaaactatagcagacttatttcatcgcaatattttaatatatttttaagatcaatatggcttgcacttgtttcaacaatattatgccttattgttggttatccagttgcgtatataatttcacaaatgaaagtaagtagacgtaattttatgattatgctattcattcttccaatgtggatgaattttcttcttagaacttacgcatggatgcctattttaggtaaaacaggtatcgttaataatattttaagtaaagttggaattggtccaatttctttcttatacaatgatggtgctgtgcttcttggtatggtatataactttctgccttttatggtacttcctttatatactattttaataaaaatggatcaggatttaataaatgcagcagctgacttaggtgcaaatagatttaaaatatttttaaaagtaatcctaccattaagcattcctggaatcttttcaggtataacaatggtatttatgcctgctgtttctactttcgtaatttcaaggcttcttggtggcggtcaatttatgcttcttggtaaccttatagaacagcaatataccacaatgggggattggaattttggttccgctatttcaatctttatgatgataatcatacttatatttatggctttaacgtctaaatttgacagcggttcagataaagaaggaggtacacagctatggtaagcagattagaaaattttataaaaagattttatttgtttattatctttttattcttgtacactcctatcatcacccttatggttttttctttcaataattctaaaaccatgggaaaatggtctggattcactctaaaatggtatgaacagctttttagtaaccaaagattaatgtcagcactgtattacactatattaattgctttattagcatcagtaattgcaactattgttggaactataagtgctatagcaatttcgcaaatgaaaggtaaattaaaagctttaattttaaatataaactatcttccagtacttaatccagatatagttacaggaattgcacttatgagtttatttatattcctaaacttcaactttggttttacaactatgcttttagctcatattacatttgatattccttatgtaatattatcagttcttccaaagatgcgtcagcttcctgaaaatactttagatgctgctgccgatttaggtgctactccactttatacattatggaaggttattatccctcagataaagccaggaatcttttcaggattccttatggcattcactatgtctatagatgattttgtaattagtttctttactacaggtccaggagttactaatctttcaattgaaatttattctatggcaagacgtggtataaagcctgaaattaatgcactttcaactttaatgttcttaacagtacttgcattactgttgattgtgaatagaaaacaaaattcagataaaactaattaataataaataatagcccatttaaaactttaaatgggctataaataagtatttagaggtgataatattgataaaattgaaacgattgtgtgcattagcattaacatctttactaagtataactttatttaccgggtgcggaaattctaatgttggtgtaaatggaacaatctatttttataactgtggcgactatatagatgaagacttactatatgaattccaaagagaaactggaattaaagtagactattctacctatgatacaaatgaaataatgtatcaaaaattaaagagttctcctggaagttatgacttagtaattccatcagattatatgattgaaaagatgattcaagaaagtatggtagaaaaaattgattttaacaatattccaaactatgagtatattggtgatcaatataaaaaccttgcttatgatcctacaaatgaatattcagttccatatatgtggggaactatcggtattgtgtacaatcctgacattgtgacagaaccagttaacagctgggatatactttgggatacaaaatataacaataaacaattaataatgtttgattctatgagagatactcttgctataggattgaaaaaacttggttattctataaacagtacaaatcctgatgaaatagctgctgctacagatgagctaataaaacaaaagaagactatggaccctctttactatgtagatgaagtaaaagataaaatgataaacgaggaagctgctatagcacctgtatggtctggagatgcaacgtacataatctcacaaaatccaaaattaaaatttatagttcctgacgaaggctctaacaaatggtttgatgctatggttataccaaaaggttcaaaaaacaaagaaaatgctgaaaaacttatagatttcttatgtaaacctgaaaatgcacttcaaaatgtggaatatattcaattttctactcctaatactggagcttatgaactactagaagattctataaaggatgatcctggtgcatacccttctaaagaagtattagataaatgtgaagtttttgtagatttaggtgactcattaaaactttatgatgatgcttggatgaatataaaaactgcaagctaatttttaagatacaaaaaaattccgttaataaacattttaacggaattttatttttcttttttacttaatattagttcagtaattgatacctaaattatattcctaatcatcaacctctggaaaccacaaagcaatttcttcttttgcactttctggcgtatctgatgcgtgaacacaattttctgttttacttctagcatatctaaatctaattgttcctgcagatgcttcatcagggcttgttgctccattaatctgacgaattctctttactgcatcttccccttcaaggattattgctaccaatggacttcttgttataaatgttattagttcttcataaaagggtttccctttatgctgacaataatgcttttctgcaatttctcttgtagtctgcataagtttcaagtgtattaccttcaagccattatcttcataaacacttatgatattgcctataatattcctttcaactccatctggtttgattaataccatacttctctcaaccataatattgccctccatttacgctaatttcaccttttaatatttttccctatcatattaatattatacttaattttcagaaaattataaatacttatatatttatattctactattaatttattatgatataattctagtataatcaacaatctatacgaaactacatatattttgcctatatataataaacaatggaggaactatttatgataaggtattcgattttagtagatggaagagttcaaggtgttggcttcaggttcttcacacaactaactgctacaaatctaaatttaactggctggtgtaaaaatttatatgatggaaaagttcagatagaaattcaaggttcagaagatactttaaacaaatttatatctctacttaaaaagggaaataatttttcaagaattgatgaaattattgttgataaaattcctgttatagaaactgaaaaaaagtattctgttaaatattaaatctcaactccctagatctattgagtccacacctttaatcattattctataattatacttttctacataataaaaaagcagctctaaaaagaactgcttttcattaattctatgtgtatatatattaactttctaagctaaatttttttctgtattaatttccttttcttcttttaaagttgcaaaatactcttctgtttcctttattacaacttttctaagtcctataagacctacaaggttagggaatgccatacatccattaactatatctgctattataaatattaattctaatggtaggaatggccctattgctacaagaactatatatattattctatatggcataatagctttaactccaaatagatattgagtacatctttcaccataataattccatccaagaattgtagtaaatgcaaagaatactaatcctatatttactatatatttacctacagttcctattgagtttgcaaatgctgcagttgtaacctgtgctcctgcaagcgtagacccagctgtaaatatacctgtttctccacttgttattactattgcaagacctgtcattgtacaaattattattgtgtcaaagaaagtacctgtcatagatataagaccttgtcttactgctgaatttgtcttagctgcagccgctgctattggtgcacttccaagacctgattcatttgaaaatactcctctacctacacctctttgaatagccataccaacagtaattcctagaactccaccaccaactgcacttggattaaatgcacttgttataattaatgataatgctggtattattgatctataattgcatattaatacaactaccgcagcaagaatatatgcacctgccataaatggtacaacagtttctgaaacctttgaaattctctttattccacctaaagttaccattgcaactaatgctgtaactataactgctgtaactattaatggtacattaaatgttgctgctgctgctgcaattgaattaacttgaccaaatgtaccaattccaaagaatgcaactccaattccaaagagtgcgaataatttagcaagccatttcatacctaatccattttggatgtagtacattggtcctcctgccatctgaccattttcatctttttctctatactttattgcaagaactccttctgcatatttagttgccataccaaaaaatgctgcaagccacatccatagtaatgcaccaggtcctcctgctgttattgctgttgctactccaactatattacctgtaccaatagttgctgataatgctgtacataaagcaccaaaactagatacatctccatgagcttgatcatttgtcttttcctcatctttaccaaatacatattttaatgccaatggtaatttgaaaatttgtaataattttagacgaagtgtaaggtagatacctgttcctactaaaagtactagtaaaggcggcccccatataatatcgtcgattttttggaatatttcctgcaccatagtgcttcctgataataaatttgataataacataaaaaaaatccccctaatataatgatttcggaggagataagactttttcagttggtagttgaaattagataattgaaagttattttttagtatcttaagtttaaatactaatgatatattcaaatcctttaattttatcattgaatttgaaatatattttcagaaatcacatatgaatttcatattaaaccgtcaatcgtcaattctcaattgtcaactgcatttctgtcttttcccctgtccttttacctgagagtttcaattgtatacttattgtatacaaccttgctccttcggtgcttattaaataagtctctccagaggctcgtccaatggcggtcctaatacctgaaagatttccctcttcggtgtatcattttaatattaataatataaaatgatatctctcccaccatcttcatccgaacgttgtttatatatttattttatgtattagattatataaataattaatgttttttgcaacaaaatttaaaatttttagcatattatcaaattacttgttttctatatcgttttcaattattatcttttcttttatatttatgatgatttttgtttaactttactttttatgtcaaaaaaaacttctgtatattttaaaatatacagaagtttttactcccattctcatctctttaaaaataccattaagttgaaattacccttacaattattaaactaatctctcaatttcctttaatttactgtatacattcaatgttttatatttgagattgtatacacgtttacaatactctataaaattatactgatttaattcagaatacttatcttcaattttattttctaaataatttacatattcaataaaacttttatcaacttcccaaaagccatctatactgtcggataataagtatgatacttcacttaagctatattctctttgaaattttttattattatctagcacagaaatgtcattgtcatcatcaattatgattgatttataaaatttctcccctaaaaattcagcatcttttaataattcatttattatattatatgctgaaccggctaattcttcttttgtaaaaattctgtccatcactactccccattaccgaaattcatattttaagttattgaccaatttaattatataatattcaatttagaatttttgtcgaattgtatgtagcttccaatcagtatatatatccattaccgatatatttatgtatattttagaatacttttcaatatttaaaatttatttttattattatattataaatttctctaaaaagcatagaattttaacatattttgattgatttacatattttgctataatattaattatatacgtcaagatatattttaaagggggtgatattatatacaacatacttttagaaattcaaatagatatttttatgtgcatattactttttattatattagttcattcctttttcaaattaaattttaaatatgaatataacagaatcttttctttaagcggaataattttattgttcattttaattttagaaatattgagtattatatgcaataaaacatctgtaattaataatgtttttgttcataaaactattaattttattggcttttctcttactccattgctgctaatgctaatgcttttgtttattatctattggataaatcaagaaacacaaattaacattaaacaaactataattatttgcttgccatgtttaatacttataatactatcactattaagttataaattcggtctaatttttaacatagataatacctcatcctatagcagaggcatgctatttattctgtgtcctctaatatgcttattctatgttgtacttaatatattttttttatttagtaattacaaaaatatgtccaatgaagaattacttattttttcatttattgattttgttccttatttaataggtttgttacaaatacgctttttttcttttttaacaatatggaatacttctacaattgcatatataactttatatatttttattttaaataatcaatctcggaaagatatactaacaggtcttggcaatagatcagaatacgaataccatattgctaaattaaaaaacaaaaaaaaattaaaattatcagtaatgaatatagaccttgatggattaaaatacataaatgacacttttggacatgctgaaggagatgctgcaatatctattttcgcatcatttttaaaaaagacttttagcagaaaagttgtctgcatccgttatggtggtgatgaatttattatatttattaaagataacgataaaaataacatcaaccattacataaaaaatatagatacgttgttaaaggcttacaatgaatctaatgcaaaaccttataatatacgttttagctatggaataggcatttttgatgaaaaaaatgaaagtatagatgaacttatgcaaagatgtgatcagtctatgtatgaacataaaaaatcaaatcacaatacaattaataatttatagatatatactaaaaaataatacaaagccaagatttaatttatatactaaatcttagctttgtattacataaatgatttttttataaactcatcttcatcaatgaaatctattttttgccccattaattttagatctaccgcttttctcatcttagtactcatttcatttctttttaactcatgtatatccttaatattagaaactaatatggtagtttttttagttacagagctcccaattgcgccaccaagtcttcttacaagtcttatagcctcatctcgtgtcatagatgataatctacctgtaaatacaacagtatcacccttaaatacatcataatttggatttcctaatgaatttgaattattacatgtagatactctagacgattttctaaaaattcttccttttactgatgatggtttatatccttcttcattaacatttccaatagttactccaacacacctacatatttcatctatatcctcattcccaagctcttttgagatattaataaggatattactacatgcaagtgcatcagctaaagcatcatgatgatcaaattcatatcctaagaatttatttacagtatttaatttagaattttctatttgaggataaaaattctttgaaagcttcattgtacatatatacttaaaagatactggttctatattatataattccatagttcttcttaatacagatatatcaaatgatgcattatgtgcaattacaaatccattatcaaagtatcctttaatccttttccatatttcatcaaattctggttcattttctaccattccaggtcgtataccgtgtatccctatatttataggcataaatctcatttctttaggttttattagataatgtatcttttcaacaactttactatttttgacaactacaatacctatagaacaagggctgctccttttttcatttgcagtttcaaaatctatagctatataatccatatattttctcccgatctgttttatccttgatttcatcttttactatcaattctcacttgtccattttcaacactttaactctgttgaattcaatatattaaatcattacaatttcatatacataaataaaatcagactatgcacaatagtttacctaattatgcacagtctgataataaaagctatttttgttaatattttcacattattaacaaaattaatttttaaaatatgctactaattcagccattgattggttgaattcttccatagatgagtttttaaatactcttaattcaggaataccaactggtttttcaaagttacatcctgatatgtattcatcccagttttctaacttccatgtatctctatctgagttacgttcaatcattctttgatgacaaacttctttgtctgtttcaacccagataataactaattcacagtcgttttctttaagcttacttctaaatttatccatatattcaagatttcttatttctcttgtaaatggagcattaatcaatactgtatcacagtaatctaaagcttctaatgctaagtcaattacaacttcatattcagtatttctgatgttttcttcaaagaaatctgaacttctattgttttcttctcctgcaactttgaatacttgattagataaccctattagcgtatctttatctaagtaaacaataggtttaagagcttttgatatctctttagaaataaatgtttttccacatgctggtggtgatgttactaatattaatcttctcatatttctgcacactctccgtccaatattaatattgtttggttaaaaattaaaaatatagtagaacctatttattagctaatagattctacttattttttgattaataaattatgttatatttactacttaagaaatagaaatatacctgagtcaatattcattgtcccacttgttgtattatatcattttttgtcataatgtaaatagttttttatctatttagtaatttatctattattttttgtaccatcttaacaaatttattagtttgaatagtttttattgtatatccttttattaaatttatgtaaaatacataatatcatgatataatatattccatcattgaatacaaggggtgattgttattactattgaacaaattcaatattttctagctgtaaaaaaatacaatggattttctcctgcagctcatgagttatgtatatcacagtcttcgttatcaaaacagataaaatctcttgaaactgaactagacactatattgtttgatagaacctcaagaattacaaaactcacttgtgctggtgaagatttttatgtatacgcattaaaatttttagatgattacaataaaattgttcaaggaatgaaaaagcattctatttcaaataaaacaacattaaacataggaacaatagcagttatatcacaatacggtttagcatctatcctagcttctttcaaaagtaaatatcctaacatagatataaatatttttgaagaagaaaatgaagctgttttaagcatgcttaagaattctgaaattgatcttgctattgtaagagattttaatttagaaaaaaaattattcaatataacacatatagctgatgatgaattagttgttgtaacttctaatgatcatccatttacaaagaaaaaatatatttcttttggagatttaaaacacgaagatcttataatttgttctaaatctggtgtttatgatatatgtctagatgaatgttctaaattaggttttactccaaatgttatatacaacataaataagattgaaaccatattaggtcttgtttcagaagggcttggtataactttaattgtaaataatgttttaaagccctttagcagtcataatatagctgttcatcctctgaaagatcctataaattcaaatctggcacttgtttctaatatcaataccagtaaaagtaaagaaattaacgcattcagagaatttttacttaaaaattcccaaaaataaagctgagtatatctctaaacgctttctgttatataagaaaaatttagatgatatactcaaatttaaaattactctttattatttatactcataatttcttcatacaaaccatatgatgcttgtatgttatataaatatacaaggaaaacatctaaaatatatggagaatagcttatttttaataattcctttgcaaatgccattcctgctatttctcccaggcagactatattagagtcattttttataggacctatcttccataatctaattttttcagttcttgtaaatatgtcatcatcattttcctcaatgaaatgaaatatttcatgtgctaataataactcttcaatatttatatctgaaaacaatcctgctaactttttgcttgttattaactcctctgccttgttaatactatccttaaatactgtaactttattaggttcaacaaactgtgcaaatattatgtgtcctccaccattaggtctatctggataatctacctcaagacccatttctttagctatatcatatgtattcatatgactatattgttctcttattttctgagcatactttttaccacattcatttgctttattaattaaaattaatttatcatcctcactaaattttccttttagtggttcacgtctaaaagcataatatccccacttttcatcatcaatcatgactaaattttttagcatttcttctatctctggaatatctgtatcagttgttctagcatctatactcttacttctcattgcatttacaaatttatttgcaaaattatcattagatttcattttttgctcctataattaaaatttcttcttttgggtctgccatttgtacacttacatccataatcataagcatttgttcaaaatcacttcctgatgcaaaatccataactcttggtcctatacacagataaaaatctggtcttaaaacactatctgatttatacactgtaagttcttcccaaagactctttactgaatctttataactctctacttttactttacatgcagatcctgaatttctctgaacttttataaacccttttttatcaacaatccttatttgattcttatttttatattctccaccaaaaacataaaaatatttattcttctctataagagaaacttcttctttagaaatacccatatcctcacttgctagttcttttgcttcaaattcactacattcttttaataaatctgtagatttaacttctgtagaacctgttgctattgcaataagtctagatgtattagaatcaatttcaatatgcacatcaattgtatctggcgaagcaccactttctattgctttatttattacttccgcccttatatttcttatgtcttgttgagttggacttggaactactctttctacaacatctctaaccatggcaagtgctacaccaatagatgaaattacttctgcattatcaggtatgctatattttatgtccattttagaagcgcaatacttaataagagatgaagcaccacctccaacacctataagtgatatctgactattatcaagcttatatttatctattagttctaatataactggctgtatcttctcaaaagattttctaagtatcagttcggccacttcttcaactgtttttccaagatagtctgctaatggtttcattgccttccttgctgattctacatttccatatgaaaaatcctctgaagtaatcaaaccaagtacattagctgcacaactatttgtaattgtaattctctttccgctctttaatcttattgcaacataatctacaggatctccatctttaggtgcaaaaagttctaatgtaggttcaattatttcttcttcatgggtaaatactgcataatccattcctgcaatatgagcacttcttggacctacatcaattattttttctgaatccgcacgtatcatgcttcctccagcaacacctaaaacctgaacatctaaagaacttacataggttttatgtccatccactatagaataatctattgcaggtcttccattcttaattacacctatattggttgatgtacctccaacttcaaaataaatcccattagatactcttagatacattagggatcccataacacttgcagctggacctgaaagcatagtaagtattggtctttttttcatttcactaatatccattgcaccaccatcaccacgcattatcataagaggtacatccactcctgtactacggactgatttttcagtactatttgatgtatcaagcattttaggaagtatactggcatttattgctgctgtttttgttcttcttgtaagtccatataactttgtaatatctgatgcaatagttataggcatacccatttcttctgcaacctttgcaactctaacttcttctgtcatatcatcaacaccaaatgccattgataccacaagaacttctactcctaaacctttaagttcatttattttatcaattatattttcttttgttaaatttttcttcttaattatagtatttgatatttttattgttcttccggtccccaaatttatatctttaagtgcaacctgtttttttgctagatatccttcaatacctcttcctacaattcctattactccaacatgagctacatcaccttcaagtaatgcattggtagcctgagtagtgctatgtgctacaaacaccacatctttcgcatctatattattttcttctaaacaatttttaaaagcctttaccactcccgctgcaactccaaatttatcatcatgtgttgttttaactgatgattttcctataatcttatgtgtatcattatcaattgctacagcttttgtgtgagtgcctccaacatctattccaaccctgacattattattttttttcatataataaatacctcttcttatcatataatgctaaatgtatactccccaataatgaacctattatacttttataaaaacttatgacattattaacaactattatttcttttttattaatattgattttatcataattaaagccaaaagttttattttatgacctgaaaacaaagaaatccgccctacaaatatgtaaagcggaactttatttaaactacataccaaacattatgtaagtaatcaagcttaatatagcgcagattaaccaacctgctggtatacttaattttaagaaatcttttgtatcaaccttagtatatccaagtccccaaacaatccaagattgtgttatacagcttgaaatgttcattgttactgttggagcatacattaatgggaataataatggagttccgaatccaacactctttaatataccaagtgtggcagctccgcatcctgctaatgtaaatggtcctctaaacatacctaatggtgcaagtattgcaaacgcaacacaaattactaatgtattgtttggaattaatccacctaatacagcattaaagtaaggtacacataattctgccgctttattaaacataggaatcattaacataaatccaactaatggagcagtatctatagcaccatcatagaacgtcttattaaatacttctgaagctgccttatatgatgttaattttccacaaacagctaaagcaaagaagcttgctaccaagaatccaactataactggtacattaaatccaatagctaatacaactggtataaatggtgtaagtaaagctattactggagctgcttttacttcttcagtctgaggagcttgtgctgcccatgcatgaactcttttttgctttttcattaatattgctggtattaatattgcaactatcaattgaacagctaaagcagcaaatccccattttaagtatccaccattatagaaataagtctgttctccatttgcacctaaatagaatgcttgatattgattaaatataacagggtttatgtataaaccagcacctattgataataaaaatgatactgtagctaataatttaggtatccctaaagataataatattggaagtacaattactccaatagcaacaactgcaccagcaccaaacatacttgagaatactgctgtagtaacaactgctaaaagtgtagatgtaactattggcttatctccgccaagttcaactgtcttacgaattattgtagcagcaattcctgtttctaacatgattctaccgaaccaagcaccaaatatgaagtttataagtactccaccccatccttcaggaccaccttggaatactttcttaagagcatctacaatactcatattaacaatgtcactattttgtgctataaagtctggatttgtaactaaagcattacctataaggggtaatacagtccatataatagccataattagtataccagtcataagatttccacctttaactgcataagcaactaatccagcgaatgatactaataataaaattccgataataaattcaacactcattctagttctccttaataaaattattcaatacttcgttaattaattaattaacaatcttatataaaattttaataataacatgctgatactaaatttaataaatataaatgagtaatatgcttgagcatcagcaatgttatatgactaaatattaattatatctttttctatattcttctaaaatctcatccattaccttaataacgtgagctgcactttctaagtctgctggagacttttcttttcctattaattcattaactattgtttgaatataaggttgagcaacatgttctggttcttgatagtctataacttcttcaataccatcaactataacctttataggaccatagaataaaccagtagtacttattctacccttatctcctactattaacatttcttcttcatcgtggtcagcaacgtaacaccatattccattacccattactccactttcagttttgaaaatagcatttactgtatcttctacatcatagtatccaccgtagttttcagccataccacttacattttcaatcttaccaaataaatattcaacgatatctaatacgtgagcaaccatatcaacgaactttccgccgccagctgcttctggttttaatctccaaggtaagttttctctatctaaatcgatatcttcaaccttcataaactgtcttaagtgaacaaagtttatttttcctagctttccactttcaattatttctttaatcttcatgtacttagccatacctcttctatagaacgctacatatataggtaagttaacttcttgtgacttcttaatcatttcttcacattcttcatatgtaagagccattggtttttctgtataaggaatctttccagcttctaaacacttcattgagtaatctttgtgaaacttcggtggtgttggaagatatactgcattgatttctggatcagcaagcatttcttctacagtcttataaacaactggaactccatgtcttttagcataatcacaagctctatcataatctaaatcaaaaactgcctttaattctgagttttcagatttatataaacctggaccacttttcttttcagttacaacaccgcatccaaccatgccccatacgactttatcaaactttttcattttatattctcctctaaatcatcattttcattaaaatcataaaaataatattataatgtcgatactttaaccttaataactatttttctaattaccatagattcgtctttcattattgcaggaatatgaacatcatgtggatagaatacagcatatgagccttcttccatttctagatgagtttctcttgcattttcattattcttatagaaaataagatcccttgtttctaaaagattttcatcaacttcattgtctcccatatctgggtaacatcctattaattcttttccttttgcaaggaattgaacatcaatataagtttcatgaacttctggacgtaaattacatctttcagttgtttctacatctaaaacctgcaatatcatattatctccatccaattcatatcttcctggaactgcattcactaaatcattttcttttagatactgaatagctttttgaatagcttttggataacttgatatattttcatttgattttatattaccaaagatcatcttaatccctccccttaatatctatttttttaattttaaaatttaatttgttattttttctacaaatttcagcaaatcaattcaaattcaaacttactacatatgatatattacaaagtttttaaatcttgttcaattcattttaagaatcaaactattccataatggaatagttattgtattttggttatattacctatacttatttgcttataaataatctcttttatattttttataacagtgattacttaacataaaaaatgcttatatataaaaattctcaaacttttatatataagcatttccttaatctataaactataaatatatttaataatacttattaaataaaaaaataatagctgcttacgattttttcttcataatacagctattatttcactactttatttggtaatttactaattttaatacacctctttgtttaatctataaattttacatcggaatcacctcttactatataaaatcataattgatataacaaatctaatcatcctcctttactttaactctattaattaatatattattgttcttaactttttcaattcctccttacattgattattaattatattaaaactaaatattgcattggtatcatcttcttttcttttactactttccttgattattaatatgttaaataaacttttaatcaactcctcacatttattaatcttttaattaaaatacattttgcatcggaatcatcttcttttctttataatataaattatttaataattatatttaatcagctttccaattcactccttacctttattgatcctttaattaaaatacattttgcaattggtatcatcttcttttcataatcttttacttaagttcctaaatgaattctatctcactccttacattttttaaatcttagctgatactaaactttgcattggtatcatccccttaagtattttaataaaataagaaatttttttattatgttgttttcttatcttgtttaaattatattaccatttcatagtaaattacagactgttattgaaattttatttatgttataataaaatagttggggtctatttcaaatcaatttatattattctaaaaagagatcgtatcaaaattaatttgttacaacctcttttcaatataaatatcatcatctactaaaactatatcggttgcatctactgcaatatcactacctgctccccccattgcaattccaacatctgcttttttcaaagctggagcatcattgattccatctccaatcatacatactttaaattcattctcttgatgtttattaatccaattaatccaatttaatttatcttctggaagacaatttgcatataactctttaatattaagcatattagaaattaatccagcagcactttcattatcaccagtcaataagacagtatgtacatgactattaaatgatttattaattatttttattttatttcaatatttttttatcgtttttcaataaatttttattgtattacatacaagcatgtgataatataatgctgtaaaataaatttaaatacgaggtaacaacatgaaaaaatatttattaaacttaattccatttattcttacagcactatgctttgttgcttataacttaataggctctgaagtccttcctgacggcacactatcagaaccatttttcctaattccaatatcatggttctttttcttaataggagtggcttggttaataataaatataattttgtcatttatacacaaaataaagaagaaaatttaataatctaaatatttcatattaattgagaaagaagagaaaagattcatgaataaaaattttagttcaaatttattaaataaaattattacaactggaataattttaacttttttagcactcctatctactccattaatattaacagccatatttaaaagtagattaggaattattaattctaatatcccaattagtatatctataggactatatatctgtgctattccttatattattgcattgttcattttaaagaaaatctctaagcaaatagcaattaaagatccatttaatataaaaatacctatacttttagaacaaatatcattttgtgcttttagtgaaattattttattcaacatcgtatgtattgttctatattatgtttttaatatatacttatatggaataactattatgtcatctgttgtgatttcctttgtttcattagctattggagtactaagtattgtattaagtcaactaatgaaaatagctattgaaataaaagatgaaaatgataaaactatttaaaaggagcttagtatgtctattatagtaaacttagatgtaatgatggccaaaagaaaaatgagttctacagaacttgcacaaaaactaggaattacaatggccaatctctcaatactaaaaaataacaaagcgaaagcaattagattttcaactttaaatgaaatatgtaagatattaaattgccaacctggtgatattttggaatatatcgaagattaaaaataataaattcattataaaagccaataaaataaactactcttcgtaaattagatatgagcagtttattttatcttttatatataccttaatgaatttatggttattcttatacatattttaatttatatattttaataaattagattttttttaatttcactttagaaatcatgagatatcccaaaataatcataagaactcctggtataatctttgtatatgtaattattaatgataataaagctaaaacacttccagaaatagttattggaatccctaaaaatactccttcaaattcacttatattatactttgcaagcctataacatccacatataatataaaacaacataatacatgtaccaattaaataattgtttaatccatatttaaaaaatatgagaatccctggtgcaactccaaatgaaacaaggtcagcaagtgaatctagttcctttcctatttcacttgaaacattaagcattctagcaattctaccatcatatctatccactaaagctgcaagaattatacataacgcagacataaaataattattatttatgacttcaactattgataatattccaaaggataaatttaaaaatgtaagtatattaggaatgtatttcttcaacattaatcctctcctcctgtgatttatattttttatttttagttgataatttaacttttttattctatctaaagaatatattttacccccagacaaactagctgttggggctcattaatttacttagcatttaaatttcacaatttatttcttcataatcttttcaaatctgaataaatcctctgatccaggtaaatcttcgtactctggtgcatgaggatcaggattatttttgttaaaatactccacaatcttaaaaccacatttatttacataaaaatgaatattccttttttcaaagtatggtgtacaagtttcccaaattttagtttcaggatactgtttttcaatagccttccaagctttataacctagtccatgactatgttcacttttatatataaagaaaagttctaatgaattatgttgtgtaagttcatttatattaatgacagcaccacctaccttttttccttctagaattatatggtaaataacagttccagcttcattaaaagactgttctatatctttatcagaagggattggctcattcagattagaaccaaactcttcaacaattgctacagcaaatgcttcttgtaaattttttttaaatttaggcagttcatcctttttcgcaatccttaatgtaacttcatttctttcattaatttttatcataaattttcctcctatactttaatatactaccaaaactctaatttcattgattatataattaatcaccaatttaacacagtcaaatttcttaacatttttcattagtaaattttttataattttatctttataaaatattcctattataaatccaataatagctataattaatacaattatagtaagaagataatttccagcatttatgtttgccccaacacttactgatgccattatccaaggcaatctgcttgctattaaaatcataaagaatttcataggtctcaacgttgtaagtccagctacatatatcataaaatcttttggaagtcctggcattataaaaattataaacaatataatttcaaattttctactttccataatataaagcatccactttaactttttctttctaagcagatttgctataaaatctccacctatcaatcttgtaaaataaaatgctatcccagatcctataataagacctattaagctatatatggttcctaatggtaatccataaacatatcctcctgctatctgaataacctcaccaggaataggtgcaactacagtctgaagaatttgaaagaatatcagcataaatactcccgaattccccatagataaaatgtatttattaaattcatcaagtgatacagtcattaaaagcagttttggcataaatgcacataataatgcagttaataaaatagcaatgaatactgctgaaattttcagtgtacgctctttattcaatattaataattcctttctttaaatatattttcaaattatatgattcaatctttttaaacacttatgtctgtaagatatagtctagatacaatatcttaagtttttcatatatcaaatcttaagaattcttaagtgctttataaaatatagataaaaaatacatgaggctatatactataaaaaaaggaggtaacaaattctatgagaaacattttgattgcagatgacaatgatgaaattagagaaatagttcgaatacttttagaaagtgaaggatttaatgtgtctgaagccataaatggtgaagatgctgtaaataaagtaaacgataatacagatttaattattcttgatataatgatgcctataaaatctggatttaaagcatgtatagaaattagggaaaaaacaagcgcacctattttatttcttactgcaaagtcacaggattctgataaatgtatggctttttctgctggaagcgatgattttctttcaaaaccattttcatatacagaattaatttcaagggtcaaagcattactcagaagatattatatatacaaaggaaaagaagctcctgaatcttcagactctatagatataaatggattaaaaataaataaaacttctaatgaagtttctatagataatgaagaaattatacttactgaaatagaatatagactacttttgttgatggcttcaaatagatctaaaatattttcagcacagaatttatatgaaagtgtgtggaatgaaccatatttttatacaaataacaataccgttatggttcatataagaaatttaagaagcaagctggagtgcgatcctcaaaatccaaaatatataaaaactgtatgggggaaaggatatagaattgagtaaaaaaatttttttaacaaaactggaaaggaaattaactgtatctataataatttcattaactatttctattttaatatcttttttaataaattttgctggtgaatatatgctagatacttattatgataaaagtaattttcttaataacaaaagtactcaagcattatctgactttaaatcatatatatcaaaaaataacatttcaattgacgatcatgaaaaaattgaaaaatgggtacgtaactataagtatgtagatatttatatatttgaaaataatactttagtatataactcaactaggtatgcttcatattctgactatgaaactttggtagaaaccacaaatatatcagattactttgatgatatatcattttatgatgcaaatggaaaagtttatatggactgctattttgaatataaatattattacattactctttttatatctgctactattggcttaatatgttttgtaattatcatgcttactttaataaataagaaaatttcgtatataggaacacttgaaaatgaaattaaaattttagaaggtggtgatttaaattataatataacaatagatggaaatgatgaattagcttttcttgctgaaagcattaatgaaatgagaaaatcatttatcgagcgactacaaaatgaaaatgaggcaaaatcagctaatagcgaactaattacagctatgtcccatgatttaagaactccacttactgcattacttggatatctagatattattgagtataagaaatataaaactgaagaaaatcttatgcaatacatacataatagccgtgaaaaggcttatcagataaaatcattatcagataaactttttgaatactttttagtttttagtcataaagaacacctagaacttgaaacttttaatgtaaatgaaatatttgagcagatatttcaagaagaattttttatgcttaatgctgaaaatttcacatttgattttattccatgcaaccatatatgttatttagatatgaatttaatttcaataagacgtgtatttgataatctattttccaatattttaaaatatgctgataaatctgaaccaatcaaaatacgttattatattgaaaataatattttaattatcacaataaaaaataaaataaataataatctaaaatctgtgagcagtactggaataggtctaaaaacttgtaccaaaattatagaaatgcataatggaaaattatctactcaaaaaatagataacttctttatagtgactattacactagatgtaaaataaaattaaatcttttattttagtagacttaatgctgtcttttaagtaatgattcacttaaaagacagcataatctattcttatctgtattctattcaacttaaaatcaaacatttttatatttttaaatccactaattttctcaccaattcttctgatacaaaatcataatccttttcatgtccctctggcccataactatagtttacatactgaccacatgttgtttcatcactgccccaatccttacaagatgaatgaacttgagatatctttgtataatgcattaaatcttctgcatttaatgcatttactccacttccagccaaaatttctattttatcaccataattttcttgtaagcttttaatcatatccctaccatacattgcctttggttgtaatccacttgtaagcaatcggtctattttcatatctattaatacttcaattgcttttattggatcatctacgcaatcaaatgctctatgaaaaactgcttctgcattatattttttaactaaatcaaccatttttttagttttttcaatattaattgttaaatcatcatttaaaaatccaaatgctaatccatctgctccattttctaataatgctctggcatcttccatcatttgttcaaattcaatatcattatagcaaaatcctgctcctcttggtctaaccatacatataacttttaaatcagtgtttttctttgttaatgttaaacttcctatacttggtgttaaaccacccaaatgtaatgcactatttagttcaatacgcttagcgccaccaatataagaattttttgcatcttcataacttccacagcatatttctatcattttttcttctcctttgattaatcatataaacttagtaaatatatttttgtatttgttataagcgtatattatttcaaaaataaatacaacttatctttaagttgtatttatcaattcttaattataaataacattaatggtctgtttaaataactttatctatacactttattctaaaaaatatactcaaatagtctaatatgttaaaataaaatctcttctcatatgattttcaaaaaaatctcattaattggtgttatactattatttcatctgttctaatcttttcttagactctaatctattagaccacatctcttcttcagatttatatcctcttctttttgcttgttccttagtatatttttctccatgtagtaaatctaatatgtgaagtgaatccttacctgaagcttccatagttcctctacaagaaccacaataagatataatatgttcagaattaaaatctcctgctctcctattatatactttttcatataattcaggattcgagctacaaaccattcctcctacaccacaacatctagtattccccttacttctttcaatttctgaatatttgtatccaagttcctcaattatccatcttacgctttcatgatgagatgacacatttctagttacacatgaatcatgaatattaaatataacatttgaatttagccctatatttttttgtctctctggtattcctatactatctttcattaaatcccagtaagaaataacttttttatccgttgtgctactataaacgttataacacgatggacatattgtaataattacatctgcatttgttatattaatctcttctactgcttttttatttctttccttaaattttacattttcaccaatcaacttagttaccttaccacaacattgtaacattgcacctacttcaccatccaaagaacttcttaaatgttctaatgtcttttctattagctctggactataagctggaattgtacatccaggaacaaataagtattttgtcttcttctctttagctaatatagttgtagagtattcatcactgcactccatctcttgagatttatcaaatggctttaatgaatcaattacattttcgtcattattatcttcgttgtattgttccttaatagctataaaattaggagctaactctaatgatttaggacatactaatgtacattggttacactcattacaagaaaatgcaatcattttgtccatattttcatatcctttatctaaatacttcttaaataaagttttaggacaatctgtatactcatttaacattatgcattctttcatacatttcttacatacgcattgtctacatctatctgcttctctagcagcttcttcttcagtatacccaagtgctacttcatcaaagttactgactctttcttctaccaatagttcttgcatatcttctctttccccagatacttcttcccagtttgtaggcatatctaatttagttttaaaagtccatgtatcttccaacgctctatcattaattaaatcttgtccttttaaaaatcttattactgactgcgcagctcttctaccagttgccattgcttgtataactataacagattctcctgaagcatccccagctataaatatttttttatttgttaaagattgaagcgttaatttattgcactcaaaagtagaatttcttctttgatctaattttccattggcaaaactaccctctacacattgtccaatggcaaatactattgtatcgacttcaacttcatatacatcattttcatcaaacctaggtgagaacatgccttcttcattaaacatagatatacacttctttagtataactttagatactctattatcttgtacttctatgcttttaattgctcgtgcatgattaaattttataccttctgaaatagcacctttaatttcatgatttgatgaagccattgaatcaaaaccatcctctaaacaaatagaatgtacttcctcaactctatgtattcttcttgaaactctacagcaatccatagcaacatctccgccaccaactaccaataccttcttacctgcttttttaacatctctagttaatgctgcctcttttaaaaattctgctgctgaaaatactccctctgcatcaaaatttttaatactttgatcaactctcccttggtgctttcctacagctacgactacagaatcaaattcatctaaaattttatctaaagttatatctttcccaacttcacaacctactttaaaaatcactccaagtttatctaaataacttatttccttttctaaaacatttcttggtaacctatattcaggaatacctactgccatcattccacctctaactggtagcttttcaaaaacagttacttgaacaccttcttttcttaaatctaaagctgcttgtaatcctgaaggaccagaaccaattactgcaacttttttatttaagctatcatttatacttaaatcccaattttcttctttatcaaaattatctgctgcatatctctttaatgaagcaatcgccattgggctttttccttcattccatttacattgtgtttcacaaggatgtgcacaaatccttcctaatgttcctggaatgaacaatttttctcttattacttttattgattcttcacctttgccatctttaattaattttatatactcttttacatctgtatgcattggacacgttgcaacacaagctgcttcctctgatcccatacaattatctattatattttttatattatctatcacattgccttttaacataaatatcacctattttattcatatatttctactttgtcttcttaaattgctttggatcaattgcaaatacaaatactcccagcactattacaaatccccatattgctaatgataatgttattttgctacccaaaattactgctgaaaaaattattgaccataaagatgcagtactatttaaagcagttcccatagcagctcctattaagtcaacagccttataccaagctaaatatgttatcgctccaagtattgcaattcctgcatatttaaatactaatcctgaagttataacctttcctgctacttcatatccacctattaatggaactactactaatgcataactaattaacgatgtaagatatctaacacataaaaattgctgtggtgtagcttgtatatgctcttcatttttaatcttcttcattgcaaatccaacgataacccctctaaagcccatccagctactgcaactaatgcaaataaaactcctttaaagaaagtttctggtacatccgctgatggattaaaccctaacataaacgaaccaaataaactaactgctatacctatcattgctcttattgataatttctcttttaaaataaaataagataaaatagctccaactcctggatatattaccgaaatacttgatgcatatggtgctccagcatacttaatagctaacaaatatgcactcattcctactggagctccaactattgccgcaactattgtaactaaacctttttttgtctttaataacttaaacgcacctaataattgttttgaaaatattaacgataatgcaatccaaaaaaatgcaaatccatcatgaaataatgcagtaactaatggtgataattcgaaatcactaaacataatactatttccaacttcacccataagaactccatcaagccccatgcaagacctactattactcctagtaaaatacctaataaaaatttgtttttcttaaaattcatcttttgttatcctcctaaaatatttttacatattttatataagcaattttcatgccaactttttaaaacgttaatttttctacaatcttttttaataatcttgttttattttttattttttgattttaaatcacttttattagcaataaaagtgtcatctttcttaacagtgtcattatttttgttatataatagtgaaaatctacttatctaatcttataattaaattctcacataataatgaccttaaagactgtacatagatgttttataaaaaactcatattaactaaactatataaattttaatacattaatttttgatttatatttaacaactacattggcatattattcaaaaaaattgtgctattatataaaatatatttattttattacatcaatttccttattaattttatatattttttgttttctttttcttcaaagagtattattataagtagtatattttatacatgggaggattaaatgagtaactcacaaaaatgtaaatataatttttctaatattataggagaaagtcctcaattaaaaaaggttatagcgcaagccaaagaaacggccagaagctcatcaacaataataatttatggtgaaagtggatgcggaaaagaattacttgctcaatctatacattgctatagtgatagatgtaatgaaccctttgttgcggtaaactgcggtgctttacctactaatttaatagaaagtgagctgtttggttatgaaagtggctcattcacaggtgcaaaaaaagaaggatctattggaaaatttgaattggctaataaaggaaccctttttcttgatgaaatagcagatatgtctttagatatgcaggttgttttgcttagagttttacaagaaaattatataactaaagttggtggaaaaaatcaaattgacattgatgttagagtcattgctgctacaaatagaaatttaaaagatgaagtaaaaaaaggaaacttcagagaagatttatattatagattaaatgtactaccattaacactacctccattaaaagatagattaggtgatattccactacttctagactactttttaaaaataaaaagtgaaaaacttaacaaaccaatccctactatttctaaaattctatttaaaaaaataatttcttattgttggccaggcaatataagggagcttgaaaactttattgaaaatcttgtagctttaaatggaagtagtagctatgaaattgactttgaagaatgtcattgtcttaaatatgataacctgggtaacctattggataattttttttcagaaaacgctacggattctaatgaaactgataatattgttactcctttaattgtccttgaacaaaaagagattgtcaaagcattaaaaattttcaagggaaatatttctcaagcatcatctaaattaggaataagtagaaatgcactttacaataagatgaaacgctacaacattacttataaagatagatgattattttcttattctctactccttattcaaagtgatagttttttatataccttactatataaaaaactatcacttattttatataataatattttataaatacaaaaatatcattagatctcactatttcaactttactataccaaaagaattcctctagttcattattccttttaatattattttaataacttgatctaatacctcattaacttttagattatttgatttcaacacttctttatccattagcttttcacttacctgatctatcattaatgctactattgataaatccatatctttttttacttctccactttttttagcttcatctaatactttacatattgcttctatcttgaactttttcagttcttttatttcgttccattcatcttcataatctagccttatttcatccataataataaatggcagcttatacttatgatatgtatatactatttgatgacatttatcacttacattcatgctattttttaatatctttattgtgctttctctatctgtatctaatacttctttaatataacatcttatcatatcatctttattttcaaaatatttatatattgtcttcttactaattttcaattctttgcaaatcaaatctaagttcatttttttaatcccatatatttgaatattttgagctactatcctcaatatttcatctctcataaaacttctccttattaacatattttttaacaattaatgcacctaataatccaactaaaaaagtaactataaatgaacatttttcacttttaacccagatagcggctattattgatgaccctaaaaaagaacctatatattgtaagctatttattataccatttccagttcccctatattcatcttctaatataaagttaccaagaaccggtatgattgtactaatagatatatatcctatcataaataacaatgttccaataaatattgaaataaaagaatccttatttaaataaaataaaactcctaatgctgataaaacaaaagctgatattaaaaaattaacactttctgaattatttaatcttcttacaactattctcattacaattatagcaactattactgttggcataaatatcttccacattccatcaatgcctgtaattttctctaggtattgcgggatagaaaaaaatattgcggtcattataaagttgttaattaatgctgcaatattcaatgctataaaacttttatctttacttaaaattcttattgcatctttaacttccattgtctcttcattataaatattttttgtatcttttaaaaataaaacaataacaaaccatgcaataaaaataattattgctgaatataaaaacatatctttaacggaaacaaacttatgaattaatggaccaaatgcaaaagataaagctgctgctacaccaataatcgtacttattatactcatggatttcattctttctttttgatcagttatcgtacttgatatccatgaataacctactgctataattgcaccacttccctgcattgctcttgcaaatattaaccaataaatattgttagcaaaatatgcaataaccaatccaattccaacctgtaataatcctattaccattacaattttatttccttttttatcactccaaattccataaggaatttgaaataaagcttgcatcaagccaaatacaccaagtgctattccagctaacattggtgtattatattttaatgtactactataggtacttaaaaaaggcataaccatagtcatggccatttgtcttatacctaatgcaacacctaaagttccaacaaatattgaattaaagcttttatagttatattttttaatcataattatccctcctaggaaactatattttgtttttaagttcccttaatgtatttaaaaaggaaacttattttattatttaagtttcctaactatatattatactacaacactttatattataatacaacataaaaatatatttataataaagtatacaagttttctatagattgtatttaattcccatattatgaggtgtagtttttaaacattttaacctatcttgaatactttgacttcagattatagttttaagtttatcccaaaaataaaatccccctttatagaaacagctttatcattttagctgctttatataaaggggcatatcaaaactaaaattattatttaatgtttttgcttttcatagtgaaagtgacttatgctattcaaaatccactttccaataaatatattatactcttgactttaaatattcatcaatagcagccgcagcttttttaccagctcccatagctaatataactgtagctgcacctgtaactgcatctccaccagcatatacgccttcttttgtagtaagaccagtttcttcttctgctacaatacatcttctcttattaatttctaatccttcagttgttgatgaaattaatgggtttggtgatgttccaagtgacattattacagtgtctacatccatcacaaattctgaacctggaatttcaacaggacttcttcttcctgatgcatctggttctccaagctccattcttacacatttcattcctttaacccatccattttcatctactaagatctctgttggattagttaatacatcaaagattactccttcttccttagcatgatgtacttcttctgctcttgctggaagttctgattcacctcttctataaacaatatgactttctgatccaagtcttaatgctgttcttgctgcatccatagcaacatttcctccacctactactgcaactttcttaccagatctaactggagtctcatatccttctactgctgctttcattaggtttactcttgttaaaaattcattagctgaaaatactccattggcattttctcctggtattcccatgaatcttggaagtcctgcacctgaacctatgaatactgcttcaaagccttcttcttcaaataattcttctatagtaattgttcttcctataataacatttgtttcaattttaacaccaagttttttaatattattaacttcgttagctactactttttctttaggaagtctgaattctggaattccatattctaaaactcctccagctttatgaagcgcctcaaatatagttacttcatatccttttttagctaaatctccagcacaagtaagtcctgcaggaccacttccaataactgcaactttaattccattcttaggttctgttgcacttaagtcaacattgtgtgctgctgcccaatctgctgtaaatctttcaagctttcctatagatattgaatcaccttttattccaagtacacatttgccttcacattgtttttcttgaggacaaacccttccacatacagctggaagtgaactatattttgaaatttcttttgctgcttcttcaaaattttcatccttaatatgtgcaacaaatccaggaatattaattgatactggacatccttccacacacttaggatttttacaattcaagcatcttgaagcttctttaacagcttcttcttcattgtatcccatacatacttcttcaaaattagtagctctaaccttagggttttgttctcttacaggtactcttatcattctctctttcatatccattactacttatcacctctgcaaccacagccaccatgactatgagtatttccttcttcaacttttaaagcagctctgccttcttcagtcttatacatagcttgtcttctcattgattcatcgtaatttactaaatgtccatcaaactctggtccatcaacacaagcaaacttaacttctcctccaacagtaactctacaagcaccacacatccctgtaccatcaaccattataggatttaaacttactgttgttggaatgtttaattccttagtcagcatagaagtaaatttcatcattatcattggtccaataataattgcgtgatcatatttcttaccttgattgttaactaattctttaagcttatctgatccagttcccttaaattcatatgatccatcatcagttgttacgtaaagatttcctgcaacattcttaagctcttcttcatatattaataaatctttgtttctgcttcctaaaataacatctacagctattccgtgttcatgcatccattttacttgtggataaactggtgctgcgccaactccacctgctacaaagatgaaattctttttcttcaattcttctatattctcatgtataaattcacttggtacgcctaatggtccaacaaagtcagctacataatctccttcattaaaatcagctaactgtttagttccttttcctacagtttgaaaaactatagttactgtccctttttctttatcataatctgctatagttaaaggaattctttcacccttctcatcattttttatgataataaattgtccaggttttgcagattttgctactcttggagcttctatatccattaagaatatattatttgtcagctcctttttgttaactattttatacatttacgttcctcctaatttaaccaagtaacttgattcagcttctgatttttcttaatctgaatcttatatataatttttattcttgcgagaatatactttatctataagtactatctaatacctctattattaattggaaattgaatatatattaagatataagatccttatctggtgttactaatatcttaacatgtttcttcttttcagggcctgttaatgcaccaaaaccttcttcaactatatcatctaaatgtattttctttgttacatatccttctgcttttattcttccatccttcatttgagccatagttgcttggaactcatgtctatatgccaatgttccaactatcttcttttctgtaaacactaatgcattaggattaaatgtaactcctttttcccatatacttgttataaccatagttccttcgaattttaagctatcgatacctgtatcaaaacctatttgagctcctgtagtctcaaatgctacatctactcctaatccatttgtaagctttttaacttcttctgctatattcacttcattaggatctaaaacaacatctgctcctgctctttttgcatactcttgtcttatagactttctttgtaatactattactaattttgctcctgctgctttcaagcactcaatagttgcaagtcctattggaccagatcctagtactaatgcagtatcacctgttctaaaattaccaactctaattgaatgtaaagcaactgccattggttcaactaaagcagcttgttcgtaagacatttcatctggtatcttatgtacgaattcttctgggaaaactgtatattcggcaagtcctccaccacttccacaaagtccatggaaacctaatgatgaacataaattatattttccttctaaacatgctggacattttccacatgcaactataggttcaacaattactctatctcctggcttgaagttagttacatcagatccaacttcaacgacatctcctgaaaattcatgacctagaactactggagctgttgtaccacttaatggatgaggttgtcccactggtataaatatagggccacctaaatattcatgtaaatctgatccacatattccacaccattttaccttaatctttacaccattaactgtaaccttaggttcttcaatttcctctactctaacatctttctttgcataccataatgctgctttcatattaaaactcctccttggataaattgttaattaattcacatatattattagcaatattcataccaagttatgaatagaatcatagtttttttattttattagggttaattccttgatataatcaggtttttatttattgtatatattattctcttacataaaaactattagactataaaataaaaatgtatcaaaacgatacattttttattctcattttgatacacatctacttcttttctcattttgatacatctatattgtatttttttatctttctatataacgttgctcttcctatacttaacaatttagctgttagctgaagatttccattacattttcttatagcatcccttattgcattctcttctaccaaatcaagaggcactatttttttaatttcctcttgatttaatgattcttgattcaaaacttgtaatgtatttttataatctaaattgtttatgtctatattcattatttcatcttcacttaagtaataatctcgttcaacaacattcttaagttctcttatatttccatgccaatcatgtttctttaattcatctatatatgattgttttgcttttataaatttatttctattttttatatttaacttttgtataaactcatttacgagcaagtctatatcttctttccttttcctaagtggaattgtctttatctccattacacttaatctataatataaatcttctctaaaattctgcttacttatttcatttttcaatattctattagtagctccaataacccttacatttaattgcttttcatatgttccaccaactcttataatctttccattatctaatactctaagaagcttactttgaatatctaaaggcaattctccaatttcgtctagaaatattgttcctccatctgctagttcaaatttacctgggtgtccttctttcaaggcacctgtaaaagctcctttttcatatccaaataattcactttcaacaagttcactaggtattgaagcacagtttactgcaacaaatggaccttttgcccgattgctgtaattatgtattgattgtgaaattaattctttacccgtaccactttctccttgaattaatatattacaatcactttttgcagcctttttagaaaaacctatcatgtttttcatttctagattattagttattatatctttaaattcatattgagctttatatcctgcaaatttatttacaagtttatgtacaacttccacctctgtaaaagttattaccataccactatttttctcatttttatttaatggaagtatatctataacacattttattatgtcattatttatagaaaaatcccactccaaattatgcaaaaacttgttttcactttcaatgatcttatgaaaatcaatgccacttaaaacctgattaatatccatattcattgcttcttctaacgatatatttagaatttttagtgcttgttcatttattctttttatcttcatctgttcattcataactatcatgccttctgatatagactcgaaagttatattaagtaatttatatgaagtggccaatttcatttgtttctgtattgattgagcagctgctgttactatacccaaagtatgagaatgagcattgtaatagttacctgacatatttatgcatccaattaaattatcatcttcatcatatattggtgctgcggagcatgtccaagaatgttgattttccccataatgctctgctccaatagtttgaactggcttgttaagatataaagctgttcctatagcattagttccaactactttttctgaccacagttcaccttttagaaaatttaattcttcaactttctccattatatctttatcacctattacatctattatgtatccctccttatcagctaaaaacaaggcaaatcctgacccacgaaccaaactataaatactttctataactggtctagcaaccgaaataagttcactatttttattaataagctcatctatattaggatatttaacattccctcttccgttatgaggatctactccatattttctacaccttatccatgaatctgcaatttctgatctaacctttgaatgaactttcccacaagaaataaattttttccatgcttcagtgataaattcgatataatctttcatctctacctctccattacttataaaatataatatcaacattatttttattagttgtacttaacgtatccccaaatctacaatatataactatcttaattatccaaactatgttgttctagaaactattttatcatgaaacaaccctttttacacatttgcctagtatatagaaagtattttaacaaaaataaacctacgaaaatccaataaaatgattttcgtaggttttgtggtggaggtgacgggtgtcgaacccgtgtccgaaagccgacgtcattatctttctccgagtgcagttcatgttttaagattcccccaagtgcacgcccatgaacaggcttacactctcggtagcttcattaatacccctctggctcaaagctttgccaggcttcgtgtcccacttcaatgacaccagtgatccgagccgtaggcaacccgggctgatgagtagcttatattaagctgctaatgcaaaattgtcttctgcgtttacatttagtgcatactttattaacgaggacacatgcttccctcgactcgcttaataaatctttcatgcccccgtcgaagccaaaacacccccaggtttataaaaaacttaaacgcatatttaattttcaaatatctatcttgcatttttgattatatattattaatcatactatgtcaaataacatattaataaagtatatacaatttttaactttttattcaaaggacaaatttatagtacttattttatttctatgcctatcattgtagaatcatctttaagttttccttcatctaaaattgtatcttctaaatattcatcaatatatttcttaaaatcatttaacgttactttttccatatatcttttaattatctcatcttcatcaaatataaaatccaatccatcgctaaacagaaataatctatcaccactttgaatctgtatttttttctctgaaaattcactatctgaaaacatacctaaaaacggtccttctgcaagtttcctctctgctttttttccttgtttttgaaacataaactggtttattcccgcacctacaatcttaaactctttctttaaaaaatttatactaaagcagcatactgctatataattttcttcatagtatttggctatttttctatttaaatttttaactatattaataggttcatattctgtaaatgtttcttccataaacattaactctaacgctgatatatttaatgctgcagatattcccttcccttttacatctattaaaattccaataaacaattcatcatttatcttatttaccctataaaaatcaccgcttattgtatatgcaggtacatatacacaaacattttcaaaaaactttccaccttgaaagtccctttgcagactatttctttgaaagtttgctgcccttataagatcttttctactttcacttgtatttctcacagtcataaggattgccgactttccttcatacatcatatatctgcaagttaactgtacacttgtctttttattattataaaagtttaattcacaatcatatttttcttttaattttttacttaatattatatttctaaatttcttatgaagaatctttgaatatctttcatcaaaatacttatatatattactattaattatctcctcatgctcttgatcaaataaacttaatgcttcattattagctacttctattctattatcaactataatcattaaagcatctggggaattatttaaaatatgaatatatctttctttatcatttttcataattttatctaaagtttttctttctgttatatcctcaagtctttcaataataaatttaatattattattttcatctaaaaccggagtatatgatgtattcataatcttattaagttcaggaatatatctctctagttttatctcttttttgtattttacaacttgagcaaaacagcaatctttacacggtttatccttatttaatagtttatagcaaactttcttttcaacttcatttgggctcttcttataaaaattatatccagcctcattacaaaaatatacagtatggtcaggtttaaataccttaataacatctgaaatcccatctaaaatacactgcacatctttaactgctattgatgaattatcaattttactcataactattgtcctttctcattttccaataacaagcatagagtttagccatacttatagaatattacagctaaactctacctaattaatttctattcctctatttcaaatacacgatcaagtcttgttaattgaaataactttttaacttctggtcctaatgattttaactttaggcttccatttttctcaacacactttttatatattgaaacaatagctccaagtcctgtactatcaataaaactacaactactaaaatcaaaaataaaattcacttttccttcatctatataattattaattttaattctaaaatcagcaacttcttcaacacaaaaatcttttggtattattatgtttaaattattatccactacttttcacctcatacaataaatttttctacaagtcccataagatgttctgacatatcacttgtttcttctgccgtagctgttaaattattagttacattggcttcttcttgtattgctaaagatacaccttcacagtttttactattattttcagtaatagttgcaatgtcatttataagtgaaataactttatctgaagatgcaacttcatcacttgtaatatcaagaatctctccaacatgtttagctatatcttctatagaatcaattatatctaaaaatgccttatctgtttctgataccacttctacaccattttcaacttctgaatttgctctttccattgcttttactgcattttcaatttgtttaaccatttcagaaaccagtcctgctatttccttagctttattatttgtttcctctgacagttcccttacctcttcggcaacaatactgaatccttttccatgttctccagctctagctgcctctattgctgcatttaatgctaataaattagtttgctctgcaattgcatttattgttgtcactattcctgagacttcaacagataattcatttacatgctttaatgcattaaaagtatcattactttcagtatttatactattcatagctcttactgtctcttcaacttttcctcttccaagatgtgctattttctttgaattaatagcgttactattagttgattgagctctattttgtgcaagttgcacaagactagataattgaactagtacttcagatacatctacaattgatatattttgatttttagattcttctgctacattagttactgtagcacttatctcttctgttgttgcacttatttcttcaagagaacttgctatttcttcagatgctgtatttaaatgttctgaagcacttctaacacttttaacaatttcatcctgatgttcaatcatcgtattaaatgacttttgaagttcccctatctcatctttacttccaactttggcttttactcttaaatctccatcccctgcaagtttcattaacttctgtaattctttaattggatttataataccccttgttgaatatatatatgaacaaaccattgctataataatagccaacaccaccaaaattaaagtatcatttctaatacttatagctgatgccatgtattcatcataatctgctgttactgcaacaatccaatttcctgctggttcaaatgccacatacttatatacattatcataagtatagaagccatctgccttttctccagccttcatcttttctactattgatttaaaatcactttctgtactttcacttacattttcttttaatattttactttcatctggatgagctactactaagccatttttatcaatcatatatccatagccattctcaccaatcttaacttttgaagcatatttagatatactatcaaactttatactaccaacaacagttcctacaacattaccattttcttttattgggcatgcaatgaatattgctggattcccagtaaatcttgatgttaaaacctcactcattgtagtgttaccagtacttattgcttttttcatataatctctatcacttaaatcaatgtctggttccttactttcactatcaattattactgtacctatagaatctgttactatcaatacttccatgaattcttcgttacttttttgcacatcacatatatatttaaatgcatcatctatatatgccgcattttcactttgagatatctttccaagctgtccatttaaactacaaatctccactgtactttttactgactgtattgcattatcaattaaagatgcagtatctgatgtctgttgtataagatgttccttagttgaactctgtaatgaagtagatgccatcttatatgatacagctcctaatatactcataggtaaagctataagtataaaaaaagcactcatcagctttacttttaaagaaattttcatctattagttcctccctattcaaaatttttttcataatgacaaactagagtctgtccataattttcagaaaaatattttacttaagtgactttttcattattaagcatccatctttaaattctgcttcatctgtataagcagatattatgaacaaccctcgtccactttccgataaaatatcatcttcatcaatttctttgtcagtttttaaagttaaattttccttaccagtatcttttactgaaatatttataaaatcatgttctaatttgcattctacaattattggtttatctttatcttgattattaccatgaataaatgcattagcaatagcttcagacattattagctttatttcaaaacattgtttttctaaatttaatgagtgtatgattccatccaatttttcactaatattatcaattccataaagaataacttcgtttgttgtttcattatacataataaactctcccttcataaatatttcatacatactatcattttaaaatatatctttaagaaaaaactttattatacataattattacattttaaattatttttttcaatatttgaacaaatttcttttgattttatacaaaaaagactgtactattaacaaaaaagctatacagaatctcaaaaaatgaattctgtatagctttttctatcattaaattttatttttgtaaatattcatcaatagcagcagcagcttttttacctgctcccatagctaatataactgtagctgcacctgtaactgcatctccaccagcatatacgccttcttttgtagtaagaccagtttcttcttctgctacaatacatcttctcttattaatttctaatccttcagttgttgatgaaattaatgggtttggtgatgttccaagtgacattattacagtgtctacatccatcacaaattctgaacctggaatttcaacagggcttcttcttcctgatgcatctggttctccaagctccattcttacacatttcattcctttaacccatccattttcatctactaaaatctctgttggattagttaatacatcaaagattactccttcttccttagcatgatgtacttcttctgctcttgctggaagttctgattcacctcttctataaacaatatgactttctgatccaagtcttaatgctgttcttgctgcatccatagcaacatttcctccacctactactgcaactttcttaccagatctaactggagtctcatatccttctactgctgctttcattaggtttactcttgttaaaaattcattagctgaaaatactccattggcattttctcctggtattcccatgaatcttggaagtcctgcacctgaacctatgaatactgcttcaaagccttcttcttcaaataattcttctatagtaattgttcttcctataataacatttgtttcaattttaacaccaagctttttaatgttattaacttcgttagctactactttttcctttggaagtctgaattctggaattccatattctaaaactcctccagctttatgtagcgcctcaaatatagttacttcatatccttttttagctaaatctccagcacaagtaagtcctgcagggccacttccaataactgcaactttaattcccttcttaggttctgttgcacttaagtcaacattatgtgctgctgcccagtctgctgtaaatctttcaagtttacctatagatacagattgaccttttattccaagtacacatttgccttcacattgtttttcttgtggacatactcttccacatactgctggaagtgcactatacttagcaatttccttagctgcaccttcaaaatcactgtcttttaactttgcaataaatgctggaatatctattgatactggacatccttttctacattgtgcatttttacaattcaagcatcttgaagcttctttaacagcttcttcttcattatatcctaaacaaacttcttcaaagtttgtagctcttacctttggatcctgttctcttacaggtactctaatcaatctttcattcatatccattacttatcacctctgcaaccacagccaccatgactatgagtatttccttcttcaacttttaaagtagctctgccttcttcagtcttgtacatagcttgccttctcattgattcatcgtaatttactaaatgtccatcaaactctggtccatcaacacatgcaaatttaacttctcctccaacagtcactctgcaggcaccacacatgcctgtaccatcaaccattataggatttaagcttactgttgttggaatttcaagttctttagttaatgcagacataaatttcatcattatcattggtcctattacaactgcatgatcatatttttttccctgatttttaactaaatctgttaagcaatcagtaactcttccattaaatccatatgatccatcatctgttgcaacatataaatttccacttacagcttttaagtcttcttcgtatataagtaaatccttagttctgcttcccaatataacatccacattaaccccgtgttgtttcatccattttacctgtggatatactggtgcagcaccaactccccctgctacaaataatatgtttttcttcttcaaatcttctaaatcttcatttacaaattcactaggctgtccaagtggaccaacaaaatcgcttacatattccccagcttcatattgcgctaattcttttgtacttttgcctactgtttgaaaaacaattgaaacagtccctttttcttcatcataatctgcaattgtcaatggaattctttcacctttttcatcatttttaataataatgaactgacctggctttgcagattttgctactcttggagcttcaatttccattaaaaatatatttccagttagctcctttttgcttattattttatacattctatagcacccctttgtataatgttaggttgtaaggtctttaaccttattatatagtttacactattatgtataaatttcaaattatttttttgaaaaagatgtatcttctataaaattttatgataaatttttttcatcattttaccaaaacaaaaatgcaggtacatacctgcattatattggaaatgatatttttatttgtgttgatatatgattatatttaaaaagcattttcccaccatttttaattacagatttatttatacctacaagtttatctcttaatccatcaataagactataatctcttagtgctccttcttctattattccactaccttcaaccttaataattatattatcaattgaaatatatgttgttgctaatattattcccttttcattaattaaatttgctaatgcttttccaacttctgaaattattctaagtaattcctctttatccacatttatattattcaaatatgtattttcttctattgctacatgtatacctttattcaaaattggttcaaatgcttctcttattatggaattttctaaattatctactattacaccacttgaaacagattcattcatatctacaattttatctatagcttcctttaaattttcccatctttgtagcaaaaacaagccatataaatatgatatctgtgctccataatcatgttttatttttctcaattcatcattttttatttccatctctttattaagttgatctaaaatataagatttatttataacctttactaaataattaattagtataatcattgcaatatatataaagaatgttaatatcatctttatatttttaacttttgatgattcacaataaaacaaaccaataaaagcatcacacgcaaaagttccacctataaataatcttgttattattttatcttctgatattgtttttataaaatctcttatcttatcctttttctgcatacataaatatataagaataagtattactatattctcaaggaagttgtatttaccaaatgtagctatactataccttgacaatatatattcatttatccctaaatttatatttgagtaaatgcacaataaataatatccaaaagaaaatgctattaatggatttaaagttttcttatcatacacacaaaatacaacaactaattgaaataaatgaaaaagtatcaattcaaaaaaatcattattaatgtataactgaatacattcacctattaatagtatactaaaaaaatatactattaatttaaacgtttttttcaaatatagaatttctgtacatttataaattaaaattgaaaaaaatattgtctttataaatgtactaaatatatataatataaaattatcatttatcattattaatcccctaattatacattattacatttagcaggtagcacaatcttaaaaatcgtcttaagttctgtactaataacttcaattgtcccattgctattttctataagctctttaacaatacttaatccatacccatgagaactatcactattttccttagtagtaaaaccatgttcaaatatctttctaatatttttttctactatcatcggaccattattttctatttctatccctgcttgcatgtttattttgtatattcttatatttattgttggatttttaatctcttctaatactcgtactgcattattcactatattggttattattctatatagttctaattcattcatttcaataagtgaaatatcaaatccattttcataattaacttctatgcctttattaatagcatttttagcaataatatttattaatgatgtttcatcattaatgcttttttcacatacagcatcttcattcccattaattatttcttttaaaattattcctacttgctctttatgacccaaagaatacattttctgcaaataccctattactcctgcatgtttatcttttatattttttaattctaaattttttgcttctaaacgtttattaacttgaaaaactttttttgatcttgtatataatataaaaaaataaaaagaagttattaatataaacatttgacctataagtaaagaaagatctataaaaaacggtccttcattgaaaaaattaccattactaatagccactataaattctattataaagctactggttattatagaattagtgtatttattttgattgaagtaattacatattttttttattctcaaactatatatagctgataaaaaaatatataaaataaagtaaatttttgtaataagcaaatttttatcgccttgataatcactaaaacttatacaaaaatttaatccatttacaatcataatcaccataatacagttaaatatataaaatatagaacaatttataattcgattttttttatcatggtcatatagataataaaccattatcattactataaaatgccaaaaaatatttagtatgcttaaagactctgttattttaactaaccagtaactaattacaaacataactatagccattatacaattattttttaattctcttattttagaggaacatgatactgtatattgaaataaaattgtctgtattatggttagtattacatctaggatttccggcataatattttccccctaagttgtctattatctcttaaattataattcttttcttgtaaattttcaacttttattccatataatagtatatagtagaatatattacaataacttctatagtcatggattaatatatttttctacattcttctttgaacttgttgtagtgaacattgaacaatgttaatatttaattgttcaataattgaactgaaatttattgaatagttaaatattttaatcttggaggtttttaaaatggaagatatgtcttattggaaagaagtttgggaaagaaagggacgtggtaaaacaaataatttagaagaactagatggatatgaagatactacagctaatgtaaaagaaattgctcaaaatattataaaagaacttgatataaaagaaactgataaagtacttgaagttgcatgtggtgcaggtggactagctcaatacataaactgtgctcagtacgtaggtattgattattctgaaactttagtacaacgtcatatagagttacttaataactctgtgttacacggtgaagcaaacgacttaatttttaaagacaaaagctttgataaggtattctgttttggtgcttttcattactttcctaatcttgaatatgcaactaaagctattaatgaattaaagagagttgctaaagaagcagtctttattggtgatcttcctatgaactctcatcgagatactcatctactttatacaaaggatttttttgatggttggaaaataactgatggattctataatccttgtcgatttaatgtttctttaaaattaaaataaatataattttcaagtcaaaagctgaaatcaatattgcattgatttcagctttatgtaataaaaattattttatagattttgcctatctattatttttcattgattcaggcattttttctactccaaaactacaaactgaagcttttgaagctgtcattgatgtttcagttgctttctttaataagttacttaatacttttttcatttccataactctcatctcccttatttttatcatatatctattatatatatttttttctttaaattcaatctttttattacatttatggtaatttttttattcttttatatatttttcattgttttctatcaaatctcatatttatatagataaaaattagtacaattcacttatatagcataaactttaatacttacacaaatttgcataaaaaatcgcaaaaacttatgtaaataataaatacataagtttttgtgatactcttattttattgataaaaaatattcttctaaaatctcaataaactttctcatattctcaggatatatatctccaatattagctattctaaaagtatttttagatgatactttaccaggatatattgtaaaccccttctcatataaataattatgaagactatcaaagttatatcctttaacttccggttctactatggatgtaagaagcattgatgatttttctttcggtacaagaagctttaaatccagtttttctaacccctcccaaagtatctcgcagcattttacatatctttcatatcttctttctatagtttctgcttttgtttctattattgcctgcttcaatgcatatagtacttgtaccggaggagtaaacctcatttgatagtttttctgaaaatattcgtactgattatacaaatttaaatataaatttcttggtttaatgatttttgtattaaccaataattctttttcagctattacaaaacttactccagccattccttgtatacacttatttgaacttgatgctaggtatttaatatttgaactcttcatatctattggtatgccagcaaatgaactcattccatcaactaacaaatcaatattatatttgctacataatcctccaactctatgtatatcattcaaaattcctgttgttgtctcatggtgaattactgcaatgtgacttattattttaatttcatcatctttatttttaatattatatcttccaacaattcctttatagtcatttaatttatttttaatagatgttttctttgtattatattctgatattatctgttccaattttataaaatcaattccatttacaggagaacctatgaattctataaaattcaaatcatatatttctgccatttcacatattcttttcccatatgctccattattaattattagtaatatatctttatctacaactgaacttatcatagcttcaacggcagcagttcctgaacccccaaataatacagttgtatactcatcatcatgtgcaactagattagtcaattcctttgatacaaattccataacttgtccaaattcttcttccctcgggcatatatcagggacaacctgagcatttttcactgtatctgtagtggttgctggtcctggatttaataatatattccttttcacaacactatacctcttctcttattttagtatgatttctaaaattactgtcttataaagttcataaaagcttctttattttcaattggagttttatttggcctacccaaatctttgcgtgcacctttcctcacttttatttctaataatgctggtcctttgcactcacgtattatttgagaatatcttttaagttcctcttttgttgaacatgaatacaccttaacatatccactagcttcggcaatcattggtatgttaatattcaatcctacagtatcttgcccacctactgagtcatgggcaccattattaaataaaatatgtttaaagttttcagttttcttattacctataacaggtattcctcccaaatgcatcaacatagcaccatcaccatcaaaacaataaatctccctacttttttcagtcatagcaatacctaatgcaatttgtgatgcatgtcccatcgatccaactgttaagaaatctctattatgctcctgctttttcttatctcttaattcaaatagttctctagatatcattcctgtagttgatacaataacagaactatcattaatactatcgagtattgtttcaattgcctcttcacggctcatttcaaaatcattatatatactatttttcaattcatattctttaaaagcatttttctttactacaactgcataaggttcatttgtttctctcatatagtcacatgccttatcaataatttcttcagcttgattattttctgtgaattcatcaataacagaatactttatatttagtaactctaaagtttctagtgtaatcattccttgttttttatgctgtggctcatctttttttccaggttctcctctccatcctacaagaagaaataccggtatattatatacgagcttgtcatcaagagatgcaataggattaactatgttcccaagaccagaattctgcatataaacaagacctattttttttgaagcaagataatatccacttgctataccaactgcattcccctcatttgcagctaatatatttttatcttcatgtgtagtatcctttatatatgcacaaaatgattttaaaagtgaatctggaacacctgtaaaaaattcaatttgattttttataagttttttatagaatttatcaacatcaatcatatatatccccttttcattaaataataattttaaatttttcttattttaatgcaattaagttctttttcttctatttccctccagggattaatgtaagaatttcttttataggcatacaattttctgatgcttcttttgatctttcattttccaatatactctttgctgtatttaccattgctggatatgcacttcttattaaatgatttgcgtatattattacacttatccccaattcaacaagttgttcttccttcatgaaattatatgatgtaggtacaacaataagcggtacccttctttcaagctttgcatatttttcacagaattctataatttcagttccatctttttctttgctatgaatcatgattccatcagttccagcttcaatataagcctctgctctttttattgcatcatccatgccagcctttgcaataaggctttctattcttgaaataatcataaaatcacttgttactctcgcttctcttcctgctcttattttttcacaaaaatgccctattgtatcttgtgtctgctttacttcagttccaaaaagagaatttttcttaagacctgttttatcttcaataataatagccgatactccaagtctctcaagagtcttaactgtataaacaaagtgttctatttgtccacctgtatctccatcaactataataggctttgttgttacttctaaaatatcatttattgtattaagtcgtgatgttaaatcaacaagttctatatcaggttttcccttagctgttgaatcacaaagagagcttatccacattccatcaaactctcttacctttccatctttctctaccttagttttttctacaatcaatccagtcagaccattatgagcttctaaaattcttacaggttttttagaataaatacgttctttaagacttttcatcctcatctgtggagttattcctatttccattaaatcttgatcaagttttgaaatagatactccttttgtatatggaacttctataagctttccaccatatgtgtttaatgcattaatcacattctctcttaattctttttgttgaccttccttccagtcatctccatggacaacatactccggtcttacttttaatatatttgatacttgatccaatgtatcttgtggtataacttctataactccttttatattttcaataacttcttttctttcatcatacttcattattggatttctccaataccctcttataacatcatcagtatgaagaccaacgataacatctcctaaatttctagcttgattaattacatttagatgaccttgatgcacaatatcagcactcattgccatatatacttttgccataacttttcaatcctctccacaaataataatttataaaaatatcttatacacttattttttctaatctgggtaaaactaatttttcaactctttccaattgatttttatcatcaatttctccccacactaaattgtcaatttttaaatatccaactcttctattttttgccgcatcaaaaatggcattttcataatcatatttactgattattttatttgtttcttcatagcattcaatatcatattttaaattattcacaaactttctatactcttttatcatctctttatataaagctaaagagatctttgatattccaacaagttcaccatatacatctttaatatcatttatattttttgatattttgtaaagattaccctctcttacttcaacataacattcatctccagaattagtttttccactaagaagaatacagtcatcttcataagacatggctgttctcataagaccatagacttcataaataagatcactttccaaaagtaaaaaatcttctttcaattcattttctaaaattgaaagtgaagtcatactaccagttgttctataacgtctatttcttcttgtctcaatataattatatttttctgcaagcttgtcataatgttcatgtaagtgacctgttactatatatatcttttcaattcctatacttcttaacttttctattgatcgttcaataagagtttttccatttatactcaaaaaacctttaggtatagaatcatctgttacttcatataatcttgatcccattccagctgctaaaataacagccgtctttattctactcatacttacctccttttatttttacattatcttataattttgtatttaagttcattttttgaacagttttatattaacacctttcaatgttcaaaacaatatgttcaaattcatttaattacaataaaaaaatcgccaaggcgactatgttatatacatttcataaataataaaaaatactccttttacagcaatagcgttttatacactatttactataaaaagagtatttatattaaagattattttctaataattatctatattatactgctggttttataagattttttaatccacttacttctttagaataagctgatggttgtgtaacttgattttgagtatcttctaaaagcatagtctgtaattccacttgtgtaagtttaattgaattagttggaattgttatatctttagcttctgctttagtgcttgtaccagttacatttaatgatatattacctaaatccttgattattaaatttaatcctaggtctgtagtatacttgtcatctccaaaaacttcttttgaagttatgttagaacctgcaatatattgctttattccttcaagtccactagtaaatgcttcactgttaatttgatcctttatttgtgacatatctgcatctgtaagtcctaatttaaaagtgttatttatgttttgtaaattattagatgcagccttaactcctttagcagctaaatcaactacttcattactattaagattcatagtatattctctaccattctgaacatatggtaaatctatatcactatctccaaagactgttttaacaagattagccattgcttctggttcatttgttaatgctttcatagctgccatatccatacctgtatcgatacctatataatcagcctttaaatctttcaatcccttaggaacttctaatccgctattagtatatataccttcataatagctcttgtttatatagcttactccattatcaacatatacctctattgatggtatttttatgtttaatgaactctcagatgttgtgaaatcaacttttgcatatgccttatctcctgttgtatatccagttgatgtaaagttcatctcttctttcataccttgtatatccatagatatttttcctgtaacttcagatgatgtcgcttcccattttgcagtttttgcaagttcctcaccataatttaatgtagtttggctacaccctgctaaacttgccatacttaacacggttcccattataagagccactgttctttttaatttcatttcaatccccccagattataaatattttgattcatgcaattagatgcatttaatcgtacgtactggcttttatataatacgtataatttcattatacagaattttatagaatatatgttaatttttatacaatatatccttaactttttcttaatttaattcttttaatcttttttctttaaaatttaatttttatataatatttttaaaattattcatattcctaattataaattagaattgatcaaaatttaatgtatactaacaaaaagaaaaagctatactcagaccttttataaatctgaatatagcttctaaaacatattattttacccatgctcctgttgaatctactttgtatgatcctacatatgaatttgttaccattgctccattagctggatttaagtaataccactttccatttgagtagtgccatcctgtaagcattgctccactgttatcaagcaaataccattgtccactcatataaatccatccagttgccatattaccatctgcacctaggtaatagtattttcctgaattattatcaaaaaaccattgacttgtcaaaggttttcctaacgaatcataatactgccaatttccattattcataacccattgatttacttttgaattagttggctgataatttggctgagttgaaataaccggactagatgtaactggattatattgattagaactatttgtgtttatattattatttacattagagcttgtaccattagatgtttctcctctataaatatttagagtataaactctagattcatcctcatcttcatcttccacttcaatttcaatagtatttttacctttacttaaggatacttcttctttatagttatcatcgtcatccacttctgttccatcaattgtaactgtataatcttcatcctcaggttttgcttttattgttaagttgcttactgttgaagctacatatacatcatacttagttgtttttttagaaaaacttatttcaccatcacttaatgtaatgctttttaagtaaatatcatcataatcttcatcatcatcgtcgtcatcatcattaccagtatattttactcttatagtgtagtcatttaccacatcatcatcttctttatattttacactacttcctggatcttcattatatactcttactgtaattttgtttgttccagatgatagagttgctgtttttccaaccttaacacctttttctgaacttttttcactaacaaacaatcttacacagtcatcatctactccatctacatcaattttaatctttgatgatgaagtctttgcataatattttgtatctgcattgatttcatcgtcatctaccttacttccacttttataatcattgtcatcataaatttgaatatttttaccactagaattttttaattttaattttgtaagtgatccatcatcgcttgttgaagcgctagcttcagtagtaataacgtttaactcccctgctggtaataccgtggcaatagtacatattgcagcaacaattataaacgtttttttcaatatctgcttcattatataacctcctaaattcttttaatatacaattcaaaaagatattgcttgtctttattctatcatactttcatttaattgcaaaaaacaagagtcactaaatccttctagtaactcttgttttaattataatatagtgtttttatttattatacacatctttgtctatattatctaagctgtttgcaactgtaactgctgttaccatagttccatttacattaagcattgtacgtcccatatctaaaataggatctattgcaagaattcctcctgcaagagggaaatatgctcccattcccataccagaaataacaactgatacagccatagttgctgtacctggaagaccagcaattccaagagagctgactattattattacaagaagcattccataaaagctaagatccataggtgttcctgacatattagcaattgtaatggccattaaagctgggtacactgcagcacatccattcattcccatgttagatcctaaacttcctacaaaacttgctactccattatctactcctgccttttcagtcaatgcttcaattgttacaggtaatgttccaaggcttgaacgtgatgtaaatgcaagtatcaatggctgtgcaacattttttatatacctaaatggattaagtttatttaatgaaattataatcatatgaaaaacaaatactaatcctatactcacatatatagctgctataaatttagtaacactaattatggcactcatacctcttccggctattgtattagcaagtaaggcaattactgcataaggcataaattttattactgtcattgcaacacttgttattatcttatatccagcttcaactaaatctattgctggttttactatttctaagtattttttagtaagtcttttaattgcaattcctataaatcctgcaaatataacaactcctacaacattagcatccgccatagcctttactgggtttgaaggaagaagtcctctaagtgtatccactattgaacttatttctttcatttcactctgactttgtactacagtttcaccaactcccagtttaaataaattcccaacaattattgcaattattgctgaaattgctgtggtactaagcaatacaagtatagttctagatgtgagctttccaagattctgatctgccttcatgtttattataactctgataatcgaaagaaatatcaaaggtactacaagcatttttaacaaatccataaatccatatccaacaagcccataccattttgttgtttctgttatccatgtaacagctccaatgtcatctggaaattttgcaactgcctgtattacaacgcctaataataatcctaataaagtagctactatcatacgttttgaaaaattaatcttcttcttttccatttgtcttattacaaaaaacaggcctagtaataatccaataaatactattggcataaagcttgttatcataacaaaatctgtaaaaaatgtactattcataatactctcctctttcgttaataattcctatctgtttagtatgctttatataataacaaccattttaatgtatgtcaataatattattccactatttaattttctctatgtaatattttaaaataattctgaaatcattcatgtattcttcttattattttatatacgacctcattttccataactaaaggtgatgtatgtgcaaaaaatataattccatcagttgatgaaattatttgtgaaatagcctttccttcatatggatctaatacttccccaaggatttctcctctctcaacactatcaccaggattttttaatcttctataaataccactagtttctgatattaagctctttaaaatttcctcatttataacactcgatatatatccattatgacaattatattttatgattcccattctagttaaaaatctcaagacagcaacaacagcatgctttgctgatttctcatctattttatctgttgaatttgtatatacagaaaaagcattcgtactccccatctgccagttatagtttaaagttgctgtatcagaaggggttggctttcttattaaaacatattttaatccaaacaaatttgctaaacttggattttgatacccagtttccatcattcttacatgaggtataaaagttccttgcatataaaagcttgcaaattgtattccatatgtgtatccttgaactttttcaaatataccttctgctattttgcgtgatgttcctacatattcagtttctgaaaacattctatttatatcaacattatcagtcgtacaaaatctttttcctatattcataccataggtatttatgcatggtattataagaatttcattattacgtgttatagctcctttcttttctagttttttcaattcatttataagttgtgaacacgtatacagttgttgtacttcatttcctctcattgcacctatgatacatactgatttgtttccttttccaaatttatagcctgtaatccgaaaattatctctatataatgagtgtaactcaaaaatcacttctttattcattgctctctccccaataactcattagattttataatatatactaaattctttatacagacaaatactttgtaagtatttatcaaagtcaaataattatgtaaaaatattttcttgtaaaataaaaaaagcaaagagtatcccttaaggcacctttgcttaatttaatattactactataaaaatttattgtcaatatttgttacacataatctatattttcttatactctcttaaaaacataggcataagatgtccactatattcccatagagaataacttcctttacttatgcaccaatcatatattaatcctctttcacataatgcatatactttcattatttcatcacatgatatactacttttaatctctcctctttcctggccttcttttattattttttttaaaagcttgtaataaactctattttcatcaagtaaatgcttttctccaattgttacaagctgtgatgaatataaagatgccagtagctctatagaaacactttcttctatcattttaaatagttctctgtttaagtaaattaatttatcaaaactattcatatttatatcaattgtacttattacattctcatatttttcatcaaatagatatgaaagagaacttaaaagagaatcctttcctttaaaataatgataaaaagctcccttagaagtgtgagagcgctctattatttcatccactgtagtattatcatatccttttttataaaaaagttcccatgctgctgaaacgatgagcccctttgtagtctgatcattattcataattacgagcctccccttagtctgaccataaaatctgtgtctaatctaaatattaacaataacagtctctaaagtaaatagattctatcttatatcagtaatgcagcaataattatttattgctgcattacttaacctcttcagttatttcttttttatagaacgtattacttcaactcttgtaattacattattttttatttttgctattcttagagcaaaacctggataatatatacatactccagtgccaatttcaagatttcttgcttcaatttctctcaaaacaatatcttctagcgtttcatccttatcatcaaaaggaatatcaagatgctctaataaattaattctttttactctttcatttcctctataaattgttttgtcgacttcatcaaaattataaaataaatattttcttgttgcaaataatattccaatagatattatacctactaagttttccatagttgttgtatgttctactattaactgtcttgcaattgcaaaaagtaatacttctattacagtttcaggcgtatgtttacataacatttttataaattctataccaataacaagattaaatgcagcagctaaataattattaaacacctctaaatctgaatgattcgttattattgattttatatcaccaattaaatatactactaatattccaatacttaccgcaagcaggattcctattacagtttcaagcatatctgccaccttcataacctgctctcttaaaaaccttttcattaatttcacctctttttctaatagtctatatattatgtatgatttattttaaattatcatgaaagattagtaaagataatatatttattttcatgtaaaaagtacaataagatagtattactctaattgtactttttacattttttatattttaaggtttcttattgagaaacactgatattatttccatctgttttaactactatttcaccatctttagttaaaaagtttttcacattatacttatttagtaacttaatagtgtcttcatcaggcagttcttcatctgaacatgtgattatagaatatgaaggacttattgattttataaatttttcactaagagaatttatttttccatgatgtggcatctttacaagagtatatttttcattgttactatttataaattctgaaagacgttcttcttcagcatcacctgcaaataagaacttatatttcccatagtttatacttacaattatagaataatcatttgactgtgaatatgatttttttaatgctggatatatattaatttcagcattatcagttttaacattaatattatcatgaatcaaaataggcgttatgttatttttctctatagcttttatatattgattatattgcttactatccttactataatcagcctgtataacattatctactttaaattcattaagtatagcatcagctcccccaatatgatctttatccatatgtgtcaatataagataatcaatactatcaatatttttttcttttaattgggaaaccacattatctttagtactgtttagccctgtatctatcataatatttttgtcatcaattgaaagaaaaatactgtcagccttaccaacattcataaatgtaatttcaaatggagcattttctatattattaacttcagctatgtttgtagacgtactatccacgcttttttttgaataatctgaacatccattaagtccaaaagatattcccactgctgccataattgttccaataaattttttcaatttgttttttcccatgctttaattctctccataatttaaatatattaattttactatataatttttttatgtcaacactgtgtctatattaattataatattaaaatttattaaataagaaattactttttatatattttcaagcattatttaatgatttttcttattatgttataattccattaacaaagattttaataggaggaatatatgaaaaactcaatggaaatgctttgtttcccaacatataatagagaaagcagagacctattagtatatcaatgtggaagagaagaatgtacaccagctcattcatttggtcctgctatacgtgaccattttttaatacattatattattgaaggaagtggcactttcctagtaaacggaaaactatataagctgcacaaaaatcaaggttttataatttttccagatgacataacttattatgaagctaacaatgatactccatggatatataaatgggttggttttaaaggtataaaagccgaatactatttacaatgtgcgggtttaacaaaagaaaatcctatatttgaatattctaatggtaagtttttagaagaatgttttgataatatgataaaagcttctaaattaaaatatgcctctgaacttaaacttcaagggctattatcaatattcctttctgaacttatagaactctcaagtatagacagttcttctgattattactataaagatgtttatataaagaaatgtttaaattatatagaaatgaactattcaagaaaattactaatttcagaaattgctgctttattaggactaaatacaaaatatttcagtcttatttttaaagaaagtattggtgtgactcctcaacaatacataatatcttttagagtaaacaaagcatgcgaacttatgaaaaatttcaaattatctatttgtgatatatctcgttctgtaggctacgatgattctcttgctttttcaaaaatatttaaaaagcaaaaaggaatgtctccgaaaaaatacagagaacaatttattaatagcaatagtgaaaacctagactagatttacctttctcatataacttcatagttttgtttaataataaaacactgtatcattataatatttgatacagtgttttaaccttctagtttatatattcttattttctaataatacattaaaactatttaattcctgaaattttaaatgtatattcaatatctttacttgaatcaatacaatattcctttaggactggtgcaccccagctatcatcaccaccaacacccatctgccttccaataatattaacattagtgaaattaacaggtggtaaatcttctttatgaagagcattttctaactctatgcagttataaggtaatacgctaaattcaaatggaagttcttcataagaaaatcttagtccttctccctcttcatttcttacttcaacccatcttgtatcagttctatttccacattcttgtggcactaaatacttagataaatttttaataggagtattgctatacacacctaactttgcaccatcacatctatcaatataattctcttctttaccttttccataccatataaatgaatcaaattctgataataatctaaagttcattccaagtacaggtagttcaggaagtccatctactccattataatgtactgttacttttatgactccatcttcttctatataatatgaaacattaacctttgttgatggaactgttggaagatcataagtatatcttaaaataattgacttttcattttcatccatagaaaaatcactatatttttgtccaactgtagcacttaaccattgtgcacatctgaattcatgcttattccctctatcattatcagttgttgctctccagtaataaggttttggaactcttgtaataaattcttttccataatatcttaaggatactattccaccttcctgtttagagaatataactttaaagtcctttccatgaactccaatattaacatccccgtgtacaatcttcaacttagtttctgatgatttttcttgtttagtatttccttttaaaacagcctgaccaaagttcacttcatatcctgctttagcccaaagttcatctttctttaataatgtagaaacagttaagaccacttccttctctttgctatagtcttttattggaagattaatatatttttcagttccaggatctacagatacattaatttccccatcttctaatagctcatcttcttttttaattgtatattttaaagtgtatttatcagtatttacaaaaagattttgattttttataagaactccattttcatctggaattaattttatattctgatataaatatttaacttcctgagcttttggtgattcagttctatcagcaaatattaaaccatttcccgagaaattataatcacttggtctgtctgtaaagtcaccaccatatgacaatacttctctaccatcatcagtagttctataaagtgcttgatcaccataatcccagataaatcctccttgatacataggatacttttcttcaagttctatgtatttattcattcctccacaagagttacccatagcatgcatatattcacagcttatatatggtttttgtggattgttatctagatattcttcaatatccttcacttttgcatacattctgctttccacatcactagtcttatcatattctctattccaaaaaactccttcataatgtacaatacgtgatggatcttttcttctaaaatattctgacatttggaatatatcttctccagcatatgattcatttccacaagaccatattattactgaaggatgatttttatcacgttcaagcatagattctgctctatctaagacacagtcctgccattctttaagattacctggaacattccattcaggagaacaagcaccaagcttctgccaagatccgtgactttcaagatttgtctcatctattaaataaattccatattcatcacaaagtctataccataaactttgatttggatagtgggatgttcttactgcattaatgttatgctttttcataaattttatatcataaatcatatcttcctttgttatagaacgaccacgtcttgcactaaattcatgacgattaacacctttaaaaataattctcttcccattgattttcattattttatcgtctaattcaaaatgtctaaagcctactttttgaggtatagcttcaactaaattcccatccaaatcctttattaatatttttaaagtatataaattaggttcttctgcgctccaaagcttaatatcttttatattcattgatattgttaactctttatctaaattgacattttcataatatgcaactttgtttccgctattatcttctaaatatgattctatgctaccttcaataactcctgtaactttaagttcagcttttaattcagcatctttataatcattgcttagttctgttttaacaaaaatatcatttatatgagtttttggaacagcatataaatatacatctctaaatattccagaaaacctccaaaaatcctgatcctcaatccagcttgcactacttctcttataaacttcaacagcaagtttattagatccgtcttttaagtattctgtaatatcaaattcagaaggagtaaaagtatcttcactgtatccaacaaattctccatttaaccatacataaaaagcagtttctacaccttgaaatgaaataaaagtttgcttatccttaagtctatcattaacttcaaaatacttaacataacttcctaccggattatatgtcttagagatatgtggtggcctaagttcatcgtgaccttcccatggatacattgtatttatatactgacatttatcatatccctgtaattgaatatgtccaggtacttcaatataatcaaaaccgcttacatcaaaatcttctttgtaaaaatctttaagtcttaaacttggattttcactatatgcaaatttccacttgccatttaaacattgtcttaatggcattttttcttctaaatacatttcttctaaattatcataaaaccaatgatcagaatgagcatctaatctattaactctaaatacttctggattttcaagccagtcaagtgtaaattctcttgtgttcactatacatccttctttctaattatattttctgtatgttaatatcaactttatattattgaaaatctataaattgttttttctttatattcatctcctgctttgagcagaggagatttaaattctggagtattgattgcatttggtgcatactgtgtttcaaaacataaagcacttcttctaatatatgttgcattattctttccaacatcatttccatctaaaaaatttgcactataaaactgcattccaggcattgttgtaaaaacttcaagctttcttcctgtattctcttctactatttctgctgctttttcagatatacctttatttatatctacaacccagttatggtcaaaaccacttccaattacaatctgttcataatcacagtctatataatcaccaactcttttaaaattcctaaaatccataggagttccttctacagaccttaattctccagttggtattgaattactattgttagctgtaaatttatctgagtttattttaaccatatgattaagagcatcaccagaatcatgtccagctaaattaaaatatgaatgatttgtaatatttacaacagtatctttgtcactaactgctttatattctatttctaatgaattatcttcagtaagagtatatttaaccttagttataagatttcctggatatccttcttcaccatcaaaactgttatatacaaattctaaagtgtttgaagcttcattaaaatcaataatatcccatacaactttgtcaaaacctatttttccaccatgaagatgattttgtccactattagtgcatactctatattctcttccattaatattaaaaattccattttcaattctattagcacatcttccaactacggctccaaaatatttatcaccattttcataaccttcaatggtgtcataccctaaaaccacatcatcatattttccatttttatcttttgcaataattgatacaactgttgcaccataatttattatttttaccttcataccttcttcatttgataatgtaaataaatatacatctttgttgctttgtgtctttccaaaaacttcttttaatattgccatttcctcacaccccatattgtaatagttttcataattaaattttatatttattttagtaaaaagtcaatgtgtttttacttattttttactaaaatatattatttgaaaaccttttaaaaatgctttataatctataatataatttaataatgttttattattttacttttgaatttgaggtgcttaaaaattgaatgatttttgtaaaattctaattatcgatgacgagttcattatgagacagggtatcaaatatatgacagattgggaaaaagaaggctttaaaattatcgggcaagcttccaatggacaagaagctattgacatgataaaaaaggaaaaaccacatattattatttctgatattgtaatgccacaaatagatggtattgaactcagcaaatatattcaaaataattatcctgatatttcaataataattttaagcagttatagtgattttgaatacgttaaatcttcttttcaaaatggtgcaatcgattacttgttaaaaccaacattggaactggattcattgctaaaatccttaagaaaagctgctggaaaaataaagaatttctctttatcctcaaataaaacccagcatacagaaactgttttaaaacgacttattttaggatttaactctgatattgattttaatgaactaaacaatttatttacttatgataaattctgtcttttcggaataaatgcaaaaaatatttttaaaagttatgaagatagaaacaatttcataaaccaattagcttctgaacttgatagtttcttttcatctaatttatcaaaaactatatataaaacagtaacactagagaatgaaattgtcctttgtttaataaatttcaaatttgaaaataactctcatttaatttatgaattaaaaaggttctctgaaaaattttatcaaaaattttccaattccttcttagtagtaagcaaaaactttgattctttagcaaatataaaaaatatatatgatgaaaacttcctattcttatgtaaacaatatttttttaataaaggaacttatttttactcttcagatgactacaaaactccaccagatgaaaatagctttaacttcaaattattttcagaacttatgtcatcaatgcatataactgatgcttttaatatgttattggaatatatttctctttcaatttcacacaaaagcttaaatgagtttgaactaaaaagcataatgcaaaactgtacctataatgctatttctaatcttgaaaatttaaatattgatcagtttgaaattaatttactaaaacataagttttttagtcaaattgatcaagctatatatgctgatgatttaattactatttgtaaagaaatttgtgataatttcaatgaattaatgactaaatatgagagtacttttaattctcacatgatcaataaaattatacactatattcagactaattatgcagagccccttacactaacagatgtttcacagaaattcagctttaattattattacttatcttcctacttcagctctcataaccatgaaggctttaatgaatttttaaataagataagaatagaaaaagcatgtgaatttttaaaacaagatatccctatttcttctataagttctatggttgggtattctgatcaaagttatttttctaaggtatttaaaaaatttactggctttacgccaagttcataccgaaaaaaccttgtttaaaacactattttttcgtggaaggattatattaatgaaagagaacataaaaaaattacttgattctacaacattatttgttcgcgttgccagtataatgctcataaccattatattgatatcaatatcaattagcgcaattactattagaatatccaaaaatactattgcaagtacatttagcaaatccaattacaaggttttaagtcaaattgctgaaaattttaatgatttaaattcaaaaataattacagcaatgaatatagtagcagacagctcagattttcagaatcttttaagtaaaaatgacctgactcctcaggaatatttcaaaacattatataatgttgatattgtacttggaaattatttatcatctcaagactctaacggaattactctatccgttgtaggtgttaatggtgaaagttatgttcaaaacaatgactcaatgcttttgacacccaaagaactactaactaattccataactgaaaaggccctagaaaatgaaaaccaaatattttatcaatactatcatgatggttttacaaaaagtagtgaaaactgtggtggctgggtagcaattaaggtccttcatgataagtatactaaaaaaatctatggttttgtttatgcttttgtaagtcaggaatacttaaaaaaatattatcttccatttgtaggcaacggaaacgatatttcaataatttctaatgacggcacaatagtttcttctaatttaagttatcagattggtactgtgaatttagatttatataatatttcacaaaacattataaataataatcttacctatcttgatacaaaacttaattcttctgatgtggctgttttatcaaaatatcttccaacctataattttaatattataggtaccatagataaaaatgtagtattagatgaaatatacgatacatggcagattactttagtaagtcttttaattgccttaatatttatagttattatctttttcataatccgaaaaacaacaagaccaatcctaattcttgctagaacaatgcctaaaataataaatggagattttaacaatcacatcttattgagaggcagtgttgaggttcgcgaattatgtagtgcctttaactatatgctagatggtttaaacagttatgtggatcaaaaaatgaagatacaaaaagaaaaaagaaaagcggaaatttcagctttacaaatgcagattaatcctcattttatatacaatactctttcatctataaaatggcttgtttggcaggaaaataaatctaaagcttcagaagtaattgatgcatttatttctcttttaagaaatactataagcaataaaaacgaaatgattactgtttctgatgaaattgaaaatcttaaaaactatgttctcatcaatcatgttcgttatggtgataaaattaatgttaatttctttgtaatgccagagtgcgaaggctatattattccaaaattaatacttcaaccattcatagagaatgcattttttcatgctttcacagatagagattctggatcaattcatgtttttgttaataaaaataatgaaaatctcatttgtgaaattattgataatggaattgggatgacctctgaaaatttaaaaaacatatatactggaaatcacaaaaagaataataactttacaagtattggtattaataatgttaatgatagaattaaacttatatatggtgataatcatggtgtgaatattacaagtgaacctgaaagaggaactattgtaaaactttctttgccagctattactgattattgtgaatccaactaattttattatccaatgattgcatcagataattttgattatctgatgcttttattttataattttatttttcttagagtctcctccaattcttttgaaacattttcacaatccttagcattttcaattaatttttcagttgaatctgataatatatttattttatcagatatattcagtgcatctcctgctccttcacctgaagattctgcaacattatcaattgcacttgaaatatcttttgttgatattaaaatttcttgtagagtatctcctatattttgtgacatagtgttgtaatcatttgcatctttactatataaatcactaatctcataaaattgaatatagttatttttaatcatataatcaataaagtttaatacttcattagaactgctaactaaattttccatcgcattaattacataaactgtaatttctcttatcttttctgctgtaacatttgattcttcagcaagattctttatctcatctgcaactactgcaaaacctttacctgcttcaccagacctagcagcttcaatcgcagcatttaaagcaagcaaattagtctgatcacttatattagaaatagcatctaaaagttctgtaatttcattaactctttttgatctatcaatagcttcttttagctttccactattattttcatatattttttcagtttcttgtttcatttttattgactcatctttaaatttatcagctctctttttaatttcttttgaatgaagaattgcatcttttgtaatttctgatattccatttaccgattgcaccataacacttgtgctagaatttatttcttccgtagatgctgctgtttcttctaaacctgctgctatctgttcagttgaaattctaacctctccaacaatttcatttacgtcttttacaatatcagataaaatctcacttgtttttgatgtagatgcagactgtttttcaatgttatctaacattccacttacagaattcttcattaagttaagatttctaaacatagtgcctgtctcatcttttgcagcaaataatctttcttcaatggatatactaaaatccccttttgctatatgtgatagatattcgttgaatttatgaattgaatttacaattattgaaccaatcttactaaatataactattcctaaaatcatcaaaattaacaatattaatgcaatcatagatatagtctgtattatataatcatatatactgctatactcaacaccaacaaaccacattgcaatgacttttccaaaaccattttttattggaatatactgccccagcatatcttctccacctatatttacttttccaataaaagtttctccattattgattactttttctgtaatttcatcagacgcttgaagtccaactaccttttctccattcttatcatttatgcttgtggcaattatctcatttcctaaataaatacttgataaatttcctgtttctattttaataaactcaggaacatcattattattattaagtagtgcatcacccttatataattttccatccctaactttccaatcacctgaatatcttttttccatatatgcatatcctagtttacttgttgtaattacagtctgttcaaaattgctatatgctgatttattaaaattaaaatacactatagaaaaaatactaattgatattatgcttataattgcaacaaaagaaactactagcttgttctttattttcatctttatcttctcctaacttgctgaatttataaatcactttttatgtatcaaaatattactttaaacataaaggcactataaaaatttatagtgcctttctaagaagttattataaaacataaatttacttaaaagtaagcaatacttttaacattttatagaactttttaatatttttactccatatttgtctaatataatttcctcagatactttttctcctgaaatcatatctaaatactccttattatctaaatatacggtctttttttcttcagtaaaattcataacaaaagtatatttaaactcatcattaactcttgcttgagcagtaaccccatctggaagattaccatctatagcgccttttatgtttaaatcatttattattttcccataaaaatcactattaaactctaattcagttcttccagctatatagtaacattttccttttccatatttattaactgtaagtgctggcattccagcataaaaatcttctttatattcacctaatatctctgctgtttctgcatgtattaattcacaataatcttttacttcatagcactcttttatattcaattcatttgatactatttcaatatggttcctttcctcatcatataaagaatctatctcttccgcccatattccagttacatctcgtaatggacctgggaatcctccaagaaaacataagtcattttcatctacaactccactccagtatgttgtaattaacgttccaccatcttcaacaaatttatttaacctttctgctatgtttggcttaaccatatataacattggtgcaactataagtttatatttagaaaaatcacaatccatatttataacatcagtcggaatacctttttcccaaaatactctatgactcttctgacaagtttcttcatattcttttttcttcatttttaatccttgtaaatcgtctatagcccatttgttttcaacgtcataaattattgctacttctgacttcattgttgatccttgcacttcttttatcttttcaagaacacgtccaagttctgatacttccctaaagactcttgtattctcatgtccacaatgatctactactgctccatggaatttttcagatgcacctctgccctttctccattggaagtataaaactgaatcagcaccatgtgcaagtccttgaagtgaaccaagaatatgcattcctggacgttttaacttattagtatcatgccagtttactaaacttggagtgctttccataactaaaaatggctgaccaccttttaaacttctatatatatcatgaacaaaaccaacattagaagctaattcagcagtactttcaaaattattatgccatgcaggataattatcccatgatgctatatcaacttcttttgcaaacttccaataatctaatcctgtgaataaacccatatgtggataattccccataaaattagctgttacaggtatatcgggtgttatttctctaataggttctatttcattcttgtaaaaatctattgtctgatcagtaacaaatctcttccaatcaagattatgcccatgtacaaacatttctccatgttctgatggactttcaacttgtgaccaactagtaaatttatgactccaaaatcctgtccaccatgctttatttaactgctctaaattattatcatattttttcttcagccaatttctgaatgcatcctgacacaagtcacaatgacattctccgccatattcatttgaaatatgccacattattaatgctggatgatctttatatctttctgctaaaatcctatttatctcattagttttctttctatacacaggtgatgtaaaacagtgattatgtctctgtccatgaagatttttacttctatcactatttactcttaagacttctggatacttctctgacatccacgcaggtcttgcaccacttggagttgcaagaataacatgaatattattatctgccatatcatccattattttatctagccattcaaatgtatactttccttcttcaggttcaattgcactccatccaaaaatatttattgagacacagttacagtttgcaagttttaataaacgtacatcatcttttaaaacttctggataatcaagccactgatctggattgtaatcaccaccatgtaaaaattccgttactttattataaaaaaatttatttttcatattgcccctccttttaataggtgactgtcacctaccgaattatagctaattgtatcgattttcctgtattgtaattaagaaagattaatcaactcacgcaaaattagttaattaatctttcattattaataatttaatttcatatattaactttttttctatgaatattatttaactgatccaatcatacctgcaacgaaatgtttctgcattgtgaagaatacaaatgctgttggtaatgttgctattactattgctaccattatcaatccatagtcaggagaataacttgatcctaatgtagatattattaatggtacagttcttttttctggtgactgtaatactaataatggccatagatagttattccaactactcatgaatgttattattgcacctgctgcataagtagttttcatggttggcatatacatcttaaagaatattgcaagttctcctaatccatcaattcttgcagcttctaatatatcttttggaaaagactttgtattctgcctaaagaagaagatcaaaaatgctgtggatatactcggaaatattactgctaaatatgaatttaatcccataaaacttaatggtgttccatttaatgatccaaagaatttataaagaggaatcattaatgctgaaaaaggaaccatcattgataaaagaagtagtgtgaaaactttgtcccttgtaggtgttcgaaatatttcaaacccataccctgcaattgatgatactaataatgctaaagatgttgttattattgcaattactgcagaatttcctaatgatcgcataaatcccaaatctgaacttaaaagatttgttaaatttgctataaagtgagttccaaatgttagttttcctctcgtaacatcaacagatttattagtagcacttataatcatccagaaaaaaggaaatatagaaacaaatgctgcgatgcttaaaaatacatattttaaaaccattgatttatcaattttttcttactcattgctatctcctcctaccttaaattggattaatgataagattacaatcattataactactacataagctactgctgctgcatatccaaagtttggtgtatatgtgaaacataagttataaatatagtgtgaaattgttgtcgttgcatttgcaggtccaccctttgtaatattcataacttcatcaaataactgtaatgtacctattgttgaagtaatcgttgtgaaaagaattattggttttagaagtggaactgttatttttgtaaattttttaaatgatgaagctccatctatatctgccgcttcataaattgatggttctatattttgtaaaccagataggtagaatatcatgttataacctgtccatctccatgttatggcaataattattaaaacttttgcccaaattggatctgtaacccattctataggtactgaaattacattaatagtcataagtaacttattaactaaaccatctgaagcaaatatacttttcataattattgaataagcaactaatgatgttacacaaggtaagaatatagaagttctaaaaaatcctttaaattttaatttcggatcatttaatgttgtagctattacaagtgctaaaattatcattacaggaacctgcacgataagatataagaacgtatttccaactgcctttttaaaagtagcatcacccattaatcgtgtatagttagcaaaacctacaaatttaaggttattacccatccctgattgtaatgatgttataaatgattgaatggttggataaaagacaaataatgaaatacaagctatacttagggctacaaatccccaaccccatttattagttttactttcaattccacggcttcttttttgcttcatttatatcaactcctcatttttataaaaccatttgtcaaataaccccacatttatttgacaagtggttcataaagttaattttgttttaagatggagctttcgctccatcttaaaattgttaatccatttagaataaattatatattaagaataattatgagcttattaattatttacagatgcctctgcttgtgcttgtgtctttttaagtgcttcatcaatatcaccaccagagatgattgactgcattccctctgccattatattttctaaagcataagtatgaagtccatagttaacacttggaatcttttctgcccatccagcaaaatctttgaatatttgttgtccaccgaaaaattctacttgtgtattgtaattttcactgctgcttgcagattttaatgtacttactaagtttatagctggaactaaatcattcattaagtcatcacttgatgcaaatgtttcttttaagaaatctgctgctaaatctgaatttccaactttatctaatacataccaactacttccaccactattagatgcatttattgacttaggattatttcccattcttggagtagcagctattgcccatttacctttttgatcttccgctgcttgaatagaagaagaaagccagcatccatttacaactgatgcaacatcaccactttggaatgcacctataaatgaatcccatcctgaaacttgtttagctatatctgcatctactatttgtttatagatttctacagcatctcttaaagcttgattgttatctatgcttactttaccatcagcatctacataccagcttcctgctgactgcatcataattctcaattgatttaaatcacttggatcaatagttaacatctttttaccagtcttttccttgactgctttaccaatttcaatgtatttttcccaagttatatctttcatatcttcctttgtatatccagcttgttctattaaatcagttctatagaataaagcagaaacaccactatcaaatggtactccatataccttatctccttctgtcataaatcctaatttataatccataaatttagctggatctatataactacttaagtctttaatttctcctggatatgatagtaagtaattttgtatcttgtaatcttctataagtaccacattaggaagtccgtcataagtaccagacgataaacttgtatttaatttttgaactacatcatcttgtgccatgcttactacattaatagttacatctggatgatcttttaaatatctttcttttgccatattagcagctttaatattgaatgtatcatcccatgcccatacagtaattgttttatcatcgctgcttcctgattttcctgagctgcttcctgatgatgatccacaccctaccattcctaaagcaacaattgctgtcatgactaatgccgttatttttttaagtttcataattaactcccccttaaattgtttccatacctttgaagtaaggtaatcagttcttgtatttgtttacattatatcagcttcatgtttgtaaacgttattatattctttgtattaattagaaaaaattttatatatttactaaaatataatttttattatttgtatttttttaatttatttgtactaatttataaaattagtacaaataaaaaagtttactaaaattattttagtaaactttttagttaaatgcttttacagctctttcgtatttttaattttgtaggaataacaacctttttcttatagggtctacttccatctatattctctaatacaagatcaatcgctgcgcttgcaagatattcagttgataatttgactgtagtaagtgatggaaccatatatttagcacttggctgatcattaaatccaacaatgcttatatcatcaggtattgtcagtccttcttctgctattgctttatatgcaccaatagccattgtatcattctcaacaaaaacagctgtaggtctttccttttccttcaacatttcttttgttagttcatagccacttttaaaattaaacctgcttgcagtatatatgtacttaggattatatattcctttacatttcatgaaatattgatattcaatatctctttcatcaatcatcatattttcataattttcatttaaatccttgccaccaattaatcctattcttctatgacctatttcatatatgtaatttaataaatcaaatgtagcttttttcttatcaattacaactgaatcatatttactttcatcaggtgaataatcaacataaactatattatcattatcatttgacattttttcaaccatatctgtatagtaatttcctataacaagtattccacttaactcttttactagtttcaaatctatgttttcatctaatttcactaaatttatacatcgctcactacatattctctctacaaccaatcttattgataaataatatggatctgctaactcctcttcatagttgcaccagcataaaattcctatatttttattattttttttactttttttacttgatgatgtgtactccaactcatctgctatttttaatattttttgccttgttgaatctgatacatttaatgattcatcaaaattaagtactcttgaaacagttgagattgaaacacctgcaatcgatgctatatcctttattgttgccattatttttacacctcaattttcttatatctatatatagtttattgcattagtaaaacatcgtcaaattttagtaaaaaataatgataaagctaatgaaaaattcttttcgaattctctcttcactttatcattatataaacataattatcttatgtattttattattccttcttttctttcatgctcaacacctggtttttcaggatatccaatggaagccattccccatactatatgattttctggtatttcaaattcatttaataaatctcttacctttttgttatcacatatagtttttagctgattaatccaacatgaccctatacctaatgaattagccattaaaaatatattttctaatgcacatgagcaatctgctaaaccattattgttatctctttcattagataacattattaatgttggaggggcataaaaattgtatccttcatctcttccaagttcttctcttacaactttagcaagagcctctatcttttctttattctgcacaactgtaaactgccagctttgtttgttcataccactaggtgcataaattccagcttttaaaatcatttcaagttcatcatctttaatttgttctttcttaaatgccctaatacttcttcttgttaaaatattattcaaaacttcattcatattataatttctccaatctaatattaaaatattttattcactttattagcgattctttctccaaatattctagcattttcatcttcattttcgcatatctcatttatatgaacgtatccaatatgagttttaggctttccaaatgcaactcccctgaatataccatcattccttttaccattagatgatttacaatagtaagaagtgctatatctgctcctccagcaattgaatttgcagttgcaaatgttgctccaagttttccttctaatttatattctgttgattcatcaatccatttcttcaattcccatgcaatatttgcataataagtaggagtcccaaatattatcccatcagaattattaataaaatctttgtctattgaattctcatcttgtaaattcataagcttcacatcaatgcccttaactctttcaacaccttcttttattaattgcgccaccctttcagtttttccagttctactgctataaattatagatattttcattttacaatcccccatttttgtataaataattatttacagttattatttgtatttaaatttattttaccacgataaaaaaataatgtacacgttataaaaacagtcagatattcatataaacatctgactgtttttataatacttaattcttataaacactcaatattaattctctaagaatcttacatgctaaagctgtagaacttccactttgatcatatataggagaaagttcatttacatccataccaacaatatttaattctgaaatttttaaaatagcatttagaagttccataaatgtaactccaccagcttcaggagttcctgttcctggaaatactgatggatctaaaacatctaaatcaagtgtaaaataaacaggttttccttttaatttttcgactacttcttctaatccattaaaattaaatttatttgtaaaaacatgatctcttccccagtaaatttcctgcctatcaccagatcttattccaaattgaaaaattttattatcgcctataatatcccatactctgtgcattactgttgcatgagatagttgctgacctaaatactcttctcttaaatcagcatgagcatcaaaatgtatcacatgaacatctggatactttttagctactgctctaaatgctccaagtgtaactaaatgttctccacctatcatacaaggaattttatcatcttttaatacttttgaagtaaattcttctatatcattcagggcgctttcaggacttccaaatctaagttctaaatccccaccatcaaaaactccaatgtcttctaaatctttatcttgatatgtactatacgtttcaattccaaaagattcacttctcatggccttacttgcaaatcttgttcctggcctgaaagatgttgtcgaatcaaaaggtgctccaaaaataacaatttttgattcattatattcattatcacagcctataaatgtttctatattcttctccataataaaactctcctatataaaaaatatcaattcttaactgttaattgttaactgttaactgttaactatcaagatagtcttcccttaaaatcttcatacccaaattcttttataatttccacaccgttttcttcgctatacttaacaattgaaggaagattaattccattgaatgtattattttttaccattgaataaatagccatatcacagaatattaacttatctccaacttttagtggttctttgaatgaataatctccaattacatctcctgcaagacatgtaggtccccaaatctatatgtatattcatactcatagggttttccagaacctataatgttaggtctgtatggcatttcaagaacatcaggcatatgacaagctgctgaagtatcaagaatagcaatgtccattccattattcgttatatcaagtactgtgctcactaaaaatccactatttaaagcaacagcctcacctggttcaagatatatctctatattatatttattcttcatatataatacagattcaatcaatgtctttaagtcataatcatctcttgtaatatgatgaccacctccaaagttaagccatttcatattttttatatattttccaaacttctcatccacaactttaattgtacgagctaatgtatctgaattttgttcacacatggtatgaaaatgtaatccatctattccatctaaatcattttcttgaaagtttttcaaagtgacacccattcttgaattctcaaaacatggattgtatatgtctgtttcgatttctgaatactctggatttattcttatgccacattgaattttcttatctttataatttttaactctatctttatatagtttccactgattaaatgaattaaaaataatatgatcagagtatttcattatatcttcaaattcatcttgtctataagctggagaaaaaatgtgaacttgttttcccatttcttcatatcccagtctagcttcaaacaatgaacttgatgtaacaccctttaaatactttcctattaacggaaaagtagaaaacatagaaaaagctttagttgcaagaataatgttagctccactttccttttgaacataatcaagtacttcaagatttttctttaataatctttcatccacaatatagcatggtgatggtaacttatctatatcaatatcctttaacaaaatttttcctcactttcattttataattttcctcattaccaaaaatgatgaagaaaaaattctccatcatttttaattaataatactcttatatttttaaaaatattttgcagaaatatcttcccaaactattaactattacttgattaaagttggattaaaatcttctacccaaggaagtccccatttgtttaattcttccataaatggatctggatcaaattcttcaatattatgaactcctggtttcttccatagtccctttaatatcatactagcaccaatcatagctggaacacctgttgtatatgaaatagcttgtgatccaacttctttataacactcttcatgatcacatacattatatacataataagttttaggctgaccatccttaataccttggaatatacatcctatgtttgttttacccttagttcttggtcctaatgatgcaggatctggaagtactgcctttaggaattgtaatggaactattttttgtccttcaaattcaattggttcaattgaagtcattcctacattttcaagaacttttaaatgagtaagatacttttctgagaatgtcatccagaatcttattctctttattcctttaatattaagccctaatgattctaattcttcatgatgtaataaataaacgtccttaggtcctatttgaggtaagtcatatacttcttttaattctaaaggttttgtttcaacccacttaccttcttcccaataacttccatttgctgttatttctcttatatttatttctgggttaaagttagttgcaaatggatatccatgatcacctgcattagcatctactatatcaatatagtgaatttcatcaaagtaatgtttttgagcatatgcagaaaatacgcctgttacacctggatcaaatccacttccaagcaatgctgttattccagctttttcgaatctttctctgtattcccactgccatttatattcaaatttagctgtatcaagtggttcataattagctgtatcaacataatgaacctttgtagctaaacatgcatccataatagttaaatcttgatatggaagggcaagattgattactacatctggtttaaagtcatttattaaggctactaattcatcaacattatcagcatcaactttagctgtctgtatctttgtttttccaccttgtaatttttcttttaatgcatcacattttgataaagttctgcttgctatacatatttcttcaaacacctctgaattttgacaacatttatgaattgcaacacttgcaactccacctgcaccaattattaaagctcttcccatttttcattcctccattttttaaactaaatctataatctatataattttttaatttaacttatttcttctttacttctagtaattttttcacataattaggtaatgcaaagcaccctgaatgtaattctgtattataatattttgtctctatattgagattattccatctttcagcattcaagtctttcacaggatcataatttttagatgcaaaaccaaaaagccaatgacctgatggatatgttggaatatgtgcttgataaactctgtgcactttaaataatccatatattttttcatgagcatcctgcatagcttttgcatatttttcataatatgggctttcatgctgattcactaatattccatcttcttttaacgctttatagcaatttccgtaaaactcttttgtaaacaagccttccccaggtccaaacggatctgttgaatcaactattataagatcatattcattttccttatttctcacaaaccttaatccgtcttcaaaaaataagtttactctttcatcatttaatctgcacgctgtctgtggaaggtattccatgcagacttccacaactcttttatctatttcaaccatatctatattttcaatagatttatactttgcaagctctctaacagtccccccatctcctgcacctataacaagtacatttttaatattaggatttactgccattggaacatgtactatcatatcgtggtaaatgaattcatctttttctgtaaccatcatcattccatcaagtgtaaaaaatcttccgaattcctttgattccaatatatctattctttgaaattctgtctgctcgctatgtaactgtttttcaaccttaattgaaaatcgtacattttctgtgtgttgttctgtataccaaagttccattcccatagctccactacatgaaagttaaataattaatgattaattctgacaaaaccgtcaactactaacctttaactcttaactaaccaatttctccttccacaatattaatcttttcaatctttgagtcttcagttccggttaagaaacaacctttttcttttgcataatttatataatcaagtatttcttctgttattctttctcctggtgcaagaattggaattcctggaggatagcacattacaaattcagcacatatacatccatcgctttcattcattggaactgaccttttattacaataaaaagcttcttgtggagttaataccacttctggatttatatattcatgatcaaacattccacttttgtcttttgaatgtactctctttatttcatataaagctgatattaatctttctaatgtaagctctctatctccaacagaaattattgctaaaatatttgcaatatctccaaattcaatctgtattccatattcatctcttaaaatatcatatacttctattccagcaagacctatgtctcttgtgaatacagataactttgtcttatcaaaatcaaatacttgatccttatctattaattcttcggaaaaagcatagtagcctccaattttattaatttcctgtcttgcatattctgcaaggcttgttacttttttaaatatctcttttccattaagaacaagatctcttcttgcaagatcaagagatgacatcaaaaggtaagatccacttgttgtttgtgtaagattgattatctgacgtacatatccaacatgtaaatcacaatttaataataaaaatgaactttgagttaaagaaccacccgtcttatgcatacttacagcagccatgtcagctcctgcttccattgcagagataggcatattatcaccaaagtaaaaatgcgtaccatgtgcttcatcagctaaaacatacataccatgcttatgagctatttctgtgattttttttaaatcagaacatatcccatagtatgttggattatttacaagaacagcttttgcatctggattttcttttatagccttttccacatcttttacactcattccaagaggtataccaagctttttattaactcctggatttatataaactggtattgctccacttataacaagcgcatttattgcacttctgtgaacattacgtggcattattatcttttcaccttttttacatacactcataaccatagcttgtacagctgatgttgttccatttaccataaaaaatgcatgttttgctccaaatgcatccgctgcaagttcctctgattctttaattacagaaacaggatgacagagattgtctaaaggtttcatagaattaacatctacagaaagacatttttctcctaaaaactcttttaacattggatttcctcttccttgtttgtgcccaggaacatcaaaaggaacaactcttgcatttttatatttcactaaagcttcataaataggagcttttgaatgtttctctttatcttttttatacggagatagattttcattactttcttctttatttatagtcatgtcttctttttcattcatgtaaatcatctcctaatcatatatattacttccgctaaatatttcaatcatttccctgcggagattattttctatttcaagcctttgctttggcttaatttcataaacatctctgttaaaaagataattttgtaattccatatcttttatcaacatttttgtatgaaacaaatttgcttgataaacattaatgtctactgcgtcatatttttgtagtgtttcattatcaatataatcttgtattgatgttatcttgtgatccatatataatttctttccatcaacatcacgtgtaaatcctcttacacgataatctgttgttattatatccgaatcaaagctacctattaagtagttcaatgcattcagaggtgaaacctctccacatgttgatacatcaatatctacacgaaaagttgctattgaattatgtggatgatattcaggatatgtgtgaactgttacatgactcttatccaaatgtgctacaaccgtatctcttgtcgtctgaatatcaagtttatcagttacaattggttccgtattcattctattagtcatagattcttcagcaataagaatagtaacacttgctccctgaggttcataatcctgttttgaaatattcaggacatgtgctccaataatatctgttacatcacataaaatttttgtaagtctttctgaattgtactgctcatcaatataagcaatatagtccttttgctcgcgctcactttttgcatagcacacatcatagatgttaaagctaagtgtctttgtgaggttgttaaagccgtataatttcagcttgttttccaaccctaacatcacagcctttctttataaaattaaatttaaagatatactgattactatatactattttttaagtttagtatttataaccttactattacttaacttatagtttagtttttcttatcttttgacattgtactatatttattgtaaaatttctactatttttttatatttttatttttttgaatatttaataattttacaggatttttatacatttttattaatttaaaacccgatttattttcatttagtcaatttttatttcaaattaaaacattacatcctaatttagaccaatatttttcaaggtaaaaaatttaatttttccttctctttttctctttacaaaccagaattattagtcatacatctttttccaccaagtcaaatcaatattttttatttatttatgttcattaaaagcaaactttttgtttagtttatgtaagttcaaacttttaacatctattacaaaaaaaatgttgtaagcaaataaactcttacaacattttatactattacttattttcagtttttaccattttatttttccaatcccactgtacatttctctctgccaataaaattccacttgcaactgctgtaaatggtgctacagtaataagaccaaagcttcctacaagtgtatgaagtatttctgatgaaacatattttaaatttaatatatttattattggagttccctgtgccataaataccataagaagtccaatatatccacctgaatatgctaatagaagtgttgtcatcattgttcccataattgaacgtcccacattaattccagatttaattgcttctgttcttgttatatctggttttttttcaacaacttctgcaactgctgatgttatatctacagctacatccataaccgcccctgatgatgctataaatatgctggcaataaatatttctgtaagattcagattttcataaccagaatataaaagcatttctgaataggacattacagctccatgaattttaaatctactcacaaagaataatgccataaaacaagttactatgcttcctgctaaagctccaataattcctgctaaagatcttctatctattccatatactaaacctattatcagacatactaatattatagttgttaccatacctattaaaataggattgtatcccatcaaaaacaacggtattaataatttccacatagcaagtattgtaaaaataaatgacagaatagcttttataccaactatacctgaaaatcccacaagaaatatcataaatactccaacaagtagaatttcataattaattctgtaatgatcaaccagtgttgctacccttatttcatcacccgtataatctaatgttacaagaatcttatccccaactgcaaatattttatcctgttcaagagacccagataatctattgcttcctgtaacagtttttcctttaaacttcccctgaagtatttccacctcacaaagctgttcaccagtctttataagtccattatttattataaagctctcatctgtgcttaatacccttgcactaactctctcagtattttcataaatcttttgcggaaatttattaggaacacatattaaaacaacgattgctataagtgtaattaatataggaatagtattacgtctatgaatatctttaagcatttcagtctcctctttattattgtacctttgtaattgattttaatttagcaaatacatctgtattatcataatatccaccaaataaatcctgccctacacctttagccattaaagctactggtacccctgtatgtgaatatgaactgtatgatatacccgatttattatttagaatatgtgtaagagtaactgtaaatggttcatatgatccatacataacatattcattttgatctaaatttctgtcttcttttgcaatcatactcttttcatatgctgctttaatctttgcttcttctaattcagtaagaaccataccaccctttgttgaatcaccttctgatccagctctctttaatccaaattgtgcttcaacatctttcattgcatcatcaaatgatgttttattttctctatacttagcaacagatttatcaaattctgtgtatgatactttttgatttgataaattttgtaaatgtgtatcataatttgttcctgcaaatccaagtgaaagtccacctgtttcatgatctcctgttactaatattaaagtttcgtcagggtgagcattatagaaatttacagcttcttgtactgcatcactaaatgcatttgtatcatgtatacttgatgctgcatcattagcatgacctgcccagtcaattttaccaccttcaaccatcataaaaaatcctttttcattatctaaaagctctataccttttctagtatattcagctaatgttaattcattttcatttctgtctaaatcgtattttaaagctccgctttcttcttctacttcattttctggacatattgcaattactttttcatcaccactgtttaagcttttaatttcctcatttgtatcagctattttatatcccttttcttctgctaactttgcaataggtgtttttccttgttctgtaacttcttttgaagtatctgaaagaaattttcctcctgcaaagtaatcaaaatcactatctacaagttgaagtcccatatcataatattgacttcttgctggtacatgagcataatatgcccctggagtagcatgatctatgtttacagatgtaacaattccaactttatatccaagttgattttttaatttttctgtaattgtttcatatgactttgtctttgtttcatccatattaattacactacttaaagttttttcaccggttgaaagagatgtagctgttgaagctgaatccggacaaatagatgtagaatcatatgttgataccgttcctgatactgggaaattcataaatgatagtttttcctgtgttggataatttccttctgatacattaattgctccatttttttcaacaccattataatattgagctgcctgaatctgtgggtaactcataccatcacctataaacatgaaaatatatttaggtgtctttccattccattttacagttgaagtagttgccgcaccaacttcttgtggtttaatttgagttgaaatcccgtaagctccaccacatattaaagttaatgcaagcatagctcccatgattcttttagctgttttattcatttttatttaccccctcggatttgtagaaacatatttttttcttccttacagatataatataaacctaaacagttaaagcaaatttataatacagttaaaaaatgttgactacatgttaaaactttgtaatatttcttattattaaccaaaataaataaattaatgtaaaaaagtagtattaaattcagttcaaactaaacttaatactacttttacaaactatttatttgttttcatagctttttcttttacaaatttgttatattcctctataggataagtttgaggttctcttatttcctctaagaaatgtgatgcttctgcatctgaattgctaaatgctaaaacagacttatacatttctatagctttattgtaatctctatactcatctttaggtacatatgctcccatatgccatctaatcataaggcattcttctaaagttaactttacaaattgttgaagcaatattacacttttttcaccatgacctaaaggaaccgtttcatttatttcataggatgcataaccaatccactttcctgtcatttcatccttttttaatctcattgtcttttcataaagattgcatttacaaagatcatgtaaatatcctgctaaatatattgtatcattacttagtccaagactatattgtttgtttttttgaagcataagttcaacaacattatctgagtgaaatgctaaacctccatcaaaattagaatgaaattttgttgatgctggtgcaataaaataatcagttctttctaaaagatatttaataagttcatctattccatctctttttatagagcttaatctaccaattattttatcctgcatttcctgtctatcttgagcttcttttgctttagttaattcttttaagtcttttaaatcactcattattattctccttgtctattaccttaaataatcatatatagaaatacttagagtattaagccaaataggctattacttttcccctactataatgattgtatcacttcaccttctaagtgtaaaagtttttataaatacaaaaacccaacattaaaatatacgttaagttaaacactatactatatagtattatgactattacttcacaaataatcataatatgtataatattaaatatactttaatgttgagcaattattcaaactataaaattcattacactaaattatctattaagcattgcagctccaattaatcctgcatcattaccaagacttgcaatcttaatttctgttcttaagtctccagcataagctaaatccttgattcttgcttttaaaggagttgttaagttttcaccttgtttgcatattcctccacctaaaagaatagcttctggtttaaatatgtttataaggtttgcaacacctacagctaaataatctaaatattcttcaattacttcatgtcccgctttgtctccagcttgatctgcatcaaatggcacttttgcattcattttttccatatcaccttcaactaatttgtataaaagttaatccttattttcttcagctttatttttagctgcaagaattaaagcggttgcagatgaatatgcttcaaaacagcccttatttccacaactacattgtcttccattaacttcaataatttgatgcccaacttcagctccacctggatagaatcctgcaaatatttttccatcaataataattcctccaccgacaccggttccaagagttactactatagcatctgaacaacctttagcactacctgcagcaacttctcctaatgcagcacagtcagcatcattagccattcttatttcaaaatcaatttttcctttagcatattctctcacattgaaattatctattctaatattatttgaatatacaataattccatttttatcatcaattgttccaggaattcctattcctactccatttaagtttgtcttgtttaaattgaactcagttattagctcattacacatatcaaaaatatcatcgaaaataggttcaacacctctttcttttactgttggtctgctgattgactttatcatttttccttcttcatcaactaaacctactacaatatttgttccgcctaagtcaacaccaatataattcattttttgtgattccccttaccttaatttttttaatatttttaacattgtttatatacagcatttatgttcccgattttaaggactttaaaagctcttatcttatttacaataattattataccatattacaagttgtatacaattacagaattgttattatattttattattttttatttttattatttactaaatttatcataggtattagtttgttattataaacaaattaataaaaaatacccatttaaatttatatattcatattaactacactttattttatattcaattattctaataattacacaataaaatatatctaaaattaattccattgtatatttaatattttaaaatctataacccataatttaaaattttattatatgaataaactatttctattatttttcaaatgactgtagcaaattgatgtttttcaaaatagattgtagtaaaaagaaatatacagaaggtgattaaatgaatccattattaaatatgatattaggctcacttttccctggaatgggaggtatgatgaataatcctatgggcggtatgggaaatatgggcggaaatcctttaatgagcatgcttatgggtggtcttggaggaggtatgaacccaatgatgggcggtggaatgaatccaatgatgggaaatccaatgaatcaactaactcaaatgatgggtggtcaaagcaataatatgcctaacatgaacaatatgcctaacatgaataacatgaacatgggcaatatgaatccattaataagtatgcttatgggtggacaaagtaacaatggacaaatggctcctaacaatatgaatactcaaactccaggtaataatcaagctcctatgatgaacaataatatgaatatgggcaatctaaatcctttaatgagtatgcttatgggtaacagaaatatgggaatgaataacacccctatgagaaacaacagaatgatgaataataatcaaaatatccctcaaagaaagagataaatttgattgtataggcgtaaaatgcgcctatctcaaaaacagtttacataaagtttattttgtaaaaataatatgatatttcttcccttgtgcaagaacatacattcgtgtataatattatagaatgtatgttcgattttttaattaaggaagtgctgtcaaatggatcttatgaataaattaaaaattctttctaatgccgcaaaatacgatgtatcttgttcatcttcaggatctaaacgaaaaaatacaaaagtaggtataggagatgcatcagtaagtgggatatgtcacagctatacaccagatggcagatgtatatcactattaaaaattctattttcaaatgattgtatatttgactgtatttactgtataaatggttcctcaaaggattttgaaagagttacgtttacccctgaagaagtatgtgaactcacaattaatttttataaaagaaattatatagaaggactatttttaagttccgcagttgtaaaaaatcctgattacaccatggaacttctaattaaaacagttaaaaaacttagactagaagaacactttaatggttacatacatctaaaagcaatacctggtgctaacgaaaaactcattactgaagcaggtaaatatgcagatagaatgagcgtaaatatagagcttccatcaaatgaaagcttaaaactacttgcacctcaaaaaagtaaagataaaatattaaagccaatgagtacaataaaaaacaatatcatacattattctgatatgaaaaaaacaataaaaagcacacctttgtttgtgcctggtggtcagagtactcagttaattgttggtgcaacccctgaaagtgattttaaaataataaatctttctcaaaatctctatgataaatttaacttaaaaagagtgtattactctgcatatgttccagtaatacaaaataataaatttctccctcaaataagccatcctccaatgattcgagaacacagactatatcaggctgattggcttataagattttatggatttaaagctgatgaattattaaaaaatagcaatgacaattttgatttaaattatgatcccaaaacccaatgggctttaaataatttaaatcactttccaatagatgtaaataaagcttcttatgaaatgttgcttcgaattcctggagtaggtgtaacatctgcaaaaaaaattctaaaaataagaagagttcataaattaacttttgatgatttaaaaaaacttcgaatagttcttaaacgatcaaaatatttcataacatgttcaggtaaatactatggacaggtagcttttgatgatgtatctattagaatgaaaattatagaaaacaatttacctaaaaaaaattctataaacccggatcaaatatctttttttgattcaaattcttttgatgaatcatcatacgaaacttcaaaatcaggaataataattccaaaaaatattttgactttacctgaaaaattaacatcaattaatggagagttttagctatgagtatattaatatatgatgattcttttgaaggcttattaacatcaatatatgatgcattttattcaaaacatgaaattgatggaatttacggattgtctcaatataatgcgcctcttctccttggagaaattaaaaatatagaaacagatttaaataaatttgaaaaagtacgtaattccataattaataaaatagatttgctatgttttcaaaaaatttacatggtttatttaagtaatgttgaagataaaggtatggttatatttaaatatctaaaaattgcttttaaatacaaaaaaaatattcacgccttccttcacatagatatagttagacaaatagatgaaataaaaaaaagagtctcttttgaggctcataagtttaaaggttttgtaagatttaagtcaatagataataattttttatattgttctatagagcctgataataatatcttggaacttataggagatcatttcatgaagcgtttttctaatgaatactggattattcatgatatatctagaaataaagcaattatatacgatactaataaatatgaaatgattgaactcttcaaagatgattgtaaaaaactcttggaacataatgatgaatactcttctttatggagatgctattttaaatctactacaatagaagaacgtaaaaatttacgtcttcaacgtcaaatgatgcctaaaagatactggaagcatatctttgaaacatcttaaattataaatactataaaacacatgaaattatctagcaaacctttttccaaataaaagcaatattagctatgactatattaataaaaaatagtcatagctaattaaagtagcaatatttttatatcttaaacttatttactatatcatttaaattcaatgcaaattctgcctgactttgtgctgttgtagctatttgttctatagcttttgatgtttcatctacgcttatctttattctttcaatattttcagatgatttttgcgtagtttcagacatcccccttaccgcttcagtaacttgtccagcggtagcagtcaattcttctgacattgatgctatttcttctgacattttacttacgaaatccgaatctgtatagtatgaatttcccatattaccaaattccttaaacttaggatttacattttcatttacaaataacaaaatctcatttccgttatttgataaattatcaaatgcattttgcacattgactatagtctcctgtatattagcaacagcttgagaagactgttctgcaagctttcttacttcctctgctacaactgcaaagccttttccttgttctcctgcacgtgcagcctcaatagcggcatttaatgctaataaatttgtttgctctgatatacttgcaatagtatcagccatgacctttatattatttacaactttcccatcctcaatggcttttaacattttactcttcttctctgaatataaattatcagcctcttctatagctttttcaccttgcttttggactataagagctctctctttaaattcatttgcattattgctaccttccatagctttttctgaaagttcatttactgttgtatctacttcttcaatagatgcagttatttcttctgaagaagaacttgcttcgaccatttcatttgttatatctactacagcttcgtatatttcttctgtttttgatgtaatttcttccacagtagccgataattcttcactagatgaactcatatcctgtgacttttctattataattttaattagattacttacattttctattgacttattgagagcagttccagtttgaccaaactcatccattgctgttacaaccataggtactgaaaaatcaaattcagccagatttttagcaagtgctgttattttagataaatttttattaatataatttgatattataaagccagtaccaattgctattaataagccaagcaacattaagcctttcataatgttattactctttaaatacatagcctgattatctaaattaaattgtttagaattaacaagatttatatctattaacttattgatattattcattacttcatctaagacagccacaagctgctgatattgttgagctgcttcatcatatttactctcatcaataagtttaagaacctcatctctcgagcttctaaattctttaagtttatttttatatattggcattatttctttttcttcctgggtcattggaagattttcatattgttcaacatttttattattcttatccacattaatctctatatcatctttcaagtcactttttctatcttcattttttatgaaaacaagttcaatgacatcactttttacagatattagactttgtttaatatctgcaagaagatatatactttgaagattattttcatacatggtatttgaattttcagctacagattttaaggatacaataccaattgttccaactaatgctattaacaaagatatcgtaataaaagataccaacaacttcgttttaacttttgtatttcttaagaccttcataaaacacctctcctgtaattctttttttctgttttaataaataaaaaaatattcttataataataataacgaataaatactaattattatttatttttagtataacaaaaccactctatattttccatataaaccaatattatagattttaaaaaaattttaatttcacaatatatccattaaatatttatttaattatcaatttcttgcataaatttaaacttattattgaatttttaacaaataaaattaatagcaacaaaaaaaatgtgaatccactaaggaattcacattttctaaatatatgaattataattttccacctgaagttgcaataccttctataaacttcttttggaatacaataaaaattaaaagcattggccatattgcaagtaaggaacctgccattaattgtggataatttgttgtaaactggccttgaagtgatgcaagtcctgctgataaagtcatcttgtcaagtgacatattaacaatcaaaggccacattaaatctttgaatgcaaacaatgctgtaaatattcctaaagctactaatcctgatcttgaaagaggtaacattattttataaaaagtctgccatgtattacatccatctagtttagctgcttcttctaaatcttttggaagtcccataaagaactgtctaagaagaaatgttccaaaagcacttactattccaggaactatcaatgctgatactgtattcaataatcctaatttttgtacaaacaagaattgtggtattataaatatttgcgaaggaatcatcatttgaaatagtactaaaccaaagaatatatttttccctggaaagtttaatcttgcacaagcataagctgccatagcactgaaaaatactgatccaataactcttcctatcaacattaaaatagtattaatatagaactttgaaaaaggtaatatatttaaaacctctgaataattattaaattgtgggctgccaggaaaaattttaggtggcacttgtactgcttcacctactgtttttaacgatgtcaataccatccataaaaatggtaatatcataataacagctccaattattaaaattatatgaattaataagctactatttttaatctttgctttcatgattatcaccctacttcctctagtaatttacccatttttcctgtactttaacttgtaccgctgtaattatcataataattactagtagtaacataacaattgctgagccgtaacctttatcattcattacaaatgaatattgatagaataaatatactaatgattgtgttccttcaagtgctacacttgttttgtctatcatcatgaatataacatcaaatacctgcatggcacttattatgcttgtaactactacaaagaacatagttggtgaaactaatggtaatgttattgtgaaaaattgtcttattggacttgctccatcaatacttgctgcttcataataatctttaggaatttcttgtaaaccagctaataaaagtaccatattgtatccaacactactccatattcctactattgcaatagatatcattgctattttaggatcactaagccactgtggtcctttaattcctattatcgataataagtaattaattagtccgaattctgaattataaagccatctccataccattgcaattgcagctggtgctgctaccattggtaaaaaataaattgttctatacagcgatactccttttatctttttatttaaaaggactgctacaatcaatgaaagtataacagttacaggaactactataatagcatatttaaaagtattaacagtagctcctaaaactgctggatccttaagcattttagtataattgctaatccctacccactgtccatctccaaaagctccaactttctgaaagcttaacatgaatgtttgaattactggaattatattaagtataagtaatcctataagtgttggtgcgatcataaaatatgcccatgcacattctttctttgaatattttccaaatagtagcttactatttttctttttttgtttattatctaatccaaactccataaattcatacctttcttaaatttatagtagtatatatgtgtttatgtacttatacataaacacatatatactttttcattttttcttaattatttctcatttataattgaattcatcttctcttctaattgtttacacccttcatcaacggacatgtctcctgcgaaaattttcttaaggatattattttcttctgtttcccatttagaattatttttaatgtatggttttatagttgcataatccaacatttctgtaaatactgataagttaaatttatcgtttgatttagtccaagcctctgatgttccttcatatgcaggtattgctgctccgctttctgcttgaatcttattagctttttcagatcctaggaattcaacaaatttccaagcagcttcaggattttttgtcttagctgatacagagtttccaagcccattgaatacagttcctcttgtttttccttctggtaatactgcaacattacaattagctgatgtatattcatttgatgcaaattctgctgacatccaagaaccaaataatgccatagcagtttttcctgattcaaataaagttattactgggttttctgcaaactgactttgatttggcgaaacaccttcctttaaacttaaatctacataccattgaagagcttctcttgtttctggtgaattatattctgatttacttttatcttctgataaaatctttccattattttggaatacataatcgtatataccttcatgagtgtttaatggtgctgataatccataaatacccttatctttattagttaattttttagcattttctaataatgtatcccatgtccaagtttcatctggatatgatattccagcttcatcaaataaagttttattgtaccaaagtcctacagtatcataatctttaggtattgcataatttttcccatcactcttatataaatcaactaagtcttgtggaaacttattcaaatcaaccaatgaacttgatgagattttatctgttaaatccattattgcatttccacctatatacttttcaacctgacttgcatgcatccaaaatacatctggaagacttcctcctgttgcagccgcctccatttttgtccaatactgatcccaaggagtaacttctatatttacttttattccaggattttctttttcaaattcatctgcaatttgtctcatacccggttcttgtattttatcccaaatactatatgttatagtagtatcaccagattgactctttgaggaaccagttccaccacagcctacaagcatactcccaataactgttgtcattgcaatacagctaataattttcttaatattttttatcataattgtacccccgcttttttatatattctattttctaatattttagttatatatttgtttcttagtacaatataactatattatatattcatgttttttgaaatggttttatgtaatcgttttatggttaaatgtgattcacatcgaatcttctataaggaaacatttccatataatgaatattaatacttttttttataactcgttactttaaaaaaagtactgctaatatttttagcaatacttttcttatattatctatttttcaactttatttaatatccattgacttgctgcataatcacctttaagctcaggaataaccaaaccaatgttcattagttcatctcccctaacacgatttgtgttccatcaatctcatacttttcatcataatctaatccttttaattttaatggtttattccacatattaggttctgcaaactgctttacataacttacaactacttgcgatctatctttagaaatattcatccacgcaacttcatttccttcaaatggacttgataatctataagaatttccaaattgaactgtttctcttattttcttatataaagttacttgttcctttattgattctttttcttcattacttaatttagtaatatcaagttcatatccaaagttcccagccatagcaactattcctcttgtttcaatagaagtatttctatgaacctgatgatttggaactgctgatacatgacatcccatagatgaacttggatacactaaagatgttccaaattgaatttttaatctttctattgcatcagtatcatcactagtccatgtttgaggcatataataaagcattcccggatcaaatcttccaccaccacctgagcagctttcaaataatatattagggaacttacttgttatctcttctaatattctgtataaaccaagcatatatctatgtggaagttctctttgtctttctgaacttaatcctacagaaccaatttcactcatattcctattcatatcccatttaacataagaaatattagcactttctaaaatatcacttacagattttattatataatcacaaacttctcttcttgataaatctagtataagttggtttctagcttcatttctaactctaccaggtatgtgtatacaccaatctggatgtttttcatataatttacttataggcgaaaccatttctggctcaaaccataatccaaattccatacccatttcattaatttccgaaacaagttttcctaaaccaccttttaatttttcttcatttacaaaccaatctcctaaagatgaatcatcattatttcttgttccaaaccatccatcatctagtacaaaaagttctattcccaaatttttagcttccttagctatttcttttatattagtttcattaaaatcaaaataagtagcttcccaattgtttataagaataggtcttactttatctctaaatgttcctctacataaacgtttttcatataacttattataagtctgtgacataccagttaatccattttctgaataaaccaataccgcttctggactctgaaattcttctttactttctaaaagccaattaaagtcaaatggatttataccaatttgtgctctcgatttaaaatacatatcaacttctacattagctaagaagttaccactataaacaagactaaatccataaacatcccctatactttctgttgaattttttcttgtaagagccataaatggattttgtgcatgactacttgctcctcgtctactttcaattgattgacttccacttctaagactagtttttacaatatgtctttctcttgcccatgcccctgataagtgaataaaatcaaattcatcatccttaaaatcaacatttgcgcttaatactctttttatgttaactttttcttcactatcatttattatctttacatttttagttattgcatcaaattcattaaatatagtataactcaaaacaagttttatattttttagagaatccttcatatatatttctaaagtttctgcttcatcatcattttcaacataagttgcaggaagattttcaattctaggttttccctttattattttatgaccatcatatctaaaatctgtaacacttgttccatcttcaaattgtaattctatagctggacttcttaaatcagtacttccatatcccggatattcctgtgcagttgcttctaattgaaacgtatctatattatcagtattagctaaaaaacttccccaaagatttttttctattaaataatccaaattatttgtatttaattttcttccccaatataggtgcgttaaatggcctgtttctaatatcttaattaaataactcacatttttatttttaatatgaaatgttttactatttttttcaaaatttattaacataattcccctccattttgtaatcattttcacatatgtgtaaccaatatacaaatactttatataacaattatttttgtatgaatcaattataatctgatataatactaaattatatggtattatgtaaattacatatgtagaaatgtcatttttcacatttttacaaaaatataagggggtttgaatttgattgaagtaaaatattttgaagataataaatgtaaatatctcgaaccaataaaaaagcaatctgtagatttatttttatgtttttgtggaaaagagcattgtgcagcaggatattcatatggacctgcagttcgttctcaatacgtacttcactatataatatcgggaaaaggttcctatactattaataacacaacatatacacttcataaaaatcaaggctttcttattccacccgatacagtaacttattatgaggctgataaagaagaaccttggaattatatgtggataggttttaatggagttaaagctgaaacatacttaaattatgcaaatcttaatgaaggcaatttaatttttgaatattctaaggatgatacgttaaaaacgtatattaatgaaatgttaaaattaaaagaattaaatttttcaaatgaattaaaattagaaggattattatatatgttcatgtcatcacttgtcagttgtaaaaaagatgaaggaagtacaaaatcatttagaagcactgaaatttatttagaaaaatccatagaatacatagataagaattatgctgataatattaaaatcaatgatattgcaaactatattggtataaataggagttaccttacccatatttttaaaaaaaatataaatatatcacctcaggaatttctattaaattatagaatagataaagcatgtgctttattaaaaagttctgatttgtccgtaaaggcagtttcaaaatctataggatactctgatcctcttaccttttcaaagatttttaaaaaagtaaaaggagaaagccctaaaaattatagagaaaaattttcatctgctgtttttattgaataattcaaaatatatatttatataaaaagagaattcagtttttatctgaattctctttttaaaatcatactaaactcttactcaatagtaaaatcataactctttaaatcagcttttaaagttaatgaatattctccacattttcttgttataattaggtcgcttccatgagtttctgtaatacattccccatctaatccaaatgccttatgtgaattacgaagttccataagttctcttatatctctcactacttttctattttctatgttttctttaatttcttcttttgtataataatgacggttaatatctcttccgttttttgttgattccattaattcaatatcattttctcctgcaagcattccaacataatataattgaggtatacctggagcaaaaaattgaattgcacgtgctaaaagatatgccttatcattatttcctagtgctgagtaataagtacaattaacttgatatatatctaaattattatatgctgctgtattataaatcttttttacattagcgccttttgtaaacatcgcttcttttgtttcatgaatttcttcatcagtcattaaatccttaacatctactataccaattccatcatgtgtatctaatgttgtaaattgtttcattggactcatgtcaagccatctttttaaattattaccatttcctgaatacaaagcgtttaatactaaaacaggtaatgcaaaatcataaatccagaatcctttttcagctatcttatgctgtattgtataatgttcatgaatttctggcaatatatctactccatatgctttaactatgccttgaatttcatataataattcccacatttcaggttcaataaagaaacaactagtcccaggtttctttattgcatatgcaaaggcatctagacgtataatgcttgctccatttttgcacatattaattaatgtttcttttatgaaatctcttgcaacttttgaatccatatttaaatctatctgttcttctgcaaatgtacaccatactttttctctacttccatctttaaattctacttcataatatggagctcttggctttctcttatatattaaatctacttcttcatgtgttggttcaccatttttccaaaagtctttatatcttatgaaaaaatctttatattcagattcatcctttttctctgtaaaatctttaaaataatctgattgtcttgaaatatgatttaccataaaatcatacatcaaatacttattttcacttattgattttacatcattcatatctccaaaagcttcatctaccacatcgtatctcataggagcaaatcccctatctccagaagaaggaaaaaacggcagtatatgaactcctccaactgcttttgaataataggtatcaataatatcttttaaatcttttaaattttcacctaaactatctgcatatgttattaacattatttcattttttatcttatccattataaatcatcctttccatggtttaaaatcgtttacttaactctgattatataatcactttttatatattcaaatatttttatgtattcaaaacatggataaatgttatttttattttagtaatcgctttccgtaaatattcttaatactataattttttgtattaaaaaaactttatatacctactctataactatgcctcttcattttttttaatgattttaactttaatttaagtagataccaataaaaattttttttattttttagataatagtatttacttttttatagtaagcggttactataatagtataaatataaataattattccaaagggggatttaaagatatggatattatcaataacttaaaagaacaattcaaggaaatttttaaaagggactctgaaaatgttttcttttcacctggaagagttaatttaatcggagaacatacagattataatggaggtaatgtttttccttgtgctttaacaataggtacttatggattagtagctaaaagagatgataacaaatgttttgtaaactcattaaactttgaagatttaggaacaattgaatttgatttaaaaggtcttgtaaacgacaaaatacatgattgggcaaattatccaaagggagttataaaaacatttgaagatcatggattcaaaacttcccatggttttgacatacttttctttggtaacatacctaatggttctggattatcatcatctgcttctcttgaagttttaatggggtgtatccttaacgaatcttttggatttaatatagatatggttgaaatcgtaaaaatgtgtcaagaagcagaaaataagtttatcggagtaaattgtggtatcatggatcaatttgctatcggaatgggtaaagaaaattgtgcaattttactagattgtaatactttaaattattcttatagtaaacttgatatggatgggtgtaaaatagtaattggtaacacaaataaaaaacgtggacttgctgattcaaaatacaatgaaagaagaagcgaatgtgaagctgcattaaaagaaattcaagctgtaaagaacattagctctttaggagaacttactgaagaagactttgaagctgtaaagtctaatatttctgatcctataaaagtaaaaagagcaaaacatgctgtttatgaaaaccaaagaacattaaaagctgttaatgcattagaaaataatgatttagctttattcggacaacttatgaatgcatctcatgtttctttacgagatgactatgaagttacaggtatagaattagatactcttgtttctctagcatgggaatgtgaaggtgttattggtgcacgtatgacaggtgcaggatttggtggctgtactgtaagtattgttaaggaagaatgtgtagataactttatttctacaattacacctaagtatgctgaaaaaatcggctatgaaccaagtttctacatcgtaagcatatcggatggtacaagaaagttatcataaagttcaaattataatctataaattaatttaataaagtaaataaaagggagtgtttattatgtcaattttagtttgtggtggtgcaggatatatcggttctcacacagtgtataaacttatcgaacaaggaaaagatgttgtaataatagataatttacaaagcggtcatatgggtgctgttcatccaaaggctaagttttataaaggtgacatcagagatgctgctatattagataaaatttttactgaaaataaaatccaatcaattgttcattttgcagctaattcattagttggagaaagtatgattaaacctcttctttacttcaataacaatgtatatggaatgcaaatattgcttgaaagcatggttaaacaccacatcaagaatatcgtattttcttctactgctgctgtttatggagaacctaaaaaaattcctatattagaagatgatgaaacaaacccaacaaatacttatggcgaaacaaaacttactatggaaaaaatgatgaaatggtgtaataaagcttatggaatcaactatgtagctcttagatactttaatgctgcaggttcacttggtgatggaactataggtgaagatcacaatcctgaaagtcatttaattccacttatacttcaagttccactaggtaaacgtgaagctataactgtatttggaagcgactaccctactccagatggaacatgtttacgtgactacatccatgtacttgaccttgcagatgcccacataaaagccgttgaataccttgaatctggtaaaggaagtaacgtatttaacttaggtaatggagttggatttagcgtaaaagaaatgattgtagctgctgaagaagcaactggtcaagacatcaaagttgtaattggtgaaagaagagctggtgaccctgctcagttaatcgcctcaagtgataaagcaagacatttacttggatgggttcctcaatatacggatgtaaagaaaatcattaaagatgcatgggcattccacactgctcatccaaacggattcgaaaactaattcaattgacaattgacaattgacaattgacaattaaagttctaaccaataattgttatgttgtttattgtcattgtccatcatactaatggaggacgattatgattaattatgaaataaacagattaataaattttggactacaacaaggtcttattcatgaagaagatacaatctatgcaacaaatatgctccttggcttattaaaagttgatgaatttaatcatgaagaaataaatgaaactttaaacactccaacacctattttagaaaacatactagattatgctgtttcaaagaacatgcttgaagatactgttactgaacgtgatttattagacactaatataatgaattgcttaatgcctagaccatctgaagtaatcgaaacatttaacaaactatatgatgattctaaagaaaaagctacagattactactacaaattaagcattgcttcaaattatataagaaaagacagaattgacaagaacatggtttggaaagctactactgaatatggtgatttagacataactgtaaatctatctaaacctgagaaagatccaaaagaaattgcaaaagcaaagtcttttaaatccacttcttatccaaaatgtctattatgcaaagaaaatgagggtttttatggtcatatgaatcatcctgcaagacaaactcatagaataatccctatgaatcttggatgtgaaaaatattttatgcaatattcaccatacacatattataatgaacattgtataatctttaatagtgaacatgtacctatgaaaataaacagaaaagcatttgcaaaccttcttaattttgttgatgtattacctcattattttgctggttcaaatgctgatttacctattgttggtggttcaatactttcccatgatcactatcaaggtggaagatatacatttgcaatggaaaaagcaactgttgaaaaaacttatactattgaaggatatgaagacataactgtaggcagagtaaaatggccaatgtctgtaataagattaaatggtgatagcaaagaaaatttaacaaatttagctgaacatatcttaaacctttggagagaatattctgatgaatctgtagaaatcttatgcagaacaaatgatgaacctcacaatacaataactccaattgcaagaaaaagaaatggaaaatatgaacttgatttagttcttagaaataatagaaccagtaatgaatatcctcttggaatattccatcctcacaatgaagttcatcatataaagaaagaaaacataggtcttattgaagttatgggccttgcagttcttcctgcaagattaaaagaggaacttaaacttttaaaggatgcattaataagcagaattactgatatttcaaataatgaaagcattgctaaacacagtgactggtataaataccttttatctaaatatgaatctattactgaagagaacgcttatgacatattacaaaaagaagttggtataaaattctctgaagtattaaatcatgctggagtatttaagagaaatgaaaagggaatgtctgcttttgataaatttatagctaccctttaaattaattaaaagttgtcagttagcaattaatgtgcttaacagtcagaattttatttattataatgtttatagaaatcttcacagaagatttcatcctttgactattaactgttaactgataactaactaagttttcttttacaatataaaaataaatcaaaattaaagggcggtaatcttatgaaaataacaatccaggatgtagctgaaaaagctaatgtttcagttgctacagtttcaagagtaatgaatggaaattatccagttaaagccgaaactcgtgaaactgtattgaaagtaataaaagaactaaactatattccaaacatgcaagcacgtgaacttacaaaacaaaaatcaacaactattggtgttgttgttcctagtataaacaatatgttctttacagagctagtttatggaattgagaatgagctaaaaacaaattccctctctattattcttgcatgtactaatggtgattcagatgaagaacaaaaatgtgtaaataacttaatatcacgaaatgtttcaggaataatagtagcaggacctggcactgaaaatattaaagctaaattctatgataatatttcccataagattccacttgtgtttataaattcagaatatatggattcaaatatttcttatgtatcaaatgatgaagcttcaggagctaaaatagctttaaactatcttttagataataatcacaaagatatactctttgtcagaggaaaagacagttactcatatgatataaaagaaaaaatatataaagaaattatggctaaaaattttgattcttcaaaaattatcaacattggtaatggtaatacaagtgatactgtggataacaccatgaatatcttccttgatattttaaataatagctcttctacagcagtatttgcttgcaatgatcttatggcagttggtgttcttaatgcgtgtaaaaagttaggaataaaagtacctaatgaaatttcaattattggttacgataatattcctttaagtaaatttgtagaacctaaattaacaacaatggatcaaaacatgtttttccttggtgctaatgctgctcaattgctcgtagaaaaaatagactgtgataataaatttagtaaaagaatcatactaaataactctttagtagaaagagaaactgtaatctctatttaaaatcactataggactttttagaaaaattaaagatatagcatattacataaatcttattcatcttaaattactatttataaaaaaacaggaattatgaaatttcataattcctgttttttatagtacaatatataattttttatcacattaaactctacatcatctatttttatatctagacaattaaaatctaaaatcacgttttccgctatcgatatcatttatatgctcttgtgcaatctttcttaccttttcatttggaattttaagaagctcgtcttctataagtttaattccttttaattttgtctcttcacttgcatagtcatcaagatactcccttaacgtcattaatgcattaggatgacaacagtttgatatctgtccagctttaacgagagtcatgaatctatctcctgttcttccttctctataacatgctgtacaaaaacttggaatgtatcctaattcaataagccaatttactatttcatctaaagttctattatcacttacatcaaattgtgcagaattatcttcttctttttccttttcaacatatccacctacacttgtacaagaacctccacttacttgagacactccaagttcaagaactctttctcttgttttttgagattctcttgtagatacaattattcctgtgtatggtaccgctactcttaaaactgcgactatcttttcaaatatctcatcacatataccattatcaaattcatcaggatttatatcatctgcaggtcttactcttggaacacttaacgtatgtggtccaactcccttagctgcttctaaatgttctgcatgcatcaataaacctacaaaatcatatttatataaatttaatccaaataaaacaccacagccaacatcatctattccaccatccatagctctatccatagcttctgtatgatatgcataatcatgctttggacctgttggatgaagttcttcataagcttttttgttataagtttcttgaaataatatatatgttcctattcctgcttctttaagctttctataattctctactgttgtagctgcaatattcacattaactcttcttatagctccgtttttgtgtttaattccatatattgtttttatactttcaagaatatattctataggattatttactggatcttctcctgtttccaaagctaatcttttatgtcccatatcttgaagtgctataacttcatttttaatttcttcctgagtaagtttttttctccttatgtgtttgtttttatgatgatatggacagtatacgcatccattaacacaataatttgaaagatataaaggagcaaacattactattctgtttccataaaacttctgctttatttctctagcaagcttgtatattttttcattttcttcttctaactcacattcaagaagtaacgctgcttctctatgtgaaaggcctttacaatttttagccttttctatgactttatttataagttctttattacttttattttcttctgcatatttaagagttgataaaatttcttcatcattaataaattcagttgccacacttgacataacgttatacatactattgcacacttctttcttttaaatattttttgtataactcatcctgattgaactattatcatctcaaattttagcggaatattttaatttttaatattgaaatattacttcttggaatacattgtctttacactaatacctttaatcatacctaatttcccagataaagaacttataacatcattactggcatcaataacaatgcttattacacacacatccttttccttatatggaatccccattcttcctattatgtatgtactatattcatgtaagatgagattcaatttttctatttcatttgaatcctctacaataattccaattagtgcgattctagtctccatcatttcacccctgcacatataaattttactttacttaatattttttccaataattcttcaaaaaaataatccccatacttaaaataagtgcagagatattaatattaaaatattcataactaccgccttgttatttgggattaatcccctcatataatcagaacgacttttattttataatgaccttttccatcagcttaatctttaagtaaggccattttgattctaacatatttttcttattttttcaaattatacattagttattaatcttttattttctttagtgtaattttataaatctataaatattttctcttttctatataataaaaaatgctgaaaattcataaattctcagcatttctcttttataaaaatttaactatatccatgcaccacttacatctaaattatatccatcaattattgtattataagccatagacccatcagaatatagataataccaaattccgtttacatccttccatcctgttgccatatctccactttcatttaaatagtaccatttattattgataaactgccatcctgtcatcattgaaccagtattattcatataataccatgtattatttatctgtttccatcctgtattcataacaccattatcattcataaaataccacaagttatttacttgtttccaacctgtaactttatttcctttctcaacaaaagtccaagtaccatctgaatttaaattccaaccttctttatctaacttagattcagttttctctggaatattattatttgtaactttattttcagttactgaatcattgttacttgatgtatcattagatacagaatttgatgaattatgagaatgatgtgatgaagatgagctacttattcttgaagttgcttgtgaatatacttcattgccatctttatctgtaactaatactttaatatatttgctcttatcactgcttgttaatttatattgactatttacagcaccatctattttttcaaattgtccactttgtgatgatgccctataccattgataagaaacttcaggagtaatttcttttccatctgcattaaagatttgtgtttttaaagtattacctactttgaaagtcccatttattgaaaccttttttactttagatgtatcatcatctttatcaggattttcacctgtatacttatcccatgttccattactataaatcattaattctccagcttttatttttaaattttctgtttgaacagatttctctgttgtttcagttccatctacagaaacggctgctgaagttgttactgtaccattgaatattaatgtagaatttttataacccttagggaatgtatagctgtataaatcatttccttcagatgtcaattctactcctggccattttgaaaattccttattcatacttccatcagatttttctgtatagaaatatactcttaaattttcccatccatctttgttttcaaaataagcttttgttaacttgtctgaaacgtcatcatcatttccttcatctggtttatctgtatctgttcctgatggtatatcactctttgcaaagtctctccattcaccaccaagtccaccttcttgtgtctcatcatttcctataaaaattttagtttcaccatctgtaacttttactgtttttgtttgttcacccttattgttattattaaatataacattagcattttcaaatccttctggcaatgttaatccatataagtcatctccataataaactgatgattctccaggccatgttgtggaacttcctccatcaacccaatagtgaactcttactttgtcccagccataagtatttttgaaatatactttactcatactctttaatgaatcgctctcttcatcataaatcatagtattccctgtttttgtttgtaagtttcctgtttgatttccagttccaccagaaccattattaaatattactgtagcactttcaaatccctttggtaatgagtaactatataaatcatttccttcatcttttgcactttctccaggccagtccttaactttttcacttgttccatcattataagcatatacttttactttttcccatccagaagtatttttaaagtatacctttgtaattccttctttatcattttgaacttcaggttcttccaaatcatctgtagtataatctctaaattcaccattatcataaatcattgctttttctgaaggcaactttaaatcatcagttttattagatccatcattaaatataatatttgcatctccatagttttctggtaatgtataagaatataatgtttctgttccttcaaccttagtcattgaaataccaggccattttgccacttcgcttgaatcatctttccatacatatatattaggttctttccaatctgctggttttctaaaataagcttttgatgttccattaaggtattctttccattctccatcgtatatcatagttgagtcttttggagccttaaaacctgtatctttaggaacttgaacagttcctccttttgcattgaaaagtaccattgatccttctaagcctgccggtaaagtataagtatataatccttcctttccttcaaccttttccattggtactccaggccattttgctagttcttgtactccatacatatatacatacacatcatcataatattttccactttcatctttccagctttcagggatttgtatatatacctttgatgtaccttgtttttctatgtctggagtaacatttggatcttcagcaataggctgagtttcagtccaatttccatccttgctatatttcatcattccatcatactttaaatttaatgatgatgtttgatgtttacctgcatatgaatcattaattataacatttgaatttgtccaatcctttaattcatatttataaagtttatcacctattttggtcattttttctcctggccatgccttattttgttcattaacttcattcttagcataaacatataaaggagtatcccaatcatcaggcttttcaaaatatacagttgctgtacttcctacagcttttttaacataagtataagtttcttttgcagttcttgttccatcagcattagtagcttctaatgtcaacttaacactttctcctggtgtaatatcactgcctattgtaactttcatttcatcaacatatggaacttttgctccatcattaacagaatatgttgcattagttgaattttcaactttaagtatcaaatcaagcttatcttgaaaagattgattttctttatctactgaaacaactggtgattgaacattttcttctttttgtccatctttatataaaactgtgattccctttttaataactcctgatattttaccttcgttaacagtaaaacttgaatcgttaactccacagttatcataagtcccattttcaagatttacatctaaccctgaagctgtgtaatcttctccaagattaacaataacaactcccttagtttttgaatcactgcttgtaccacgctctatcatcataatttctttatttatttctactaacttttcatcttgatttaacatagcatttctaaatttattaactgctaccacatcaggattcctccagttatcatcaccacaatcacctattgatccatctaactttcctcttcctgctggtctgttaaaaaacaaaggatttgcatatgcacgtgatgctataagtgcccatccatttcttatctgttcatcagttaaagctgtagattcttctgaatcgtttgcatacgtgtcatgtgattcaacccatgatataagccttttaggagataccccttctgagttgtaatcttctatctttgaaacatctggatttccatttaatccaactgcacttcttacacttcctccataattacttgaagttaaattaatatacttagaatattctttaaaattatccgctccgccttgtaatacttcaccataaatatatggggtgtttccatcattagtctttaatccttctaatacattaggccaaaaatcactctttactacttttccattatcatcactctcagttggtaatccaacatgcttagcagtgtcaaatctaaagccatccgctccactcttaagacattgttgtaaatattcctttgccatatcctgtattttatgattttccgtatttaaatctggaagtccaatatcctcttgagttacacaataacgactattccagctttcaacaggttttaaactatgccatgcatcagcacctaaatcttttatttcttgatccacattttctgatggtgtatctgcattagaaccattattaccagtatgatttacaataatatcaacaattatgtcaatacctttgctatgagcaacttcacacatttttttaaattcttcttcggtacctaattgtttgtttccaattttaaaatttattggttgatataaaacccaccacttctcattacttgttatttcaccatttatgtctatattaccttgtattggtgatacttgaatagacttgtatcctgcttttgatattgcttcaatattatttgctatgttattaaatgaccagtcccatgcatgaagtattgaaccctgttcttcttcatatgtcaatcttgtactttcatcaacctgactctcctgaatggtatctgcatatgccacaagacttaaattaggtgaaaaactcactaaactgaaaaaaacagtcccaattgcaaccaatttcttaatcttatttttaaccacttcacattcccctaaacacataaaactttatcggtatcgtttccatttttcattaaaataataaatcaccacacttctataagttttttaaattggagtagttttgtttacgatttcatattttatatattaatcctaaaaatgtattttttcaatttaatttattatttttgtaaaatattacaaaaataataaatcgatttataaatataaatatctataaatcgattcttagttactaaaacattatttaatagcttactacaagtccaccatcatctgcataaattgtagttaatccgccaccctcaaatattaatacctttttaaaattatatctgcttaaaatttcttcttttaatttcaatgctctatcttcagagttaacatgagagattgcaagaattctttcttcaaaattttcacattcttcgcctataatttctaataatctattaaatgctttctttcttcctcttacttgttctttaagtataatttctccatccccattatcacacataattggtgttacttgaagtaatgatccaacaaaggcttttttactgcttatccttccatttttagctaagttgtccaactttacaggaactaaaaatgtcttcatttgatctatgtaattatttatatcctctattattttattcttttcaactttatcttctatcatggtttttaattttaaagctacaagacttgcaccagcagttgctgtcttacaatcaaaaatatgtacaaaggcatcttcaacctcttctttaaacatattagctgctaataccgcactattgtgtgaaccacttaatttttcggaaatagtaataacaaaattttctttacatttcttaaatgcttctaagaactcatgtggagaaggacaggctgttgttattttattttttgtagccttcattttttctctgagctcctctaaatcaatatttttatctatcatttcttcattttctattatgattttgaatggaactctctccatgttttcttcatgaccaaatacgtctttattatgatcaacacagctgtctgtaactattctaatattcattaataaccctccacttaataaatatatttttcattagttctttcaatcaccttataaatatatttacatgcaatttttatcatattaacactttgttcatttattattgtcacttaattttacactatatattatagttagcacaattattatttctattaatttaataatattttactgaaaattcttatattatgataaattcttagactatatgtctaaaaaagccaataaaattagtttgaagcatatattttgtactctaattcctattcttaacaatataagttaaattgaatttatagtgtaaaaaatatggctcaacaccaaaatgtgttcttgacagcattaagctgtcaaggcacgtttattgtattataagaatttttttgcttaatagtaatctttattttatcgatttaattttattattcctattttcaactggagcattaataaatctatataaatcataatttatgattttctgcttccaattttcaaaggttttaagcgcaacatctacttctgatatatttaatgatttaccatcaataaaactatatttaaatgtaaaattaagcatgcaatccttacaatataatcttattttaggtaataataagattatattgccacacaaaggtagatgtcttactcgtctatgacccgaactaccttttcttataacatttgtattattgcaacaaggcaactttgtatataagttagtggttctaatatgatttctactgtattatcataaacatctgaaattttaacaatatttatatcttgcaagtttagtaatttattgatatcctttatatgcacttatttatcctcttaatcgtattgtttcgcaactatagattacaggattttaagtgcattttttatctataaatattggtaatttagttgtcaagcgcagtttttagtgttgagccttataaatcaataaaaaattccgaggtttaaaaaataaatctcagaattttttattaatttatttacattttttattatcctcaacagctctatttatagcttttgctacaccaagattatcatttgtatctgttatatatttagctattttctttatttctgggactgcattttccatcgctacactttcctcaaagacttcaaacatagagtaatcattaaagctatctccaagaaccataacttcacttttatcaattcccattttttgtgcaacttttgctaaaattatacctttttgtgctgtcatatgagtcacttcaacattatcaacaaatgatgatgaaacagcaattcctgtaagttttcctatttgactcttcatttcatttatcaattcaatatcactatgaaaagcaacaaactttcttatttctattccactatttaaaaactcttcaatgtcatctatgtatttaagctgaataaaatatggctgttttttagcttcctctgttgcctcatctaatgtcatattaggattaaaagacattgttctatatgtcatttcttttaatgcttcttcttttgtatcactggtataaacacctttatctgtaaatattctagcagatactttatttttattaagtatctctataattttagatgctatttctatgtctatatttattacctcaacaatatttccatcttcatctctatactcagctccattcataagtacacactgacatcttatattatgtttttttagaaatggctctacattgtcatactctctcccagtagaaattgcaaatataatccctgaattttcagcatttcttatagcttctacactctcttttgcaatttcatgcttgctatttaataatgttccgtccatatctgatgcaataagtttaatcaaatgaaatccactcctctgtttattatatgtaatattttattaaatcttctctttactattttatcatattttcatttatattatcagaattagtgtatatagttaatgttaactttatgcactagtgatataatatatgaaactatcatatttgagggggtaaatattttgacatacaatataaacttaatcaaaaatatagactacacaccaacatactggtctggaggaatggcatctgaacttattacatatccaatagattcttcatttgcaaatagagattttttatggagaataggatgtgctaaaatagatattgatacttcgatcttcagtaatcttccatccataaaaagacaccttatggtaacagatggagaaatgatattaactcacaaagaaaagtattctaaattattaaaaacttttgatcaagatttttttatgggagattgggacacatcaactgaaggacgatgttctgttcttaacttaatgactcaaaaaaactatgatggaacattgacacatataaatctaatcaataataatattattaattttaactatagtcatcctgaaaatagtactcttatttcaatctgtatacattctttaaaagaacatattctatgcgaaatagactcacaaaaatttcacatagaacaaggggatttattgtgtataaatatatcaaatcaagatatactgcctgaaataaaattaaaatcagatactacttatgatggatcagatataattatatgcacaatattcaaaaaataatttattattatctgaattgaaattatactaatatacttatctaaaacttataaaaatacatcccgaatctttaataattcgggatgtactctatttatttctaattaacctgcaaatgtttgtgtacccatatactttccattacctaaaagtacacctataccaactttagtatacgaaggattcatcatattttctctatgtcctgctgaattccaccattggttaaaaagttctactggatcagttgtattgtatgctatattttctgctgtagaattatatttatatcctattgtgttaagccagttagtccatttagttccatctggattcacatggttgaagtaaccattctgtatcatatgattacttttatatcttgcaacactctgcaatgtataatctattgataatggttttaaacctgcttctgttctttttgcattcataagctcaagtattttgctttctgcattgctttgtactgtaacactatatttttctgataattgaggtaatccacttactgttacactattgtcaccagatgatacattatttgatgttgaattgtttacagttgaattactgtttgttgatgaacctttatcagtttcagtaggagtaggtttgttcgtacttccactgttgctagttgattcagttttatttgaattttcattcggttttatcaaattattgtttgagtcaaatcccttatcaactttaggtgtttcactacctgaaacttgaccatttatattacattgataattcttatttcctatcttaacgctacctgtttgcattactcctgatttatttagacaataaacatttcctgaaatctttaatatgccagtctgcattgctccggtattatcagcataataccactttccagcatcatttatccaacctgttttcatttttccgttattatcaaagtaataccagatatttgatatattcttccaacccttaactggagtgtttcctatacagtagctccatgtagaatctgatgattgcttccaatttgaagatacttctttttcaagtgccgatactcctaatggtgccatagtacacattgttgccgctataatacctgcacttatcatctttttcaaaaatgtctttttcattagtttttctccttttttcatctttttagctgttactttcatttactcctttttattttattaattttcatttattgaagttttttgaagtagctatgtgtaatatagtaacacgtattcgacacttttcaacacttaataatctttatatgattttataaattcaaattatctatagataactctgtataactatacaatccatgctattcctgtatgatgttgtccaatcctactaacagcaaggggttccccctacaatattttttctaaagcattgatattttggactatacaaactccattcattcctttatattccatttattttgatatatttataattctatatatgcatatttattttaaaatactgaattttaattcttaccccttaaatttatttagactataaattctatcactatatataatcctttcataaccattattatctaatttgtccctagatgataatttttttcatatactaaaatgcagaacattttcaggagtttttataatgtacaaaaaaggagacttccacatacattcaactgtatcagatggcaattgcacccctaaggaggttgtaaatatagcaaaaaaaagaaatgttgatataatctctttgactgatcacaatacaacacagggattaaacgaggcaatatcatatggtaataatataggtataaaagttattcccggtgtagaattatcaactcgatacaataatacgagggttcacattttaggttactttaaagatgaaagctataacgatgatcttcttattcatattttaaagtgtgtaaaaagtcataagataggtgaaataaaaaaatgtctacatggatatattaaaacgtattatagacgtgataacatatgtgttgaaaacggcattgaaatactaagattttttggtgctaatgttgttttagctcatcctgtattgttaccaacagatgactttaaagaaataataaaacttggttttgatggcattgaagcaaaatatttttctaatactgaaaaagacacacgcttttttataaatattgcaaaagaaaaaaatctattttatacagccggctcggattttcatatatttaacgaaaaacatagagctcatggaattataggtgatgtatacttaaatagttctgaaatattagattttttaacaagagcagaactttctcatctataaaaaaaattactacataacacaaataaaatgtgctgtgtagtaatttaaacatactattaaaccattaacttaacaacttccttacagtactactaatttattaataataatatttcatctccataagcttttattttcttttcgccaacaccacgtatttccattaattcttgaatacttttaggcttagtattgcatattgcagtcaaagttgcatctgaaaaaattatgtatggtcttatattctctttataagctttcatttttctccactgttttaatttatcaaataattcctcatttaaaaccggctcatcttcatcaataattttaaacataacattttcttttccttttaatacattcattgatcttgcgttgagtttaagcatagaataagttccttctttaagtccaacatatccttcttctaaaagactttttattaaatttttaataaatccactaccatactctttcattattccataagtagtaactgtatctaatttattttgtattattttaggacctttaaatcctcttagaacatcaattaacactgaaatcccaaatttttcacgagttctaaatacagtagacaatatcatctgagtttcttttgtaaaatcttttagttctgaatcatttaaacaattcccacaattattgcaataatttaattttcgttcattcccaaaatagtttaatataaattttctgtaacaatcattaagattacagtaatcaatcatagattgaaattttctaagttgaacttctcttctgttcattgctgaacttttatttattatgtattctaccctgcttatatcactttctgaataaaataaatagcatttgcacagttctccatctctaccacctctaccaatttcctgataataagattctatattctgtggaatagtaaaatgtactatatatcttatattagatttatctatacccattccaaaagcatttgtcgctactattatatctattctttcatataaaaagtcttcctgattttcttcttttatatcatcacttaagccaccatgatattttccaacattatatcccaaatcctttagataatggtgaagcatatccacttcttttcttgatgaacaatatattattcctgatttttcttcattctctcttattatatcttttagttcttcaagtttatctacttcttttaaaacagcaagtcttaagttttctctatttatatcacccttatatgtgtaaggatttcttaatcctaataaatttatagaatcctcaagaacttcctgagtagcagtggcagtaaatgcagaaataactggcttgctctttaatatatcacaaaattttgaaattcctatataactctttctaaagtcatgtccccattgtgatacacaatgagcctcatctatagcgatttgagaaatattaatatctttaatcatatcaaaaaatattttagattctagtctttccggtgaaacatatattatcttatattctcctatagatgcttcaaaaagtattttttttattgtgtccaaattctgagtactatttatataagctcctttaattcctgaacctattaagttatcaacttggtctttcattaatgatattaatggtgatattacaattgtaatacctgaaaatagtattgcaggaatctgatagcatagtgattttcctccacctgttggcattaaacagaaagtatctcgaccacttaaaatacttgtaataatttcatactgtccacctcttaaagtatcaaaaccataatatttttttagtgcataaaaaattttttctctattattcaatgctctttacctttcctattttatactcttataatatggattctatttaatatctagtaaatttacatttcattatttatgtatataattttctattatatagtatataccaactttttaggttcttaaacacttaagccatatatttactatataaaaataatttattaaacaatatttaatcacaaaatcattcttaatacataagtttatataaaaataaaacagaactaataatgctacaatagttctgctttatttatatatttaaatttgtaaaatctctaatgaatttttctataattcaaacttatttaatttttcctttagattttctgcaattccatcaagcttgtcagcatattctgtaagttcatccattgttgcagtaacttcttctgctgatgctgttacttcttctgatactgatgctacatcttgagatataacagaaatattatctatttcttttttaacattttccttatcgttattcattttatctgttaaattacttatatatctaattgcttctactaaaggctctatagattcagctatttcgataaaaatatttttcgtattgttgatagattcatcttgttcatttaaaatattaaccgtttcttccatactatcaacaaatcgtatggatttctgatttacttcctttattatactttttattttatctgttgaatccttagattcttctgcaagttttctaatttcttctgcaacaactgcaaatccttttcctagctcaccagctcttgctgcttctatggatgcattaagtgcaagaagatttgtctgttcagttatacctgaaataacatcagatatttgattaatattctttatgctgtcagtcatttctttcacattactgctagattcttgagtattttgtttagttaccacagatttttctataagtaaatttaaaacttttaatccatcatcacttaacttatctgttacttctgataaatttaatatgttgtttatatttttatccacatcatcaattctatttgataatccatcaacagtattagtcacattactaattgctgttgcttgatctgtagatccatttgatacttcatttatagcatttgccacttctgaaactgcagcatgagtttcttccgacatagatgcaattccagatgctgaatcatacatttcttcacttgtagagtcaatttcctttaataatcctgaaatactatctaatgctgtatttaaattttctgctagttcttgaatttcatccttcgatgaaacctgtattctctctcttaaattaccagtagcaatttttctaacacctatatttatctttttgatttgctctgttattgttttagtcaaaatcaaagatgcaataattccaagagtaaaaaatactgcaacagcaataaatattgtatttcttatagaagaaagatgttctgttatttccttttcttcaacaaatccaactattctccacccagttttttcatctatactctgcaatacaaatgttaattctccattatttgtccatttcgtcttttcttgattactgttctttaaagcatcccaaaattcaaatccacttaaattttcgccaaatgttttatttttttcattattaattactatcttaccattattatcagcaataacaatatatccataatctaacaatgatacatcatgaatatatgtttcaatttcacttaagttaatgtctattccaacaacaccaataaattctccattgtatcctgtaactgctttagatatagttagtacattattacctgtgactgcatctacatacggttcactatatatgaatttatcagtattttctttagcttttttataccaatctttatccctaaaagataatttagtctcatctgttatttcactatctacaatcacagctccatgctctgctgaataatatacattatcaattccactcaagctttcttttattgattttaaagcatactgtacatactgctgtgtttttttataatcttgcgcaggatcttctaaatcttttatatctacatttttatttaatatagttaattcttgtgtcattttatttaaatattctgaaaatcccttatctgcttgtttaagaatttgtaaacttgttatttccaaattattttccattgcatttttagattttttatgagaaatatatccaacaaaaaatagtgataaaagtaatataactacatttgttaatgccattttaacaaatattgtccttctttttttattgcttaacatttcttcctccccattgacttagttttaacttcctgtttgattatactagtattttttacatttttctatatttttttcttgtttttaccgtatttttcacctcctgcaaatttctttttagtatttttcattaaaagtatgataaattacaactatcgttaataattaacactattatataacattaattattaatataaaacccaataaaaaactctctatgaaaaatataatcatagagaatttttatagatttattttagtttaaaaaataagtcttttagttcacttgtcgctttatatatatccttttgtgatattatagctgaaactattgcaagtccatcaatatcagtgccattgaaatcagttattctttctttatttatcccaccaataacaactataggaattgatatattttctcttatctttttaagttcatccatacttgtatgctttgcatctttctttgttccagtttcatacatagcaccaacaccaatataatctgctccgtcattttcagccttaattgcattttctaacgttcctgctgaaacacctataattttatcttcaccaattatttttcttacaacagaacaaggaagatcactttgcccaatatgtactccggcagcatctactgctaaggcaatatcaagtctatcattgattaatagtggcacattatatttatccgttattctctttaaatttattgcagtattataaaaatctaaagaagaacagtccttctctcgtagctgtacaagggtacatccaccttttatagcttcttctactgcttcctctaatgtttctgtactcattaaatctctatctgttactaaataaatactataatcaattttcggtttcatattacatactcctatcaaattatatatacaattatcttactttttataaacaatttattatttaattttacttctttttagcaaatcttcttcatctaaattacttactgcatctattattgccatatgaaaacttccaagacctatacttccagctctttcttctgcaatttctccacagattcccatagatactattcctgaaatagcagctataaataaatcttcttttgtttcgcaagctcctaaatacccaccaactaaagctgtggtcatacatccagtccctgtaacattagaaagcatttttgttccattttctatggtaacaaatttttctccatcagaaactatatcacatactccagttatagctactgtacaattaaatctcttcgctaaagatttagctactcttatgccttcatcactatcactttttaaatctgactctgatgcatccacaccctttgtttcagactctaatccagcaataaattttatttccgacatatttccacgtaaaacactgatttttatttcttcaagaattcttttagttgtttcatttctaaataatgatgcaccagctccaacaggatctagtacaacgggaatattcaattcattagcctttttccctgatgcaatcattgattctatagttctttcatttaaagttccaatatttattacaagtgctgacgcaattgatgtaatatcttctgcttcttttaagtcatccgccattattggtgatgcacctattgcaagaagtatattagcacaatcatttactgtaacataattagttatgttatgaatcaatggttttttattttttaatctatttaatagctctactaccttctgtgctatatctatattcataatttatcatccttttattattatttactttaattctaccttttctccatttagaatcatattagtagttcttacagcacacatctttccacacatagaacaactatgcttttcttctggaggaatactttcaaaatattcttttgcttttttagaatcaatagctaccttaaacatttcatcccaatccaggttctgacgtgctttggccatagcattatctctatctcttgcgccttttattccatttgatatatctgctgcatgagctgctatctttgaggcaattataccttccttaacatcatttatatcaggtaacctcaaatgttctgctggtgttacataacaaaggaaattagcaccatttgttgctgcaattgctcctcctattgcagatgtaatatgatcatatcctggtgcaatatctgttacaagaggcccaagaacataaaaaggtgctccatgacataatctcttttctagtctcatatttgctgcgatttcattcattgccatatgtcctggtccttcaatcataacttgcacatctttttcccatgctctttttgttaaaagtcctaattcaataagttcagtaacctgtcctgcatctgtagaatcatcaatacatccaggtctcatagcatctccaagacttatagtcacatcatattctcttaatatatcaagtaattcatcgtaatattcataaaacggattttcattgcctgtcatctccatccatgcaaataataatgatccacctcttgatactatattcattgttcttttatcttccttaaataactgaacagttcttctattgatacctgcatgaattgtaacaaaatcaacaccttgtttagcatgagctcttacaacctcaagaaaatcttctgcttttatttctaaaaggtctttttcaagatatcctatagcatcatacattggtacagttcctatcatcgctttagaatattctataagcttttctctaaattcctgtgtcttaccataattacttaaatccataatggcttctgcaccatactcaattgctaatttaactttttccatttctctgcagtaatcaactgaatctcctgaaattccaaggttaacgtttatcttagtcttaagcccatctcctattccttctggacttattgacttatgatttacatttgctggtataacaaccttaccttgagccattaatttcattaattcttctacactcatgctttccttttctgctactacttgcatttcctttgttacaataccttttttagctgcttccatctgtgttttataattcatttttattcctccacttattcaattacagtttagaatataaaattaacacttaaagatttttattctttctttttagttatcaaaatcatatgctagctgtaattaatattttttattaataaaaataaattctgatgtcaatctataaagtaatactttgaacttattgtttttcatttttaatattaattatttaaaattactacttgtccttttcccctgtgatttcttcatatcttcctgactctttatataattcatagaaatgattagtaggaccaacccccttacctaattcaaaaccatgttcaattgcacatgttatatattttttccctgctttaacagcttcttcaacagtcatacctttcgctaaatttgcagctattgcagatgataaagtacagcctgttccatgagtatgagttgtatttaatctttcttgtggcaataatataaagttttttccatcaaacaacaaatctgtagcatcatcttctaaatgcccacctttcacaagaactgctttaggtccaagttccataagttttattgctgcttctttcatctcatctacagttttaatctcaacacccaatatttcctctgcttctggtagattaggtgtaattaattctgcaagaggaaatagttccttaactaatgtatccttagcatctcttgataataagttaaatccactcttagatatcattactggatctaaaacaaccttaggtaaattttcaacattccttaatgcttttgctatggctttaattgattcaattttagataccattccaattttaactgcatccactcttatatcttcaaatattacatttatctgtccttcaattatttccggggtaatatcctgtattccaaaaacccccatagtattttgaaccgtcacagctgttataacactcattccataaactccattagcctgaaatgattttaaatctgcttgaatacctgctcctccacaactgtctgatcctgcaattgtcaatgctctaaacataaaaatcgtcctttcttatttatcaatatataataaaactttctaactaactaataatatattaaaagctaattatcatactttccctatactttccctatgtatttcttcattattaattaaagttttttgtattataggtatctttaagaaaaagtaccctataattgcaccaacggtgcaactcattataaatggactcacgaacatgaatatggcaccttcttttcccataaacaacttagctattggataagctattaatgctcctaataaacctgttcctataacttctccaattactgctgcaaaaatcttattaatcttcttatacagaattccagctataagtgctccacacatacttcctggaaaagctagcaaacttcctgttcccaaaatatttcttatgagtgatgctacaaatgcattggccagtgcatagacaggtccaagagttattgcacctaccacattaacaaaatgctgaattggagatattttagctactccaattggaattgaaaatgttccaaagataacagccagtccaataagaactccactcaaagcaattttctgagccttacttttttccataatacttctcctcctccatcgaattactgattacaactaatttataatacaaaaaagtgcagccctaaggactgcaccaaaattgacatattaaaatcaactaattaattctgcacttccctacgttggtcttaaccaaatcaggtcataagggtttaggaatttattccaatctcagcaaaagctcccctagttatctataaattttattctattattagagtataccattgtataaaaaaggtcaagctgtatttatatgataatagttctataaattcaaaacagtaaatactaatcttatatattcttttactcatcctaaaaaagtattataaaatttgtacagactagaaatgcagataataatttactattacattagccttaagttcaaatcaggcagtaaaaaatactgtctactttctcatatcaatgcataaatcctgagtacatgatattgtaaccataactcctttccccttaaatacaactataagttttatcatttttctttataaaataaatagttacaagcaatgttaaaaattctgttattggagcaacaagccataccccattcatttttaatatcttgggcaatataaaaattaatattaataatataattagccctcttaaagaagatataattaatgattcctttgcctttccaatggatgtaaaataaaatgatgaaatagtattaattccagaaaataaaaatgatacaataaatattttcaccccagatctaaccatattttgtacctcttgatttttaacaaaagcagtactgtaccagcctgatgtaataaacattactaaaataactgctattccagttacaaaaacaaacatattagtaattttcctaagctctctttctgtttttttatcctcagctccatgggtaaaactaatcagaggacttacaccttgaccaaatccaataagtatcatgctaaataaataagctgcatatcctacaatcgtaaatgcagatactccatcaacaccaatatttttaagtattacaatattgtatgcatacatagtgatactcattgacatttctccaataaactcagaactaccattgaatattgttctcttaaaaatttctccatcaaatgagatttttccaaacttatatactgttgactttctaacaaaataatatatactccacaaaaaacatatacctgttgatataagagatgctaatgcaattcctttaacccctaaatcaaaaaatttaatacatgaataatccaacacaatgttgcttaaaacattaaatatagtaattttcatgaaaaatcgtggattgccttcacctcttataaacataccaaaactattgttaattaccataatcggaagttctagtagcataatcatataatagtctttaaaatattctgatactaatccatcaacattgaacattttcatcattggctcaaataaaatccaaattattaagcttaatagaacacttataattactgttgtagcaattgtttgattaaaaacagaattgcactttttcttttcagaagcaccaagcatcattcctgcaataactgatcctcctaccgatatcattaagcctaatccaagatacagatatacaataggaagtcctatattaattgctgcaattccttcctttccaacataatttcctgtaaaaaatccatcagttacagtaattaatgaagttaaaaccattgctataattgctggaattgaaaattgcagaatcataccctctttattttttcttatactttctaaatccataaaaataactcccctctatttgaatcttaaaattgatatttataaatcaaacaaatatcttacagattcaattatagaaaagagtttaaatataaacttatgaattcttgcctaataaatactaaaacggaaatttttgcttattttattggaatgcaaatatcaagttccatatacatggaatcacagtcaattttattatatatgtcaaaaccatatcgattgtctattcttttttttactacaggaaaccatacttgaaacatattctgataagcagtataaatctgctctgggaaacctttataatgatacactgcaaatttacctcctggtattacacatgtattttctacatcacagttcttatcaactgtcatacatatatcataaatacatttatcagcacttgtaattgaaggatcatcaaatgtacgttcaagaaatactgttttttcatctatatatttcttatatttatcagtgaattctgcccatttttctataagttcattataattgccaattcgtctttcataaattacaaattgatcttttattgtttctattgaaatttttctgctacattcttcaaatgattctatgttcacttcagcatatggataaaatggatgattaactgaatgttgaaaaatattattacgaaattcaatgggggattcattatgatgttttttaaaaacctgactataatttgaaggacagtatccataatcaaatccgatatcagtaattgttctctgacgttctacttttaaacggaatgcactttgttcaagcttcaatcttttaataaatgcatatatactttcgccagtttcctttttaaaaatcctgctgaaataatattttgaaaaatgacaatgttctgccacatcttcaatcataatactttcatcaatatgcttcattatatatgttattgccatgtttacaatttcatttgttttcataataaagactactactccttatttcttttataatgatacattatactaatatattaataaacttaattacttactttcattatagcatcaatatgtaaatattaatctcatacaccttctgtataacttatatttacaaaaaagaatcaataaatataaaacttattaattctttttcttaatataattatttatttttaactttcacataatattttccaaatctttttactggttttattacttcaaaaccatcaatatattcgccaatttctgcatccttaggaacttcaattaaaattgtttcttttttctttttaatacttctatctacaaatacagtttttttgcctcttcctggcataattcatcatcctcttaatataatatgttctgaaattattatattaatatagagtaataaatgttctctttattaccttgtttctatactgtatttttaattttcaccagtagcttaatcttataaattcatatgaaaatatttataaatttacttatttaactgctatatataaataacaatgtgctgctccatcttttgtatattccttagggacggtactttcaaaatcttctgtaaaacttctatctatagaaccacttttctgatcattccacactctctcccaagctttctgtgcacatactgaaatatcaccattttcatctttttcttcatatcttacatatttcctattattaattttatcttccataagcttaaaaaattctgattttacagccattacagtgagattatattttccactttcatcaccttcataattactgtattttgatattggagatatccccgtttgaaattcatgttcactatcaaataaaataggaatctttccaatggatatatcctgccacaattcattaatagcctgaattcctttttctgaattatcagttctaattgtaacttcatttaatatatatgccataacatatctccctttatttataaaattatttttcttcttatcttttccatctcttaagattaggaaatgtttctttaagtaattttctagcttcatcttcattcattccatgttccttcataaaaggtacacatatttcaatttcttcttccatagtaacattaggtgtagtaaattccccatttttataacaataaatacagtattcctcattaaaacttccatctttattagtagctaccacctcttttgattccattggcataccacagctttgacatattaatctttccataaacattacaccctttcacttatatattttaatttgttattatatttacattataactaataaaacctgacatctatctgtcaggtttttcaagttactatacataaatatttataatataattctagtataatttatatcctaagaaatatttataattctatctgcaaagtctttatagaacatttcttcatgggatacaaggactacagttccattaaatgatactaaagactcttttaatgcttcttttgtaagctcatccatatgattagttatttcatccaaaatcaaaagattgcattctttaagtgtaataatacaaagtttcaccttagactgctctcctccacttaatgtttttatcttttgcatctgtgttttctttcttactccacattttgaaagatgacttcttacttccttttgtgaaaagtttgggtagtaatcagaaataatctgaatcggtgttttttcatcatcttcccaatttagatcctgctcataataagcatactttacattgtgtccaaaatatatttctccatcgatactatttaattgtcctataattgtttttaataatgttgattttcctattccattaaaacctgttatgactaccttttctccattatttattgaaaaattcatatcaggtagaatagcataatttttatatcccacttttaatccctttacatcaagaactgtccttgtcaatgtttctgaatatttaaaagtaatggatggttttacacttgctattgtaggagcttcaattctatcaattttatcaagctgcttctgtcttccttttgccatttttgcagttgatgctctaactttattctttgcaatatagttttctaatttttcaattgttctctgctgctctgaataccgtcttaaataatcttctttaagattttctttctgctttaaatattcagaatatcctgcattatattttcttacatctttaaactcaatatcgcatatacatccacatattctatctagaaaattattatcatgtgaaactattataaacgctcccttaaaatctgctaaatattctgaaagccaatcaacatgttctttatctagaaaatttgttggttcatcaagaataagtaaatcaggctgttcaaggagaagttttgccagtattacctttgccctctgccctccgctgagattctttaatattttatcaaaacctattacatttattcctaaaccagctgatacttttcgtattgtactatcaatgctgtaaaaatccctgttttcaagtatctcctgataaacatcagcttttttcataacagcattactctggttaaatgccatttcttcatacaatacatttaatttttcttcaatttcatacaaatcattaaatgacgtttttaaatattcaaatactgaataatcttcaataatctctgcatattgatcaagaacacctatttttattcctgactgccactttatttcaccttcatcaggtataacctcaccacttaatatttttaagagagtactttttcctgctccattaacccccacaattcccatgtgctctcccttatacaattcgaatcctatatttttgtataattccttttctccaaaaccatgtgttaaattctttacttctaataaactcatttttcagcctccataatctagctgatacaatgaatagctttcaatgtaattttataataaaaaaacagaagacttaattatttcagccttctgttttttatacaaatgtataaaattaaagctgaaagcagattcattgctttcagctccttaaaattcaatcataaatcaaataaaaatctgtacaaaaatcaaaccataagtctataaaaaataaacttataataacaattaaataaaatcagatttttacacttcaaaagaagaatgatttatgattacgctccttgcaatgcatcttacttttacattgtttggagctattgcaatagctaaaaaatttcttatacacataataaatcattctcctttcctaaaatttacttttatgataactctttttttaatttctgtcaaacacctaaaaatacctcataatcaaatgatatataactcatctgtttacaaagtatttttactgatttcaaattatttataaaattattatgctaaaaatgcttcagattttgcttttaacactacagcactaaccggtaatgcaataactatacccgttccaacttgtattatattacctactatatcttttgcagaataaacaattccttgaatcaaacctgctttttctgttaaaaaagcagccattattattcctgctccaaaatacgctattaccataaatactccacttattaaaaatgatataacataactaaatgattttccatgctttacttctaatttttctaatatacttcctgcaatataagccattgctcccttaataacgaatgtgaatggagcccataagtagtatccaccaagaacgtcaacaagcatcattcccatagcacttgccacagaaccttttttcttacctaaaactactactgacaaaaacaccatacaatcacctaaatgaacaaatccacctacagatggaatctttattacacttccagcaagccatactaatgctatcataagccccattaaaactaattcttttgtacttaatctgttgttcatgtaccattcccccatacagttcaaattactaactattaatttctttttttatattataaaagtagtttgtcttcttttcaaatgtatgggtacaatatttttcacaaaccaaaataaagaatctcgataaaattaattgtctattccattattaatttttttgagttattattaaaattagatagattttcttttcttataattccaaaaatttgtctaaattttaagtcgaggtgaaaaattatgaaagcaaataaagtagcagtaatcggagcaggtgctgtaggaacatcaatagcctttgatctcattattcaaggaatatgcaatgaattactaatgatagatataaataagcctaaagctgaaagtgaagttttagatctaaaacattgtactgcatattcaaattcttcaataaaaataaaagcaggagaatattccgaatgtactgatatggacataatcgttataactgctgctgctccacttataaaaggtcagtcaagattagatatgtttgaaactgcaaaaaaaataacaaaatctattattgatccaattatggagagtggatttaatggttattttataatagtgacaaatcctgttgatattataagctattatgtatataaattatctggacttccaaaaaataaagtaataggaactggtacagccctagattctgcaagattaaaagtatttcttgctgatttaatcggcattgaagcaaatagcgttcaggcatatacaattggagaacatggcgattctcaatttattccttggagtactgtaagtgttggtggaaaaaactttgaagatatattaatagataataaagacagactcaagtctttcgataaagatcttacacttgaagaaattaaaaaagctggatggaaaattgcagatgtaaaaggtacaactaattatggaatagctgcaactactgtagatataataaaatctattctaaataatgaaggaaaaataattcctgtttctgcacttctagaaggcgaatatggaattgatgatgtttatatcggtgttcctgcaataattaataaaactgggatatctgaaattgttgagttaagattaaacaaagaagaatctgcatcttttaacaactccgtttctatcttaaaaaaatttctttcacaattataaaaattttcaaattaaagtattatataagtatttaatgctttaaagagtaagggcatcatacaatagattataatctatatatatgatgcccttatacatttcccaaagtattctttcccaagctttaaaatttatattaaattatattctaattattttacccaagatccatttgctcctaaataatatccatcaatgtattcattttgagccatttctccattgtcttttaaataataatattgattgttatctaatagccatcctgttttcatggaaccatctgcatttaaataataccatttattattatcttttaaccaaccagtctgcatttgaccatcttcttttatgtagtaccatttactattttcattactccatccgctttttctaattgcttctgtagtttcacttgcatccattggcattatcatacactttgaagctttagcctttactggtaattctagtgtttgtactccattagcattaaattcttcccatattaatagcttagatcctgctttaatatcatcaactgttacaatatttcttgttttatatggaaatacattagtttcattattgaatgttatttctttgtttccaccttcagtaactattgttgtagttccattatcatttttctttacagaatcaaccttaacataacttggaactgcaaaatcttgtggaatattaactattataacttttgcatttgttataggaggtaaacttaatgtcatagctcttccagcataaacataaatgttttcatcaagctttatattttcttttaatacaggagttcctgttgctgcatcaacaattatagtatcttcatttatatttaatataacatcattatttacatcactagaattagtaattctaattcttccaagttcatcaaattcagaaacttgtccccataatctgctatagtcttgttgatatgcagcttcacttacaacttcagcatccttattttcagcatatacattacttggaactagtgaaaatactgccgctcctgccatcatacctgtaacaattctcttaatattcataataaaatcatctcctcattttttatttatttttttaattcttatgttcttctacttataatacaattaagcgtgattaattgttgcaataaatttaaatttttttattattttattttcttttaataaaactatatatttttcattttcatcaattatctttttagtgataaaaaaatataccagcaaaatcattaaatgattagctagtatatttttctttacttcaaaatatagttaacaaactatattaaaaacctttcaaacttgtgtatattcttttttgaacctataacaacaataaattcattttcttctatgatgcaatctggtgtaacctcaacaactgttgtattctttctttctattgcaataatgtttaaaccaaatttttgacgtatattcaaatctgatatagtgtgtccacttattttatttgtagctttcaatttagatattgtaatatcatctctaagctgaataaaatctagtaaattagaatacataagtctatttccaagtcgaactcccatatctttttcaggatatacaacttctgcaccaattttctctagtacacatccttgttcaaagctcccagcttttgctataaccttaggaactcccatattaattaaatttagagttgttaatatacttgcttcaatctttgagctgatgcatacaattactgtttcacaattttggattccagtttcctctaaagaatctttatcaaactcttctaatataaaagcattttctgttaaatttctaatttgcttcatattactttcattattatctattactaaaacatcttttccagcttctaaaagtgtttttgctaaggcagatccaaatctgcccattcctattataccaaattctattgttgatttatgattcatgaattttacctcctaaaattaacctatagttatatcttcttctaaataatgtacatgtgatgttggtttaaatgtccatattgttgccatagttaatggtccaagtcttcctatgaacatagttaatgtaataatcaacttacttaaatcactaagatttggagttattcctgtagataatcctactgttccaaatgcacttgtaacttcaaataatatttgcataaaactaaattctggctctattattgataaaataaatgtatctactacaactagtgttaacgctaatgtagctataacagatgcttttgctattgtatttttagatagttcacgtttaaatgctacacaatgcttattagtagatgcactatatacattttttataattgcaaaaaatgtagtagtcttaataccaccacctgtagaaccaggtgatgctccaataaacattaaaataacaagagtaaataatcctgcactagtaaacccacttaaaggagctgtgctaaaccctgctgttcttgctgaagtactataaaaaaatgctgttagccaacttatattttctgtaaacctcaataaaatagttccaataattaacaaagcaccagtcattgtaataactattttagtatgtaatgaaaacttctcaaaagaatgcttttctattatttccttaattgttaaaaatcctagacctccaaatattatcaagccacatgtaacaagattcaaaagaatattatctctatatgaacttaaattttgaaaatttccaagaacatcaaatcctgagttattaaatgctgctattgaatgaaatatacttattccaacagcatccaatggcttataatcttttgaaaatactatataacttaaaattgcacctactatttcaaaagaaattgtcataatgataactgcttttataagcttaactattcctttcatagaagttaaatttagagcctcttttacaagcattctctgctttataccaacatttcttccaattaataatattaatccaacgccaatcgatgtaactccaagacctccgatttgtataagcatagcaactacagtttttccaaataaattaaatgtatctgccgtatcaattgcaattagtcctgtaacacacactgcactagtagaagtaaacaaagcatctacaaatgatacatctacaccactccttcttgaaaaaggactcatcaaaagaaatgcaccaatcattatcaccataaaaaagcctaatactataagtcttcctggacttatatgttttaatttgttcatttttatccctctctagatttgtaaatttaaaacaaaattcacattattataaatatgtataatttaataaactctttaagccatatctgataattttcttatcaaataatagccaataaataaagtaaacaaacttatcactatgtttattccacttggtattcctggaaatacttgtactactgaaccaacaacaaaaccaagaattattaaatatgaaccttctctataagaattcatagctttttctaagatttttgttgtaagcattattccaataagcaggcctattcccaacggaattagatatggaagataaaattcatcaattgctcttatagtctcttcatacatacctaaaactaaaagcatatatgatacactaatgcctggaagcaccaatgctatagccgaaactattcctgcaataataagtaataaataatccattatcccattacttaaatcaacatcaaataactctttaggtataagtgaaattaataatattattagcaatcccaataatatatatataacagaacgtatagatattttttttatttcagcctgcttatatatcataggtatagatcctaaaactgctcctataaaaaaatacatcataggaaatgtatatttatctgttaaatataataatggtttagcaaataataaaattcctattaacccacctaacgcaaaagttccaagaagttcaatactctcccttttatgcttaaaaaacgaacttacagctgatattaatttattgtatatgcccaatatcatagccattgatcctccactaacaccaggtattaacatggatccaccaacacatatacctttaattacattagatactattttatttttcatacgcctaccttcccttgtaatcagtaatttataaaatcaaaagaggtataacctaccatttaacaatgtacagattatacctctttaatttattaataattttttatatttatattaaaataccgatttatatattgcttgactttaatcatagttttttcctttttaataataatatttatattatatttttaacattatttaataataatgtcttattaacttaatcttattataacattatatcaaaaaatttatactatgcaagattacattctattaataatttttcgtcatacaatatattatcattatttactaacattcccttatttaacacaattattctatcacatatacttcttaccatatctaaatcatgtgttgctattatttttgtagtattcaaattttttattgtctcaataaaacgcctctttcctcttggatccaaaaatgatgttggttcatcaaataaaatatatgatggatccataacaagaacagttccaactgatactttacgcttttcccctcctgataaattatttggagatttatacagtaattcttcaatatcaagtttctttgctacatcaataattttatcttttatgtcatcttcactcattttgctattcctaagaccaaaagcaatatcgtcatataccttgttcataaatagctgattatccgagttttgaaatacaacacctactttttttcttatttcttttaagctttccttactaatctgtattccatcaactattatttcaccttcactagctttaaaaataccaaccataagttttatcagtgttgattttcctgctccatttccaccaattaaacctattgtttcaccttcatttatcattatatttatacctttcaatgctatttttccatcttcataggaataactcaaattttttatttctaacatgttcactaatcccccaaaaaactttcttaatttaataacgaaaaaatacatatactaatatttatcatccttattaaaacaaaactgatacataaaatacatatatatgcatagtccttcaattgaaactttttttcatatacaactgtataacacccatcaaatcccctacatttcattgccatatatatttcttctgaccttgtaaaacttttaagcagtatttgtcctaaaaataccccatatgttctaaatttattccttttctattcccacttcttaatgaatatgctgtatacatactgttcgtttcctttaatataactgagatgtatctatatgaaagtaaaagctgaaccaatattattttaggaatttttatctttctaagagagctaaaaatatcttccatagatgttgttgccactaatatatatactgatgttactgtaagaactacttttattattattgttgaacatgataagatcccatatgttattggaatacctccaatataaaataatatacctttatcaaaaatcagatttaaaattcccattacaacacaaaatggtaatgttataataactcttttaaacagtatttttttaggtatatcagataattcaacaagtattattggataaaaaataaagcctataagcatgctcacatcatatttatcaacagatgcaactgcaaataggaacattatagttactatcattttagaaagagggttaagagagtgcactatagactctctttctgatagttcttctaattccctgatatattttaaacttgtatttaaatcactcatacttaaattcaaccctctttttcaaataatttaatatgatcttcttagttttttaattttggaaatcacaattcctattaataatgctataacaaaggtaattgtacctcctgccaatcctgctacacttgtacctatttttacatcttcattatttttaaaactataatccggcataaatgatgatgctttttgaatactcccacttaattcataaggttgtccttcatatgataattcttcttctgatgttatatttcctattgaccattctaatccatctggatattctgaagcatataatgaaagtacacctccaataattcctgtaagtacaaccattgataaaattattttcttaaaactaccaccatatgataattttttaccattgtttacaaactctaaaatttcaggtcttatactatgtatataacacaatactgctcctgttattaaaccttcaccaatccctatagcaagatgtataggctgcatcaatattataaatgaattaaaaggaagctgacttctaccagacattaacgtctcaagtacaacgctgaaggatccaaattgaagtgctattacacttgtaactattgatgcaattattattctttttttagaataactatttttcattagctttccaaataataatggataaaatacaagacaagaataaaatcccatattaaaaacattacatccaagtgctagaattcctccatctgcaaaaaaaagtgcctgaattgcaataactgttgcaagtactaaaaaggctggaataggtcctagcactgctgcaagaattaatcctcctccaatatgaccgcttgatcctgttcctggtatagtaaaattaatcatttgagcacaaaatacaaatgctcccattacccccattaaaggaatctttttttcttctaaattactctttgctttatgtacacaccagccaagagttgctgtcgttacagcccccataactcctgcaacttctggtgatattaatgcatcggacatatgcattttaaacattcctcctttatttaaaatttataaaaattactttctaaaataaccaacccattatttcatcacttaaatcacttaatttctgaccgctatacccaagaatttttatggatacatctttatcttttgttaaagtaactcctccagtgacttcaatatcttcatctataagttttgatatttcctcaataaatttttcatcaccattaaaatttccaataaaaatattagcaagatgagtatatccttcaaaaaatccatacccattcatattaattgagtttggatcatatagagtattatccctataaattattttgcccttacaccttacctccataaaagagtgatagcttttatattgaaatttctctccagaattacttcttccacaagaaataatatcagttaagataacctttgaactctcatcttgtaaattaacttgcatcttactttcaaaataagattctgcaaatggaattgtaggttgtggattatatttcaaaaatgcgttttcatccacatttatttcacaataccttactgcttttccttcattcattttgtgtattttctcataagattgtgatgttacttcaagttttgtatcttgtccaacattaatattatattcctgtctatctccagccattattcctgctgatgaactcataactactatctttatatagtcatcatcaatataaaatggtcgcattatcttaaatggcgctgtaaaatatacatcgtcaagtatggttctatttctatctttttttgtttttatgctgactttagatacttttctaaaaacattatccatattacttaaaatcctcaagaagaacatcttttttaatccagtttattatatagtcaattccttcacttgctcttatatttgtaaaaacaaaaggtctttctcctctcatctttttagaatctctatccattacatcaaggtcagctccaacataaggtgctaaatcaatcttatttataacaagaagatcagatcttgttattcccggacctccctttctaggaattttatctccttccgccacatctattacaaatattgttgcatcagaaagttctggactaaatgttgctgaaagattatctcctccactttctataaagataatatcaagatcatcaaatctttctacaagctcatctactgcttcaagattcattgatgcatcttctcttattgctgtatgaggacatcctcctgtttctactcctataattctttctaatggcataacactgttttttgcaagaaactcagcatcttcctttgtatatatatcattagtaattactccaatgctgtattcactacttaattttcttgtaagacattcaattaatgccgtttttccagaacctaccggccctgcaattcctatttttacataagacatattcaaatctccctcctttgtaaattttattacatatcatgcctgttgttttctacttatctaaataaagttttcttaatcatgacatatataatcttgaataaagtctttcatgctgcatgcatctaatatcaaatccaggtgttgataaacataaatcttcaatagtaagctttggaagtttattaattatttcttccaaaaatccataacaactatataatattttttgtccattagtctggcttaaaggtataagttttactgcatttattactgctgctgatatatatgcatataaatatctttccattgctttatttatatctatattgcaactgctgcaaaaaacaccatatgcaactgaatgaattctatttccacctagttttctactactatatttattgaatatttcactttcatatttaacatctagtgatgatactgtttttataaatcttgaacctaatttttcacttgccaatcttatttcctttggaattctgctaacttctattatttcctctatttttaaaatttcatccaaattattttttgaagcacatttatatgataaataagctgataataaatctgtatataagaaattagtttctgcactgcttttgatatactcaaacatatcattagagtcccttattaaatccttttgaatataagtttctaagccatatgactgagtataagttcctattggaaaagcagcatcatttatctgaaacaataaaaaatcttcgtacatattttagtgatgatgattattaacagaagctgatattctcttatcaaaatctattttcatcattttagcctcaacctttactccaaggtgttcaagcatatgcttcataggttcatcatatattgttataaattcgttatgagcacttccacttattaaagttgcatgtctattacctatctcataacagacttttggaacaagatgacagtcttctacagtaactgcaagccacattgattcctttatatttacaactacagcagtatcattttcagtgcctataacatctccatctcttaatcctcttataagaattgaatcatcaagctttattcccacttcaattccaccatctgtagtaattttgtgtatctttttaaaagcatcatgccattcaatatttacataatccactttataatttttatatttttcatcttttattgagccaattaccttttcacataacataaaaaacatctccttttaactttggtttattttgattcgcttttagatgtattgtttaaaacaagttatataactgagttaatggaagttccatagctgcctcacatgttaatgaaacattgtctgccttaacttcatatgtttcaggatcaactgtaatcaaaggagttttatcatttaatttcatatctttctttccaatatttctgcaattttcaactggtaatacatttttctttaaatgtagcttttctttaatattattcttaactgactcctttgaaacaaatgtaatacatgtattatattttgctcctccgtgcgctccaaacatatgtctgtaaaaaacaggctgaggtgttggaatagatgcatttggatctcccatttttgcacctattatcattccgccttttattataatgtcaggcttaattccaaaaaatgctggattccacaaaactaaatcagcaaatttaccttcttcaacagatccaacatactctgaaatcccttgagctatagctggattgattgtatattttgcaacatatctcttagctctgaagttatcattgtcttcagtctcttcatcaagctttcctctttgctctttcattttatgcgctgtctgccaggttcttgttataacctcaccaactcttcccatggcttgagagtcagaactcattatactgaaaacccctaaatcatgaagaacatcttcagctgctattgtttctggacgtattcttgaatccgcaaacgctatatcttctggaatatttgcatcaagatgatggcataccatgagcatatctaaatgttcatctaatgtatttgtcgtatatggcattgtaggatttgttgaggctggaagtacattttcataagatgcagctttaataatatcaggtgcatgtcctcctcctgcgccttctgtatggaatgtgtgaattgttcttcctgctattgcatccatagtatcttcaacacatcctgcttcatttaatgtatctgtatgtattgctacttgtacatcatatttgtctgctacatttaaacttgcattaataactgatggagtagctccccagtcttcatgaatcttaagcccaactgcaccattttcaatttgttcaataagaggtctttcacttccacagttaccttttccaaagaaccccaaattcataggatactcatctgctgctttaagcatttgaccaatattccatggtccaggcgtacatgtagttgcattagtaccatctgcaggacctgttcctccacctatcattgttgttacaccactaaatagtgcagtatctatctgttgtggtgatataaaatgtatatgtgtatcaattccacctgcagtaattatcattccttctgcagatattgcttctgttgatgctccaactaccataccttttgttacaccatctaaagcatcagggttccctgcttttcctattcctacaattttaccgtttttaattcctatatcagcttttactattcctgtataatccaaaattaaagcatttgttattactaaatcaagatcaccgtcttcacttgttgtgtttacagactgccccattccatcacgaatagtttttccaccaccaaattttatttcatcaccataatatgtatagtctttttcaacttctataattatatttgtatctccaagtcttactttatctcctacagtaggtccaaacatcatcccataatcttttgaagatattttataactcatttatataccccttaattagttaacaagtaacagtttataaacttatattttaattttacatagcttattatttatattttaaaatttaaataaatccctttaattttgcagtgtttactgatgaagccttagtattgtctgtagtttgtccttgtgtaagttcatttagtccaaaaactctttttttgcctccaagttctactagctgaacttctttttcttctccgggctcaaatcttacagatgttccagatggtatatcaagcttcatcccataagcaaactctctattaaaagtaagaagtttatttacttcaaaaaaatgaaaatgtgatccaacttgaactggtctatccctgaatttataacttttattttgattgtctttctattatcatttaatataatatctcttccacaataaaaaacctctccaggaatcataatttattacatcctttctttatataaaatgtatccattattttattggattatgaactgtaactaacttagttccatctttaaatgtagcttcaatctgaacatcatgaatcatttcaggaaccccttccataacatcatccctagataataattttgttcccatattcataagttcagtaacagaatgaccatctcgtgcaagttctaaaagttctgaacttatgtaagctacagcttccacataatttaatttcagtcctctattctttcttttagctgcaagctctccagcaaaatgaagcattagtttctcctgctcctttggagtcaatctcatatatatcactttcctttcaaaatgcaaaaaaagcccataacaacaagacgttgttataagcttctttgcttaaatatattcgtttctttttcttgtcccaattgtatcatttttttcattttttatcaataatcatcttatttttatcttcatcagccttatatattaaaaattatacttctactaaaaaactcattggtcatcaatttattgaatctacaaatagctatctggtgtatttaaatttattttccttcacttattgtataagttctaaaaactggagatacaaatatctttccatccccctgattatttgtagaattcacatccataattacttttacaactttatcaacatgacaatcttcaacaatgagcaatatttctcttttatgcattaaatttgtcttcattattgaatcatctggcaagataactgtaactgcttcttttccttttcctctaacctgacgtcctgtatatccaggaattcctgcttcaagtaaagccttttttgtttctttgaccttattgggtcttataattgctaatacttccttcataaagaatccccctttatagaccttctgtcatagaacttattgtatatgctttttctacaggactaacaaaaattcttccatctccaatatttccattttctcccgttcttgcaaacttcattattgttttaactactttatcttcatccttttcattaacaatcattataagcattgtttttggaagttcatcataaaatactgatcctacagtgatacctttttgtttacctcttccatatacatccatttcagtcactgctgaataccctgctttagccagctctgtaataaccatggcaactctttctggtctgattatagatctaatcattaacatattgattcccccgccctattcatacttttatgcttgaatatattgcaattgacatttaacaagcaacatacactatttataattaatttatagagataataaagattgtaatgattttttatcaagacattctgtttcaccactcataacaatctttcctttttccataacataacactcatctgcaatctcaagaacaaattccagatactgttcaacaattaatactgccatattttctttaagcttagttattattcttcctatatcctgaattatagatggctgtattccctcagtaggctcgtctaatattaatattttaggttctgatattacagctcttgcaatagctaactgctgttgctgacctcctgacaaatctccacctttacgatctaggaattcctttaaaataggaaatgtttcaaaaatatgatctggtatttttgtaatctttttatttgcctccataccaagaagtatattttcccttacagtaagctgtggaaagatttcacgtccctgtggaacatatcctattcctgcttttgctcttgcatatgttggctttttaaaaatactttcattatcaattgaaatatctccagaaggtgtctgtaccaatcccattattgactttaatgtagttgattttccaactccatttctacctataagacatgtgactttacctttttcagccttaagtgaaactccatgaagaactttgcttccattatatgcagctgttatattatcaagctttaacatgttactcaccacccctgcctaaataaacatcaataacttgttgattgttttgaatatcatcaatagaaccttcacaaagtactgatccttcatgtaatacggtcacgcttgtcgaaacatcttttacaaatttcatatcatgctcaacaactataatagagcaatctttctgaattattcttaaaagttctgctgttctttctgtttctctacgccccattcctgcaactggttcatcaagaagcattaacttaggctgcattacacaaagcatacttatttcaagccattgcttctgaccatgtgaaagaattgatggatattcatttctgcattcatataatccaacaaaatgaagagcatcttcaatacgttcataatcttcctttgaaagctttccaaatacagatgaaaataatccatgatttttagccactgcaagctccatattttccatgattgtaatacctgtaaatatgcttggtgcctgaaacttacgccctattccaagttcaactattttatgttcttttatcttaggaatactatgatttattccattgtttccatacactatatctccattagataacttatttttaccacatatagcatctaataatgttgtttttcctgctccgttaggccctataaaaaatcttatttcattttcacctactgaagtagttacattctttactgctttaaagtcaccaaaggtaatacttgcatctttaatttcaagtattggcttttttaaaacttttatttctgccattatgaacccctccaatcaatttcttatcttccaaatagctctttttgctctttactactatccaatttactatttataatagtatcttcatcattctctgtgtctatttcagtttcttgttcatttccattcttaaagaacctagcttttattcttttaggaacatcttttaatgaaataagtccatttggtagaaataaaactgatactatgaataatacccctataaaataagaccatatttgtgggaaactttcacttataagactcttacatgaatttgtaagtaatgctcctaatataggacctattaatgtaccttttccaccaattgctgcccagattaccatttcaatagaaggtgatatatttacgtcataaggtgatataattccaacttgtggtacatacaatgctcctgcaatacctgcaagggctgctgataaacaataaacaaaaaccttatatgtagctggattataccctgtaaaacgtgctctattttctgagtctcttatggcaataagaaccttaccaactcttcttttaactaaaatactgcataatataaatgacaataataaaactccaaatgttacataaaataaaactaatttagttaatggagagtttactgaatatccaaatatagtagtataatttgtaagtccatttgatcctccaaaatacccctgcatacctatcaataaagttgcaagtgctgctgatagtgcctgtgataatattgaaaaataaacacccttaattctatttataaatgttaaatatcctataactgctgcaagcgctactggaaccaaaactataagtatgagtgtaagagtagaacttttaaacggttcccatattattggtaatttttgtattccactccatgacataaaatcagggaggttatttcctgatgcttctaattttaaatgcattgccatacagtaagctccaagcccaaagtaaacaccatgacccaaactcaatattcctgtataaccccaaatcatatctattccaagtactattaaggcaaagcacatgtatttacctaataaattagttctaaaagaagacatataaaatggtgctgttaataaaaatgtaaatataagtactgctaaaatagtttttccagaaattttctttgtgaattttttctttattttatttttaacgctgccttccataatttctgcacctccataaattttctaagtataatttctaaaatataattaatcatcaagtgcacgactacttattgtaaatatgcccttaggcttgaattgtaaaactataattacaactgtgaatataagaacttttccaagtgatgcacttgtgaaatactcaaaagatgatcctccaagtcccattacaccagacccaactacacatcccactattcttcctacgcctccaacaacaactgtcataaatgtgtcaactatataagtagaacctattgttggtccaactggtccaagtaatgtaattgctgctcctgcaatacctgcaaatccagatcctattgcaaatgtacctgcatctataagacttgtatttactccaagacttgctgccattgatctattctgcattacagctcttacatttctcccctgttttgtcttgtacataagatatgcaattaataccacacatactatagaaaggattaatataaatattcttttataggataaagaaaacccattgcttaaaacaaagttattgtttaaaaactgtggacaatctacgcttacatttgatgttccaaatatacttcttgcaagctgttgtaaaacaagacttacccccatgttacaagaagactatcaagtactcttccatataaatgttttattatcaatctttctaaaaataatccaattaaacctgctacaacaaatgatgctaataatgaaactaaaaaataactgctaaacattgaacttggcagatattctctaaatatattctgcactacatatgtagtgtaggcaccaatcattatgaattcaccatgagccatatttatgattcccataagcccaaatgtaattgcaagtcctaatgatgctaacaataaaatcgaactaatacttaaaccattaaataattgcattaaaaaattttccatatagctccctgcccttcttttttattcattaaaattaataatttaaatcatatgcattcataaacttttatttgtaaattttcagctgaaatggtacctgtaatttttatttaaacccaggtaccatatttgagtaatactgctaataaacttaattttttaactatttttacctaaccctgcacttgcagcccagtcatattcttttaaccatggatctggtgtaactctatcatctgtctcccatactatatcaagctgaccttgtgcattacatttaccaactaagaccttttgtaatgtatgatgtgaatctcctttagcaattgtaaccaaaccttctggtgcattgaattcaacttccccactttcacaagcctttataacatcttcaacattaaacgaacctgctttttcacaagctgctgcccatagatatacaccttcatatgcattttcaattggatcaccagtaactctatcttcaccatataatttcttaaatttttcaacaaatgtcttgttttctggagtatctaaagtctgaaaatagttccatgcaaataaatgaccatctgcatattgagcacccatacctttgatatcttcttcatagcaactaaaagacattgtttgaatcttatctggagtaagacctgcatctttatattgtttaaagaacgcaacatttgaatcaccattaattgtgtttataattatatctggattagtctgctgaatctttgtaatcatcgtacttaaatctgtataacctaatggaatatattcttcaccaactatatcgaagttatatgaaggctgcatagctttaattattgtattagtagttcttggatatacataatccgaacccattaagaatacttttaatttatttccatccttaggttttatgttgttctgtatataatcaattgctggaatagcctgttgattaggagatggagctgtgtacataatattgtgagaggattccaatccttcatattgaaccggataccatagcaatccattatttccttcaaatactggaagaacagctttacggcttgcagatgtccaacatccaaacactgtagcgacattatccttagttaaaagctttgttgctttttctgcaaagatagctgagtcagatgcaccatcttcagttacatattcaatcttctttccaagtactccacctttttcatttatctcatcaatggccattttagtagcatcaatcataggcatttcagacattgccattgtaccgctcattgaatgaagtataccaacttttatagtatctccacttgtagctttgctttctgagctttctactcctgttgcagttgaaattgcagaatttccacaacccacacaagcaattgctaaagatgctgataaagctaaagcccctaatttcttaaaaaaatttcttttactcattattaccactccttatctttttctaaataaaaaagacccttttagtaagttataattcttataactttattaaaagcgcctttactttttacttatttttttgtatttctttcagacatttactatatttatataataattgctttttgaccttataaaaaccagacaaatccgactttttcctataattttccgttgtaaacaattaaatttatttctttttctataatatttctatcttttttctatattttgtgggtgtttcaccagtatattttttgaacaatttagtaaaataatcaactgtagcatatcccataacatcacttatctcatatatcttcttgcttgtatcatgaagtagcttttttgaatattctattttcataattgtacaatactctatcaaagttatattcattatatttttaaactgctttcctatataatctttgctcaattccattttctcagaaataatatctataatatttccgttttctatattttccataataattatacatactctatttataaaattatcttgtttataaagcatgtacttatcagaaatatgctttaataaatttaatatatgaataacatcctcatataagttttccttagtaatactaactttcaattctataatgtatttcagccatggaaaagccaatataatttcttcccatattctatccactatatcttttataattattggataagtatctgcctgatcaatccccatatttacaatctgtttataaaaatcttcaaacatttctttttccaaaaattggttttttattatataggatgtccatttttttattttatcctgcgatatgacatatatattattattcttttcatatttttcaactaacttttcctctaatctcgtcaaaacttgagccaatgcttcttcttttaatggcttaataacatagtcaacagcaccaagctgaagtcctctcttagcatattcaaattcactgtatgtacttacaagcactaccaaaacatctatatttctttctctaataatctctaaaagttcgattccatcaataatcggcattcttatatctgttataacaacatggaaattatagctttcaagcaattctaatgcttcttgtccatttttagcctgctttgtaattttaaaatcactataattccatactttcatctttgatactatgaatcttaaacttatatcatcatcaacaaataaaacatcatacattttcatcacctgctttttaaaatctttaaactatattccatattataagtttcaattgcatcctttaattcttgaaatttttcaaagctaaaacatttatttattttgtctatattttcattaaatagatcaatactttctacactaccctcttcaagacattcaattaaccttttaataatgacttcattatcttctgtgttttttaatatacttcttaagtttttttcaactattatgttttcatctttttttaaaatatcaagaactttatagacttctacataagtattttgatactttcttataaatacttcaaaattcatattcactttttcataatctttctcctctatatactttctatttctcagtatttcatcataaagattttctgctcctatatatccgcttattccttttaatacatgaaatatatcatttacttttaaataatctctattctcaatcaataattttatttcttcaattgtttcgctgtaatttttaataaatctatttagtatatcaatatatagatttttattattgtcaagattataaattgctttttggtaatttatatgaattattggttcacttattatatgtgctatattaaaactgttttctcgaccattatataattcttcatcatcaattaagttttcttcatatttaaaaatattcttaagttttgaaatcattaggtttatatcaataggtttggcaataaagtcatccatctctaagttcctttctctattttgaacaaaacctaaaccatctgcactaagagctattatgtaggaatctctgcataatcctttttttcttatatttcttgtcgcttcatatccatccataccacccatgcgtatatccattaaaataagatcaaattgtttttctctacaaagatttaccgcttctattccaccgctgacaagacttactttaaacccataatactctaataactctttttccataattctatttatctcattgtcatctacaattaatacattaactttattaaaatgcacttttttattagtgtaattttcctgagaaatttgttctccttgttcctttaaaaccttctgtagatttaatacaactgaaaaagtgcttcctaatccatatgtactttttacggtaatatcaccttcaaataaactggcaagctttttagatattgcaagaccaagaccagttcctccatattttcttgttattgatgcatttgattgttcaaaagattcaaaaatatgttcaattttttcttttttaattcctatgcctgtgtcttccacattaaatttaatctgtattttttttaagtctatatttctccaataaacagaaagctttattcctcctgtatcaataaattttaaagcattagaaataatattcattaaaatctgattaagttttgtcatatcaccgtaaacaaatctcggcatattttcttctatttccaatttaaaataaagtccacgtttatttacttcatttaaaaatacatttctaatattcatcagataatcatttaaatcaaatacaatattctcaagttcaaatttattattttccagctttgaaaaatctaaaatattgttgattgtattcattaaatttttagctgcaaattttgacatactaactgctcttttttgagattcactaagttctgtgttttctagaacttgattatatccaatcaaagtgtttaaaggagttcttatttcatgactcattgttgctaaaaattcactttttgcattgtttgctttgagtaaatcttcatacaaaatattaaatcgttctgcgagcatcctaagctcttttgatccttctggctcaagattgtattcctttgtttttgaatatgtatcatttaatatatttgtataatttcttataggaagcataaatgatttataaaaaataataagaactactattacaagaacaaagcttattataagaaaagaagtctgtactgttaatgcttccattgtactattcattgaagtattcatctgtattatcattctactattaatactttcttgaaatttgcttattgaatctgaaattactttctttccttgcaaatactcttgattaaaaagtatttcaagagctttttcccttttttctgtattacttaaattttcatcaactacattcaatttatatcttaataatttctctggcatattatcttcatatatgtctaaactttcaattataagcttcattgcctttagttcagtgtccataagataatcagaatattcctttgcaagacttacattacgtttttcactttctgaaagtttcattgtattaagcttttctattaccttttctctatttttattaatctgaacttctttccaataatcatcaagatatccaaaatcatcagttacaacaaaatttctcactgcttcagtcatataatctgatgttttcaataatgtctgacttacttgctcatattcatatcttagttcctctcctgtcttttcattttctatgcatacatgtatatataaaacactataaattattgaatatattattaaaaacaataaacatgaaattaaaatatttatccacttctgacttatagaatatttcctcaccttaatcccccaaatcatttttattgaaatttttgtattttatccactataatatttgtatatattttttaaatttacaattgacgctccttcttggtaattaacgctaaagacttaactaataaagttcaactgagcaaatatagatataagcaaagaaaggatttacattatgacttcaaaaactgatgatattaatatattgattgttgatgatacacctgaacatatacatattgctagttcaatattaaaatcaatcaattgttcaataagagcagcaacaagtggacgttctgccttaaaattaatagacaagaaaatccccacattaattcttcttgatgtaaaaatgcctgatattaacggatttcaattatgtgaactattgaaatcaaatcctgcatatgaagacattgccataatttttattactgcttctgaagatgaatacagtataagtaaaggtttttccctaggtgcacaagactatgttgtgaaaccttataattcttctgaacttatagccagagtaaatactcatataaaattaatatgccagaaaagagaattaaaatatgcttatagtgaactcgataaattctgccatacagtctctcatgatttaaaatctccattacttgtaataattcaacttgtaaatctattatgttctgagcttggagagaacatctcttttgatataaaaagtattttagatcagcttacagtaaaatctgaagatacaattctaatgattgaacgccttttagagctctcaaaaataaatcaacttgaatgtacctttaaatcacttgacctaaaaagtatagtacataaaatttataatgaattattttcattagaacatgctcgtgatatttcatttaattgttcagaccttcctatgatagaaggagatgaaactcttataaaacttttatttcaaaatgttatttccaatgcattaaaattcactcgtaattctaatccttctaaaataaatattaatttcactacttcatcagatttcttatatataaatgttgaagataatggtgttgggtttgatatgaagtatagtgaaaaattatttaatgtatttgaaagactacataacaaagaagattttgaaggctctggtgttggattaagcataataaaaagaattatggaacgccataatggctatgttgaaatattcagtcaaattaatagcggtacaaaaatcactcttgtttttccaaacaaataatttttttcatataattcaacttatcatttataaactatagtaaaatattaattaataattttttaataatcaccatttttcttctaaatattaaaaaagacgtgttatggaaaatttccataacacgtctttgcgttatctctaaaatatactttcattataaatacataagagtttttggtcaattaaattaatacttaattattaatttaattgtgtttacattacttatttaacattgaggttccttaccaaaaacctgctctttaagccttaagcctgctggtgtaactgcaactccaccaagtgcagtctctcttaatgatgatggcaaactttttcctaccttatacatggcacttactgcatcatcaaatgggatttttgcttctactccagccataaccatgtctgctgtacataatgcagtaattgcaccttgtgcatttctctttgcacatggaatttcaacaagaccagctactggatcacatacaagaccaagtacattctgaagtattattgatccagcatcaagactcattttaggcgttccacccatcatctcaactactgctgctgctcccatagccgatgctgacccacattctgcctgacatccaccttctgcccctgataaagttgcattcattcctattatcataccaactgctgctgctgcaagaagaccttttatcaatccttcttcatctaattctaattgtgctcctgctgataaaataactgctggtagtattccacatgatccagctgttgggcatgctactatttttcccatagaagcattaacttcagatgatgataatgccattgccattgcaaggtttgttgccgttccagtcaatgtctttcctttattaacataattattaatcttaaatccatctccaccgataaggccacttactgaatatacttggttttctctaccttcatttgccgctgaaatcattacatttagatttcttctcattttttctattacttcttctcttgtaagtcccttttcttctacttcacatcttattgcatattcacttaatgaaatattatatttttcacatatttctaataattcttctcctgtctttgcaagcatcctcacatcatccttcctattcatcttcttttgctgggctaattgaaataaccttatatacaagttcaagactttcaattttctttctagtctctatactcaccttattgtccatttcaaaaatcatagtagcatcttcaccttttctgtctctgaaaaccctcataaatgctacatttatattttcgctatataatatatgtgtaatactatgtataaccccaggcacatccttatgttgaactattaaggtttcatacattccagtaaaatctacttcattatcatttacttcacaaattttaatgtttcctccaccaattgatgaacccatgacttcacaatatttattatcaattgtcctcattacaaatttaacagtgtttggatgtacatcacctaaatctgcttctttaaataaaaatttcattcctttttctttggcaatatccatagaatttctaagtctttcatcactaggttccattcctaatattcctgctactaatgctctatcagtaccatgccctttatatgtctttgcaaaagaaccatgtagtaaaaatgttacttctgcaatctctccaccagctatacttcttgcaattttgccaagtcttgctgctcctgcagtatgtgaacttgaaggtccgatcataataggacctaatatatcaaaaattcctatacctttcataagtatctctcctcagtttaaatttatttagtgtaacttattttcatcttattgtttttctaatatttattaaaccacaatttataataactatctagcaaagcttataggtttataattattttatcactttattaaatatctactcataaactactaaaaatcaaaaaataccacaaaataaattgtggcatctttttcttattgtgttatttatatgagatttttttaaatgatttgtctatttattatttacataattctttaaattcatctgctacgaattgtacttgtgttccaactataacttgtaaactattcttacctggtcttattacaccagaaactccagctgatttaatgactttttcattaacctttgcttggtcttttatttctaaacgtaatctagttacacagttatcaatagatgttatattctcttttcctccaacaccttctaagattttagctgcaatttttgtaaaatcattgtctgcaagtgttacattcatttcatcacttgtatcgtcatcatcttctctacctggtgtctttaagttaaactttgtaattacaaaacggaatacaacatagtaaactattgctactgctataccaattggaattatcattaatccattcattgccattggagctttaaaacttaaaaaccaatctacaaaacctgcactaaaattaaatccagctcttactggtaacgctgcacaaactgctacagaaatacctgttaatactgcatgtactaaatataatcctggtgctaagaacataaatgcaaattctaatggttctgtaactccagtgaaaaatgaagatattgccgctgccaataataaaccgtaaactgcttttttcttgctatctttagctgtatgatacatagctaatgcacctgctggtaaaccaaacatcattactgggaagaatccagttaaatacatacctgtaacacctttagttccatttgctgaccagaaattagcaatttcattgattcctgcaacatcaaaccagaatactgagttaagtgcatgatgtaaaccaactggtatcaataatctattaaagaatgcatatataccggcaccaatagatcctgtagatactattgctttaccaaagtttactaatgctccatagataagaggccatgcgaagaataaaaccaacgctgctataattgatgcaaaggctgttactatagcaacacatcttttaccactaaagaatcctaagaaatctggtaatctagtatttttaaatttgttatagcaagtagctccaattacacctgataaaattcctataaattgattttgaatttttccaaatgctggtgatactgctgcttcatcaatacctttgaacatggctacaacttttactgacaatagtgttgtaatcataagccatgaaacaagtcctgcaagtcctgaagtaccatcattatcgtctgacattccaacacctacaccaattgcaaataaaattcccatattatcaattaatgaactaccagcttttattaaaaaagctgctgcgacactattagcccccaacctgttgggtccatccaataaccgattcccattaatatacttgctaccggtaaacatgctactggaagcattaatgatttccctaatttttgtaaatacttcatcataataaataagtccccttatattttattaaatttggtttttttgaacgcaaaaaagctgaaaagaataagaaatcttactcttttcagctaatgctcgaatttaatcgattacacgcacaatattaaaccatatattttatgttttaatattatcataataaaaattaataagcaatacttttttagaatttttagttacaaattctaaatctttctacatgcattgctaagtacgctatttcatcttcgcatacttttttatttaaatatttttctaatatttgcgctgcatctttagctactttatatgaaattttatatttagtctgtatttcctcaataaaatcgttttccaattctgaattagacattattctttttatagcaaattttatatgggttacaaatcttgcataatttaaagaatccttaggtattttcatattcaatcctttttctatgaaatcaactaccatactgcttatattagtacttttaattgtatcttttaagttaccaaaatttctatttgaatgaatatgtaaagctataagtcctgcttccccatctggtatagttacattaatactatcctttatcattctggctgctttttgtgctaacatatattctgttttatataatactttgatttcatcaagaaatggattatcaattatctctttattcttaattctttttattgaaaaatttaagtgatctattaatccaatataaattctttcatttaacttttcatttaagtctcgagatatctcagttattatcttttcacataaatcaaagaaatctttatctaccttttcaattatctgtttaaagtttttaagattttctgcattttccataatgaaaattttctctacttttgttcccttaggaattttatcaccgaatttttttccaaaaccgattcctttagaaaataaaatcttctcttttccaagcattttaatacaaactgtattattattataagcttgtattactattccatcattaacaataataggcataaactctcccctattttcatcagtattaaaataaacccttaatatattaggacatttttagctatattacaatataattatattttaatcgataaacttattatgtatattaccttatccctatattactaacaaaattattaaattacaatattgtttttatttttgtaacattttccattatttagtttttgtttttattctatttcttttaaacttatataataccttataaaaatagtcaaatcactgaataaaagtgatttgactattttttaaattaatattcgtaaaaacatgatccaccaataaattctcttaaaagtgaattctttggaacttcatctaagtttatttcttcaaaaaaacttaaaaatgcttttaatcttcttgcttctgcataaacttcactttcctgtggaactttttcaagttctttaagagcatatggttttaatacacctagttcatatactagtgtagaattgaacgttgcatcagcttcctcttggtatacaaaaatatttcttttttctcctctttttatagatgaccacatctttagcgtatcttcagcaccatagcctcttgaaagagagtctctaactattcttctaaccttacgtgaatcagtagttgaaattctattatgattatctatatttaattgtgttaatgctgatatatatatcttaaatacattttttcttaaatcatcgtatattaatttaggatttaatccatgaattccttctaatattaaaactccattttgtggcattttaactttatagccattccattccctcttacctgttttgaaattatattctggcaattctacttctgttccagtcataagttcttcaagatctttattaagcagttttaaatctaatgcataaatagattcataatcatattctccattttcatctaatggtgttttttcacgatctacgaaataattatctaaagaaattggtataggaataagtccatttaccctaagctgtatactaagcctgtttgcaaatgttgtttttcctgaagatgatggtcctgcaataagaattatttttacatcttctcttttgttaatttcatctgcaatattggctatcttcttctcatgaagagcttctgataccataattacatttttcaatccattattacataccttttcatttaatgttccaacttcaccaatcccaagtatgtttaaccattttttagtttctttaaatatctttgttaaacttttctgttctttaaatggttctaaagtaacaaaattatttctctctggccttcttaaaataaatccagattcatacttttgtaaatcaaataatttaattacgcctgtagaatatcccatgcattcataaaaataatcgtatcttccatcaagttcacaaagttgaaactcttccattttacatgtttgtaaaagcttaaccttatcttccatattataatttgaaaatatctctattgctttttcttttgatacttttattctttttataggaatatctttatcgattatttcttgcattctactttttatattttttaactcattttcagtcaatggattttctttatatatctctccataaatagctttacttatagaatgttctaatgttattttagcatctttaaataaatctaaagttgccttaatgaatataaattgaagagttcttgtatatattttcattccaagttcactatcaaatccaataagagaaatatcgccttcttcttctataatttcatttaattcataatttcgtccattaagcttgcatatagcaatatctttaactatcttctcatcattttcagcaattaagttatagaaagtcatacctttttttgctttaaacttattttctgcaatattaactttttcttttagcatttaatttcctcccatttctattaatcttacattgtataagtcataactgataaccttctacagtttccagcaaatcagatgtattatattatttttctccaataaattaaggaaatatccatctttatttattctattatttttttctacattctgtaaatagttatctactatattatatacaatcaatcatttttggctaaaaatatttccattggtatattaattatatttctgcaaatattatttttgaggtgttaaaaatgattatagtatgcattagaacaatattactttattctcttgtagtactcactatgagattaatggggaaaagacaaattggcgaacttcaaccatatgagtttgtaataacaatcatgatttcggatttagcttcattacctatgcaagatcagagatatccactgcttcaaggtattgttcctataataacattgttgtttttaaaaactttaataacacaattagaactaaaattacaacctgcacgtaatatcttagatggttcaccttgtatcttaatatataacggaaaaattaattatgatgccttaaaaaaacaacagctgaatttagatgaattatttgaagaacttagacttgctaagtgctacaatctagatgaaattcaatatgcaatcttagaaaatagcggacaaatgtctattcttcctaagaattataatagttcttctggatcatcagattcgtctagtggaaaatctgataatacttctacacaaaaagttgtactgcctaaaattcttatagctgatggaaaaattaataaacgttctataacatctatgaacaaaagcgaagaatggataatgaaagtactaaaagatcatgacatcaactcaattgataacatacttgtggcaatgtatgatactcaaggaaagttttcagttcagtattatgatgattatgaaaaggagtgttgtaagcaatgaaaaatgcaataatatcagtaattatttttttcggattattaattggcattttctttttaaataactctgtaattgatttatgtgattcaataaaatataaaacagatgatatggaagttatactactaaatcaagattatgacgaagcttatgataaagctgtagaactactatcttatttacaagaaaatgactttatcgcttctatatatacaaatcatcaagattttgatgctttaaggcatgaagctgtacgattgtgcttatacatttctaaaaacgatattggagaggcctattcttctttacattttataaaatacagtgctcagacaattaagcatcttcagtcagtaacattaggcaatatattctaaaatatattgcctaatgttttatattttattttggtgtataagtttaataattaaaatttgaatgtataaatccaaactaatccatgtatatttcaattaaattatgcacttagaaaatatgcatatttcaccacttcaagtgcatatttataacactttctgtatatattattatattttatgcatattactcaaaaaataatgaatatttttgcgtaaatctattgatttttattcactataaatgtataattataaaaaacagatttattttagtaaatttaatatttatttacatatttacaatgtattataagagggggcttttaaaatgataaaatataataaagtagttttagcttattcaggggattagatacatcaatcattattccatggcttaaagaaacttacggatgtgaagttatagctgtatgtggtaatgttgggcaaaaagatgagctagatggattagaagaaaaagcaataaaaacaggagcatcaaaattatatatagaagatttaacacaagaatttgttgatgattatatcttccctactatacaagcaggcgctgtatatgaaggaaaatacttacttggaacttcttttgcaagacctttaattggaaaaagattagttgaaattgcacaaaaagaaggtgctgatgcaatatgtcatggatgtactggtaaggggaatgaccaagttagatttgaacttgctgtaaaagcatttgctccagaaatgcctattatagctccttggagaatatgggatataaaatctagagaagaagaaatagaatatgcagaatcaaaaaatattcctttaaaaataaatcgtgaaactaactatagtaaagataaaaatatctggcacttaagtcacgaaggattagacttagaattcccagaaaatgaaccaaaatacgctgaaatcttagaactttctaaaactttagaagcggcaccagatgaagcaacttatataactttaacatttgaaaaaggtattgccgttgctttaaatggtaagaaaatgaatagtgttgaattattagatgaacttaataaagttggtggcgaaaatgctatcggtattactgatatggttgaaaatagacttgtcggtatgaaatcaagaggtgtttacgaaactccaggcggaactattctttattctgctcacaaagatcttgaagaaatatgcttagacaaggaaacttctcactataaagaacaaatagctttaaaatttgctgatttagtatataacggtcaatggttcacaccacttagagaagctttaactgaatttgtaaataaaactcaagaaactgttactggtgaaattaaattaaagttatataaaggaaacatcattaatgctggtatgacttctccatactctttatatagtgaagaatatgcaacatttggggaagatggtgtttatgatcaaaaagatgctgctggatttattaacctttatggactaccatcagtagttagagcaaaaatgcaggcaaaccttaagaaagaggttaaataatatgaaactttggggcggacgttttaaaaaaggtactgacaaattagtaaatgattttaattcatctatacgcattgactcacgaatgtacaaggaagatatacaaggcagccttgctcatgcttccatgcttggaaaacaaaacatcatacctcaagaagccagtgatagaatcacttctggtcttcttgaaatactaaaacgcattgaaaatggtgttattaatgtagatgatacatctgaagacatccacagcttcatagaaagtacattaacttattatattggagattatggtaagatgcttcatactggaagaagccgaaatgaccaagtaactttagattttagattgtatttaaaaaatgcaataacagatttaaaggaagatgtcatcgctttagaagaagttcttttagaaaaggcaaatgaaaatattgatacgattatgcctggttatactcaccttcaaaaggcacaacctattacatttgctcatcatattcttgcttatgctgaaatgttcaagagagattatggaagacttacagactgttataagagacttgatgaaatgccacttggagcaggtgcacttgcaacttcaacttatccaattgatagagatgctgttgcacgtgatttaggtttttcaaaggttacattaaacagccttgattcagtttctgacagagactatgccattgaaacattatcttgtctttcaatgataatgatgcatctttcacgattctctgaagaaattattctttggtgcacaaatgaattcagtttcattgaacttgatgatggatatagtactggaagcagtattatgcctcagaaaaaaaatcctgatgttgctgaacttgtaagaggtaaaacaggaagagtttatggagatcttatgactcttcttactgtaatgaaaggtattcctcttgcttacaacaaagatatgcaagaagataaagaagctgtttttgatggtttggatactgcaagcctttcacttaagactttctgtggaatgattaaaaccatgaaagtaaaaaaagaaaatatgagaaaaggtgctggccttggtttcactaatgctactgatgttgctgattaccttgttaaaaaaggaatgccatttagaaatgctcatggtgttgtaggagaaattgttcttgaatgtattaacaagaataagatgatcgaagaacttactcttgatgaattaaaagaattttctccaatatttgaagaagatatctaccatgcaattgatcttattacatgcgttgaagaacgtaaagttatgggcggaccttctacagagtcagttaaatatcaaattaatgcattagaaacatttattaataaacacacaatagaacaaaactaaataaacagataattatataacttaaagaagaatttttaatattatttagaaattcttctttaaaaatatttaatggttaaggtaacttagctattacctaaaatcggagggctatataaaatgattaaagtaggaataattggtgccacaggatatgtaggcgttgaacttttaagattattattatcacatcctaaagttgaagttgtagcattaagctcagtttcatttgaaggacaggaaataagcaatgtttatgtgaactttctaaataaaactgatttaatatgtgaaagtgcaaatgatgttgtggaaaaagccgatgtaatcttcactgctctacctcatggattaagtgaagatattgcaaagacagccatagaaaataataaaatctgtatcgatatgggggctgatttcagattatcaaatgaagaagaatatgaaatatggtatggaaaaaaattcactcaaccagaattacataaaaattgcatttatggacttccagagttaaacaaagataaaatcaaagaatgtaaattaattgctaatcctggatgctaccctactactataaatctaggattaatgccattattaaaacattcattaattgaaacaaaaaatattgtttgtgattctaaatctggaacaacaggttcaggcagaggtctttctcaaacaacacacttcccagatgaaaatgaaacatttgctccatacaaaattggtggacatagacatacaccagaaatcgaagaaattttatctactatagcagatgaaaaagtaactgtaacattcacacctcatctacttccaattaacagaggaatagtttcaacaatttattgtactccaaaagaaaaagtaaatcttgacgaaatacataaactttatgaaaactgttataaagatatgccttttgttcatgtacttcctcttggcgaaactgcttctataaagaacgtaagattttcaaatgactgctatgtttctctacatctaaatcatagaaaagatcaaataataattgtaagcacgatagataatatgataaaaggggctgctggtcaggctattcaaaatatgaatataattttaggatttgatgaaactgaaggtctaaatcttatagcaccagcgttttaatcagttaactatcaattgaattaatagggggttttattaatggaaattaaatatatagacggtggagttactgctccaaaaggattccttgcatcaggcatatattgcggtattaaacaaggttcagtaaaaaaggatttagctttaatttattctgaagttccagcaaaggcttctggaatgtttacaaaaaataaagttaaaggagctcctatttatatctgcaaagatcacttatctaacaaaaaagctcaagcaataatcataaatagtggtaatgctaatacttgtactggagatgatggattaagtaaagcaaaaaagatgactgctcttcaggctaaagctttaaacttaaaagctgatgatgttttagttgcatctacaggagttattggggttcctttaaatattgatgcaattaaagatggtattcctctacttactgaaaaattatcaaaaagcggaaatcaagatgctgcttctgctattatgactactgatacatttatgaaagaacttgctgctgaattctatattggagatacaaaggtaactctaggaacaatggctaaaggttctggaatgatagaaccaaatatgggtactatgctttcatttattacaacagatatttctatttcacctcaattattagatgaagctttaaaatcaactgttactattacttataacagagtaagtgttgacggtgatacaagtactaacgattctatttttattttagctaacggacaagctaataatcctaccattacagaaaaagatgaaaactactatacttttgtaaatgtactaaaagaaattaacacaataatggcaaaaaatattgctaaagatggtgaaggtgcaacaaaattattagaatgtcaagttattggggctacaaatgaaaaagatgctgtcttatttggtaaaagtgtcataaattcaagccttgttaaaactgctatgtttggtagtgatgcaaactggggaagaattctatgtgcacttggatatgctaatgtagattttgaccctgaaaaagtggatgtttcatttgaaagctgtgctggagaaattgaagtatgtaaaaatggaagttctgttgcttttgatgaagataaagcaaagaaagtcttagatcagaaagaaataataattaaaataaacttatctcaaggtgaatgcactgcatatgtatggggctgcgacttaagttatgaatatgtaaaaattaacggagactatagaagctagaattcagttaacaagtaacagtaaagatattccgtaggaatatccaccttaactgctaactgctaactgttaactgtaaactataataattgggggtattaaatttgaatcattcagaaagagctgagatattagttcatgcacttccatatattcaaaaatatcgtggaaaaaccatcgttataaaatatggcggaaatgcaatgataaatgatgaactaaaagaaacagttattaacgatattatattaatgaaatgtgtaggtatcgaaccagttgtagttcatggtggtggacctgcaatttcagatttactaaatagattaaatcataaaagtgaatttataaatggattaagatacactgatgatgtgaccatagaagtcgtccaaatggttcttggaggaaaagtaaataaagacttggtttctttaattgaaaaatttggtggtaaagctctagggttatgtgggatggatggctctttaataaaggctaaaaaaatagaagaaagtgatttaggatatgttggtgaagtaactgaagttaacacagatattttaaaaacagctatgaactcaggatatattcctgtaataggaagtgttgctttaggtgaagatgataacaaaccttataacataaatgctgatacatgtgcttcaaagatagcttctgcattaaaagctgaagaattaatgcttcttacagatgttcctggtgttatgaaagaccctagtgatgcttcttctcttctaagtacattaagacttcatcaaattccaaaattgtgccttgaaggtgtaataaaaggtggtatgattcctaaaatagactgctgcgttgaagcagtaagaatgggtgttgaaagagcaattattttggacggacgtattcctcactctattcttcttgaattattcacaccagaaggtgttggaacaatgatatattaaatcagttaacaagtaacagttaacagtggaatgatttaattaagatctgctaactgttaactgacaactgctaactaaaaaattgggggtattaaacatgacatatgattttaatgaagcaaaagcacatttagtaaacagttatggccgtttggatccagtaatagttaaaggccatggcgtttatctttatgatcaagataacaataaatatttagattttacaagtggtattggtgtaagttcccttggctatggccataaaaaatgggttgaagctacttcttctcaactaggaactttagttcatgcttcaaatatatttttaacagagccaagtgttaaacttgcaaaagagttaactgaaaaatcaaaaatgaagaaaatcttctttggaaactctggtgctgaagctaatgaaggtgcgattaaaatagctagaaaatatagctttgataaatacggacaaggacgaaatacaattctaaccttaactcaatctttccatggaagaactataacaactttaaaagcaactggtcaggaaaaatttcaccagtacttctacccttttactgaaggtttcaattatgtaaaagcaaatgacttaaatgattttaaagaaaaacttacacctgatgtatgttccataatgcttgaagctattcaaggtgaaggaggcgttatacctctagataaggatttcgttcaagaagtcgttaaaatgtgtaatgaaaaagatgtacttgtaatatttgatgaagttcaatgtggtattgcaagaactggtaaattatttggatatgaaaattttgatgttagacctgatgttgttactgttgcaaaaggtttaggtgctggacttcctattggcggattcttatgtggtgaaaaagttcaagatgtattccagcctggtgatcacggctcaacttttggtgctaatcctgttgtatgtgcaggtgctttagttgttcttgatgagctgtgtaatgaaaaatcatacaatgaaatttctgaaaaaggtgcatatgtaaaggaacttattgaagaaaacaataatcctcaagtagttgatgttagaggaatggggttaatgcttggaattaaagtaaaatgctctccttctctagttcaaaaagaatgtattaaaaaaggactatttgtattaacagctggcaaagatgtagtaagacttcttcctccactagttataagtaaagcagaattaaaaaatggtatagatattctacttgatgttctatcagaaataaaataaataacataacaacttacaattaaaatatgggggtatttttgtgaaaaaagacttattaaaaatggacgatttatcaaaagaagaaattttagatatattaaatttagctgatcaattaaaatatgaacaaaaacatggtatagaacatcctcttttaaaaggaaaaagcttaggtatgatttttgaaaaagcttctacaagaacaagagtgtcttttgaagttggaatgtatcaattaggtggaaatgctttatttttaagtgataaagaattacaaataggcagaggtgaacctattgaagatactgcaagagttctttcaagatttatacaaggtataatgattcgaactttttcacaaaaagaagctgaaactctagctaaatactcttcaatcccaattataaatggtttaactgatgatgagcatccatgtcaggtattagctgatcttatgacaataagagaaaataaaaatattcttgaaggattaaaggtagcttttgtcggcgacggtaataacatggcaaattcacttatgattggctgccttaaagttggtatgaatttttcaattgcatctccaaaaatatatagtgcttctgaaaaatatttatctcgtgcaaaagaaattgctgaaacagaaaatgttgagtttaccattactacttctcctatagaagccgttaaaggtgcagatgtagtaataactgatgtttggacaagtatggggcatgaagaagaagcacaagaaagaattaagcattttgaaggatttcaagttaataatgaacttttaaaaaatgcaaatgatgatgtcttagtacttcactgccttccttgccatagagatgaagaaataacaagtgaagttcttgaagcacatgctgaagaaatctttgatgaatctgaaaatagattacatgcacaaaaggctgtccttgtaaaattaatgaaataataaaccaattattaaaccatatacagactatatttcaaagctattctaagcttatatggatcgataaaaaataacatgaactgctataaaacaattcatgttatttttttattttaatatgtggaaacaaaatttacttattaaatatctaaatttatgcatttattaaattcattgatgcaagtctacttctcaatgtataccctaaaacagtagataatgctatcttcaatccatctccaattaaataaggtataacccccataaacatagcttctacaaatcccaattttaattgaaatgctaaccatgctgttccaaatgcatagcatattattgttcctataatcattcctactggatacatatacattttgtcttcaaacttttcaacaaatattcctgtaaatatagcacaaaatataaatcctataaggtatccacctgttggtcctgcaacaaccgataatccggctgaaaaaccaccaaatacaggtaaaccaatagctcctaataataaatataacaagaaacttatagtaccctttttacatcctagtacacagcacgaaatatagataacaagatttgctaatgaaattggtactggagtaaatggtaatggaatcgtaaatggcgcaacaatacatgttatagctgtcattaaagctattgtaaccatgtttttagttttcatattattcattatttatcctcccactcatcatatataattttttccaataatttcataagattagtataatactaagaaaagctattgtcaactttattttattctaagttaacaatagcttttcttaatcttttaaccaattaaatgattccttttaatttatatttactaatcaaaatttatttccaccaagtctccacaaacttactttatgacctctttcactgatcaccttcatccatttgtttagagtatctttatctgcataccatacttcatgtttaatattgctttcatctatatattcaaaatatatacatccactagtagaatccctttttttctcagatttatacttttctaaaagttcttctgcttttttttcatctacagatgttgtttttccattttcgtcccaatcaaagccaccacttgcaactgcaaactcttttgtacctggaactttttccatcttatcaatcaaatcatttataaattcaggattagctttttcacctggtttagttgaacttccatgaagattatagcacatcattacataaactggcccttcaccaaaattaatatcttctataggtgtattaggctctagtataattcttaatttcaaattagatttttcacagtaataatataacttatttataaactctatatatttatcccataattcaatattattttttattccttcaaaatcaatttctataccatcaaatccattattaatggcaatactcgttatatcattaacatatttattctgtaattcagaatcagataatatttcttttaataaatttatatctttcatagaaaacttattatcatctttctttacatcattaacaaaagttatatacttttcataattctcagattttgtttcattaaaatatttaagcaattcatctggaataataatttcatatttattatcaaaatatgcttcaaaatatgaaacactgcctaactgactcccaagtgtacttacctcttcatcaacatctagattccaatatgccgcccacgctgatattttgccaatactttcatcaaaaatactatttctattttcacttattgtttcattattgacatccttattagctgtacatcctaaaaaaataaaaattgatgctattagactaaacattaacatatacttttgtttgtttttcataattttactcctgtaatcacattcattggaatcctcatattaacaaattttttgaaatatttataatatctaatttataaatttttcacaaaccaatttataatattttcaaagcaagttttagtaacatatttcaatttttttattccttttaattcattactatagagttctttaccattagaatctgttattattagatttttaaatataccatcatatacatcatcagcaatatttctttgactatatccatattcatcccatgatgattctaaatacacagcaccaggtctatttagtgaattatcaaattttatgtcatttgccataagctcatcatctacatataaaagaattttgtccccattaacatcaatatttatatatctatcaccttcatcttttatatcaaattcttttttaacactatcaagttcttttttgaaaagtatctcttcatttccatttaacttttgaactatactaacaacattgtttgttaattgaaacctgacactactactattatcctcatttgctcttaaaactattgactgtgaacccaaaatatttccctttaattcaacttttaaattaatatccttaaaatcatcactatttaataattttaacactccttttccatttggtacacatgtaagagttattaaattattgttgtattcagcttttccagataactctttaaaattagctgctatactttcatccccacaacaaaatttatttctttttctttaccgatatcataggcaactctcataagcaaatgatttgttggccaatatgcctgaggctgtattctagttaaatcatatatagaattttcagttgtattaaaggaataaccttctctgttaaagttcattttataaagatctttaatccatttttcatttattttacttactctattgttagtaccaaattgtcctgtatttgaatgcataagtgtatataaatctagtttctttccaagttcttcttcatatatacgtgtacttgtttcataatcataatctatacgtgctttcatttcttcatatgattctattggaacattatcttcatctctaataaaatccattaaataatggttataattcctgcgaatattaggtgcagcttcagaaaattgtagcgaattcattcttcctaaaaaattcatatccttatcaaaaacatttatatattcaagtctatatccattagttccaagttcccagtacgtacttttttctaaatcctttaaatcatttggttttaaaaattttgagtcttctttttcaaatttatctgcataagtaagaatggttgatttataattatattcttccgtaatcttctgtgaaaaaatagctgtgtctgttcttccatcttcaaacattaaaaataaagatttctccggaagtttttttcctttttcataataatctaaaatatcttgttgcgttattgtaacatagccattatctcttaatgcttttaaatgtttgtttaatctatctgtacttattaatgcatcagtgccatttctatcaactccaaagtaagaaacagctataaatcctgtatctgtagtattgcttataatattttgatcgtatggttcatattctgaaaatgacaataatgatcttataataattaccaataaggaaattaaaataatcccttcacatacacttctaataagttttattttatctttacgttgtggtgaaaaaacattacttttcattgagcagtcacttcctttttttctttcctcttcttagctttctgtgcttttcgtgcttctacttctgcatctttacttgtcattcttgttccccatgtagatttccagaaagtcaaaactgcaattggcatctgccataaaagtactgcttcatagtataaacaaaatatcattccaaatatccatgttgtacttttccttaaaagcatctgggcaaaactcatcaaaagtgacatcattaatagtcccacaagaaatgttgttggaaaaacgccatatactattggaacataaataagattgtaaactaccactactggcgctaacacgggtactaaaagaccaatataaaaaaacaacatcataaacggttcttttttccatatgaacccaccagccattattgattccctaagccatgatcgcttccatctcatctgttgctttatgaagactttatatttattaggaactattgttgaacaaactgccgtatcctgataactagtacgataatttttaagtacaaaattagtcattgctctatcatcaccaaaagttgctttctgacctaaaaatttctgatttaaccaagaatctaaattttcaagtactatactttttctataacatgataaaggtcctgaaaggcatgtaacagaatcaaagaaagcctcagctgctttcataactctgaaagctatataatatcttaccgactgcattttagtaagtgtatttgtatatgtgtttgctacatctgttcttcctgagactcctcccatcttgggatctttaaagggttgaactaaatttcttattgcaaatggatctaaaaaactatctgagtcaacaaatactacaagctcatttttagcttcttttacgcctcttgcaagggcttctctttttcctttattatcttcttgaacaaaatattttaatctctttttcgtttcaaatctctcagcttcattataaagagtatctattgttgtatttatcctttcaactgagttatcacttgaatgatcatcaacaacaattacctctaatttatctactggataatcttggtttatacaacttaaaatagttctatctatccactcttcctcattaaaacatggaataattattgttacacttggtgtaaaatccatatcaattggaaatggcttatacatcataccaaagaaatatctgcttaataaaaaaactgccgcaataatactgtataaatataatattttgttaaatctaaaatatattacactttctgctctcattaatactataaaaaatgtaatgaaaaatagtaacatacttgatattaaaagcatatattttccttttttcttatttttatattctgataaggatggttcaaatactataccacatattatttttccgtctctatcaatagtatctcttactttttttcctttaattttaacattcatttcatatccctctggcattgaaccaggtaatatattaaactgtaattttaattcatcacatttattaagtatttctagatcttctttactattaagttcaattaatattccagttgttgaaatatcttgtgacattccttctattgatactatttctttttttattttcccttttatatttactttacatttcatctcatagcgtatacctgcatttttgctcataataaatcccataggatcatctttgtagtcatctaatgagccattacctctacgatctgtattctttcttatggcctgtttatctggaacatttgatagtaaacgtctatccttattttgttttaagagaatatctttgatcttattcataattaacctcctatattcaccttaaagttagttatcttcttatcaacaaaattaattaatttaaataatcacttaattttgcaattctatatctttcaccatatattccttgttcatttttagttaaaaattggtctaatgcctctgctgtataagatgcttgattattcatgtgcataactactatatttccttttttcttaacaagttcgctctctagcccctctaaaagttcttctccagaagcagcttcataatcatgagttgatatattaccattaataacataatcaaaaccacattgaaaagcagtttcaagtcctgatttgtttatatataatgtaggtggtcttaaatatggcttaagacttcctaaatccccaataactctatccattaccatatgtgatttattaagagaaatttttagttcttctgggtcagtatcaagtttgtcatgatcatatgtgtgacttcctatatcatgccctcttaacgcaattgttctcaataaattaggattggcattagaaatattactttcaatatccacatatttacctaatgcaaaaaatgtcccttttacattatgtttatctaaaacatctagtatgtcatttataacaacatcacttccccaatcatcaaaagtaaagaaaacagcactttctccattagtattaacaaaaccttctgtatccatctttgcctgctcttcttcattaaatccatgtaaatctacataaatatttccaatataatttttttgaagtatagcatctgcttcttttactgttctctgtggtagagcgcttaagtctttttttagtgaatatcttttagaatttatagcatctatttcctgcaattcatttagagttacaacagaataacctaattttttctttattggaacatataaattagtttttgagtcaaatctatgaatatacccattttcaacataattttctgtaagattcgtaatcatattacctactgtcatataatcatcaaacaaatctgaatccagtctaaaatatacaatttcaccttttcttaaagataaatacgtattaatattaaaataatcatttattatctcatcagatttccatcttctatatttagttataactggtgatttagtatatgtgaatagttcataatttttaaactcttcaagagatttcaatgaagaaagcgcttctctgacattttcattgacatatccatatcccggcatataagcatttgttttaatccctctatttttaagcattattcctacttcgtatatttcttttgctatatcttctgttgatttagatagtaatttagtattatttgttactccaccatttcctatttcatttccgtattctattattttattaattctttcaggatatttttctatttcatctttagtaacaaaaaaagtaccatgaccatttatttgttttaaactttcaagaacataatctaatgtgctctcattacttaatcccttaaatgtatacgttaacgaatttttagtagtataaatctctgaatttatatcaacaactcttttatcattaatatcaattaaatttttaaaatctacactatttaaatcaacttcatatttactatttggtttttcagctttttcatctgttatttcattatttacagcattatttgagttattcttatcttctcctataccattatgctttgatttatttgtattgatatccctatagttataattcaatgtagaattataagtattaaatattgtattattatctggaactatattagctaaatccgtaactttaacaactgccttcttattttgacttattgctcttaataaccattcaagcatttcaaatgttgttacttgatgctttttttcaacatccttttcttttattcctgattccgcatcaatagcgggtttttcattatttgttttattggcgtactctgtttcatctagtactccatttaattttatagatagaatgcttccatttttcaacctatttacatatccataagcctcttcataatttttaaaactttgataattcaaataactatcactatcaagtacatattcgttaccacatgcatatgctacttcaagaagttcatcactatacgtttcagacttacattttagaagatttaccttatcatttattatgtcttctattattttgttagattttgaaaaatcatatattaattcttcttttgatttatcatctacattatttttatagttaagtgatgcattccctatttcatgaccttcatcttttatttgatttaatatatcaggattttcagctgaatctataccagatactataaatgttgctttaaccttatatttatcaagtagttctaatacattagtcatcgtatcattatcatctattccttcaaaagatatagaaagaatttttgctgatatagtaacattacgaataacttgcgcttttttatctgtatccaatacgtttatcttattatttgacttttgataattattttcattataaatgtcaccattttcttttgtcttaccagaacctacataattcatatacatcattaatccaatagcaaacattattataaatgcaattcccaaaattataatttttcttttattcataattcacctttttttgtttaatttcaacatatataaatatattatacctattttatattctaatatataattaaacattaaaacattctaaaaactttactattttgtatatttttgtatttcatatttgtttacagtatataaaagcgtataaaaaaacagataaaaattaccactgtaatttttatctgtttctcaattctatttttctatataattaataacatttttaactactaaatttatacttccgtcaccatttcgtataacctcaaatttgctagaatcatgataagtttcttcatttatgtacaaatctatttctttatctatgttgagtcttactctctttaatttcttttcaacccatgttttatcaactgaaacctctgagcttaatccctgttcttttatataatttctaaaatcttctttggcctgattatccttctcaaacaattcctttgaaaattcatcaatgttaatcgtatcttcttcttttaatttagtttttatagcagttcttatctcttctgcctttccagcatcctctgtaatattttttctagtccaattttcagctgcctttacaaatgttttcgtcatatctctttcatttgttataatagatgcacccaaaaaattatttataaaatagtttgctccatactcttcatctttactacttttttgtttatccaaaaccattaagttatatctatcatcttcccttataggtttaataaaggcagctttttgtatcttctgtccacttccaggaagtcctgcgctttgtggaactattcctataccaatcttattattaacaaactgaacttcatgagtgaagttttttacataatccatttttaaaattccaatcataggaccttgatctgttattaatgataccacaattaaatcacccgctggtatgttaatatttcccttcataattatgaaaagctgacttgcaagttccttagataaagttattaaatcattatctatgccatttaaataatcctgaactacttcttttacaatatttctttctggattaaattttccatatttgagttcatcatctttaaagcacttctctatatgtttgtaaagaaatttatatatatcttcatcaagatcaatgctatattcatttaaaacaggttcctcagcattactatctaaaatatgtattactgcctcatttatattaatatcatttatgtattccatctttttcaccatccacttaaattaattacttagatattataatcttatatacatttaaaaaaaacccttatttatgaatatacttatttcacttaattactagtgtgcgatataatcaatttataaataaaagttcttttagaaaaataatatatattttagcgaggttatatagaatgttttatgattaccatatgcattgcagctattctgcagactcaacaactccaatgaaagacatgattgagaaatcaatagaacttggtcttaaagaaatatgttttacagaccatgtagattacgatataattggcaatccaaatgtctatgtggactatgataaatactttaaagacttagattcttattctaaagaatactcagacaagatatctataaaaaaaggtattgaaatgggattccagaatcatctattagaaaaatgctcaaaagacataaaaaaacatgattttgactttgtaattgcatctatacatacaatagataggaacgagctttacactggtgactatcataaaggaaaaacacaacatgaagcatatgaaggatactatggtagattattagatatggtgaaaacttttcatgagttttcagttttaggtcatcttgacttaattaaacgttatggtaattttaataatgttctggatgatagtattttttctaactatatagaagaaattctcaaaaaaataattgctgatggaaaaggtattgaaataaacacttcatgttttagatataatctacctgaccttacaccatcaagaaatattttaaaaatgtataaagatcttggaggcgaaataataacaatgggatctgattctcataatccatctcagattgcatttaaatttgaatatataaatgatgtgttaattgatcttggatacagatatatatgcagatttaacaaaatgcaacctgaatttataaaactatagattccataattttatatcctaataaaaaataattagtaagtgaggtattgctatgcatgaattagaaacaagaattattgatattgatgttgataatataagaaaaatacttttagaaaacaacgcacaaaaagttaaaagtgaagatcagattaatgatatatatgactttgaagatggaagattgttagcacaaaaaggatatgcaagaataagaacagttaacgatctacttctaaacaaaaccatagtttttatgacaactaaaaaaatgatctcacaggaacgttttaagattatggaagaaaatgaaactattatagatgataaaactatgggggaagggatttttaaatctttaggtcttataaaaaaggaatcaataaaaaaatatagagaaagttatagattatttaattcattaattgaaattgatattaacgataaaagtttttgtccatttccttatttagaaatagagacttcttctgaggaagaactacaaaaaatagtgactattttaggatatacattagaagatacaacatcagcaactatttatgacatattaaaagaaagaaatctatctcctcaaaatagtaaaggactttagttacttataaaacagtgaaaaaattactaatataatcttttcgctgtttttaatataaatgtctaactataaactttaaaattaatctagaaatgacatagttatttctagattaattttcacatgttaatttcaatatatgtattttctgaatatttcgcaattgaacacatgaacatatttttatgttactattgtaataagcattttttaaaggtatacttgttaaatatttctaattattatattttttactaatacaggaggttctatggatactaaaaatgaaaatcttaaatatttaaaactactttctaaacaatatccctctattgcatcggcttcaacagaaataataaatcttgaagccatattaaatcttcctaaaggcactgaacattttttagcagatattcatggtgaatcagaacaatttgttcatgtgttgagaaatggttctggcgcaataagacgaaaaatagatgaactatataataattctttgcttgattctgaaaaaagaagtcttgctactcttgtctactatcctgaacaaaaactagaaatcgttttaaaacaagaagataacattagtgattggtatagaataaatttgtacaggcttatcgagttatgtagatatgtttcttcaaaatacacaaggtcaaaagtcagaaaggccctgccgaaagatttcagttatatactagaagaacttcttcatgaggattctgatagcaaaaataaacatggatactatgatggaataattaacacaataattgaaattgaacgtgccaaagaatttataacagctttatgtcatctaattcaaagatttgtaattgacaggcttcatattataggtgatatctttgataggggaccaagaccagatattatcattgatactcttatagattatcattctgttgatattcaatggggtaatcatgatattttatggatgggagctgcctgtggaaatactacttctatagcaaacgttttacgaatagctacaagatattctaacctggatgtaattgaagatatatacggaataaatattcttccccttgctacatttgcattagaacagtatagagatgatccttgtacttctttcatcccaaaaaataatgataaaaattatggaacttccgaaatccaattagtcgcaaaaatgcataaagctattacaatcattcaatttaaacttgaatatgaaattataaaaagaagacctgaatttaaattagatcatcgacttttactagataagattaattataacgaaggaactatttctttaaataaccagacttatgaacttagtgataagctttttcctacaataaatcctgaaaaaccttttgaactgactcctgaagaaaggaaattaattgataaacttcagatatcattcttaaatagtgataaacttcaaaaacatgttctatttcttttcaataaaggaagtatttatttaacttataattcaaatcttttgtttcatggatgtattcctttaaataaggacatgacttttaaaagtatgattttaaatggagaatcttataaaggcaaagctcttttagatacatttgactgccttgcaagagaaggatattttagtaaacgaaatagcttagaaaagcaatatggcatggacatactttggtatctctggactggtgaatgctcttcattatttgggaaaaaggatatggctactttcgaaagatactttataaaaaatgaagaaacacatatagaaaacaaaaatccttattatgaatttagggactctgaagaaatgtgcaatatgatttttaaagaatttaacttaaatccatcagaatcaaggattattaatggacatgttcctgtaaaagatcgttttggagaaagtcctgtaaaatgtaacggaaaacttatagttatagatggtggatttgcaaaagcttatagaaaagaaacaggaatctctggatacactctaatttataattcatatggacttcagcttatttgccatgaatcattcaaatctattgaagatgcctttagtaaggaaacagatattcattcttctatgagaattgtagaaaagttagatagaaaaaaagttggtgatactgatattggtaaagatcttaaaaatcagattaatgatttaaaattacttcttgacgcatatagaaaagggcttatcaatgaattaatataactaaaaataagctagaattaaaatgttctagcttattttccctgttaatcaacttaatatactataggaaattatctttttaaatttatatatttaaaagaatttgttatttaaaactcacacttctaaactctgtcttatcacctctatgatgtgcaattgaatattcaaatggctgaccattatctaaaaaacctacctgttcaacttctaaaataggcatattagaatctatctctaaatattccttttcagaatcagatggttctattgcccgtattgtcttatgagcactctttattttaaggcttaattcattttcaatatagctataaactgatttatgtaatatatcattctttattcctggtataacacctataggcatatgtgtatattccaccacatgaggttcaccatcagcatatcttactcttattatgtaatatacaaaatcatcacatgtcatttttaatttagtagcaatctcttctgtaggatgtactacttcaaatttaattatcttagattcaacttttttatccttataactttcagtgaatccacaaaattgctttgacatactgaatccctctacatctgaattatcaaatgcttttacaaatgttccagcacctcttctcttcactactaggccctctgaaacaagttcatcaacagctttctttattgttattctgcttacatcataatattcacacatttctttttctagtggcagctgttcatttgggttgtatcttccatcaagtatacccttcctaatgtcttctgcaatttctttatactttgacatccatatgcactcccttttattcatgtcttaacctaattataacacgtttaaaaatagttaacattacaattaatagttctttaaattaaataaaattggaggtattaccttttccccaattttacttattttttatattaattattttcgtacaacttttattatgttctcttcttctattttaacatctggaacataactttttaataatgtaaatttaccacacagttcatattctcctaatgatgcaggtataaatatactatcacccattgatatcttttcttctccaccattatattttatagttccttccccatcaacacatgtgaataaataaaatctatcttcatcactagcttctttaacagaagtattaacttcatatttctgaattgtgaaatattctccaagacaaagatatgttttgtcatatccatcattctttattgttattccttgagtattttcacctttaagagaaaaatcaataacatctaaagctttttcaacatgtatttctcttcctctgttataatcatatactctataagttgtatcactactttgttgtatttcagcaataagaattccttcacaaattgcatgaactaaaccactttgaacatagaaaaagtcaccctttttaactggtatcttatttaaatacttatctaaatttccatcttctattgcttttttaaatgtttccttgtcacaatcttttgttccaacaattaatgatgctccttcttctgcatcaacaacataccaggcttcagtttttcctaaatcattttctactctctttgcatattcatcattaggatgaacttgaactgacagcttatctttagctgttattaatttaataagtaagggaaaatcttcagctatgcttatagaatttcctagaaatttattaccatattctttaatgacttcatcaaagcctttaccttttaattcaccattagcaacttttccagttccatttttatgacacgctatatcccagctttcaccaattactccttctggaacattatttctgaatttttctaaatcttttcctccccatattctttcataatataggttttcaaacttaattggatacatcttattccctccataacaatatctaaaagattattttgctaactctattttaacataaatataaaattcatttacatattttatttacataaaaaattgagaccttttaactcaaacaaattgaagtttttatcaaaaggtctcataactaattttcccaaaaataactttaataatataatttaaaatccgttattttcagcaacatttttaatccatcttccagatttttttatagtctttatttgtctagctaaatcaacagcaataaatccatatctgtttttgtatgcattagaccatgaccaacagtctattggagtccatgtatgataaccaaaacaatttgagccttcttctatgcccttatgaagatattctaaatgttcttcataaaactcaattctatagtcatcttcaattattccatctttgttgatatatttttcttccccttcaacacccattccattttcagaaatgtaccaaggaatattgttataattatctctaatatttatagctatgtcatacatacattgtggatatatttcccaccctctgtatggattcattcttcttcctggcatttcataattatcaaagtatttatcaggcatccatccatttgattcgtcaaatggctcttccttagctttagctcttcttggttgataataattaacaccaaggaagtctatagtgttattttttattatttctaattcttcacttgttgattcccaaagaacattgtcttcttttaatacttcaactagtctttcagtaaactcaccttttatagcgggatctaaaaatgaattgttgaaaaagtcctctgcaaactgtgcagctttaacatcagcttcatcttgcgatcttggataagatggagtaaggttaagaataatacctatcttaccatctgttttactacattcagattctttaaaagcttttatagcttttgctgaagctaaatttatgttatatagtacttgaacagcttttttaccatcaactattttaggataatggaattgatataagtattcaccttcaacaacaaccattggttcattaaatgtagcccaatatttaactctatcaccaaaaagctcaaaacatttttctgcaaaaactacaaataaatcaacaactttctttgattcccatccaccatatttatcatatagttcaactggtaaatcaaagtgatgcaaattcataactggaatgatatcattagctattaattcatcaattacatcattataaaatcttacagcatcttcatctacttcaccagtttcgaaatctttaataagtctagtccattgtattgatgttctaaaactgtttaaaccaatttcttttactaactttatatcctctttgtaactattataaaaattagatgctacatttggacctacaccattaaagaatgcttctggttctatatcaaaccagtgatcaaaaacactatcatgtttcttattaaatctaccttcactttgtgggcctgaagttgcagacccccaccaaaacttatcagggaatttacattttaaagtcataaaaaacctcctaaaacttgtccgtatttttaatatttaaataataattttaagcgttcacataatatagatattctttacttattttcacatataaactctttaattattttgtaaatgtttatattatcattataattgttatttttctcatagtcaacaaaagatatgtcttttcgtaaaaaaagcatacctttttattgaaaatattatgtaacatcattctaattaggagaattaagattaatattaacatatatatataactataaatttcttataaaatcccaaagctgattagcagcaatttcatgattaagtttgccaggatgctttcttgcaccaacagtttcctctgttgtattaggaagctgagttataaacaccttatcatcattaaactcattttgatatttttctatgctcctataaatatatttcatcataggagttccaagcattccataagcccatacaatctttgcctttctattattttttcttattttacataaaaattttataatagcattttcaaatcttttaatatcatttttattataatttccatcgtcatctatatgttgtttaaaagattcttttgtagtttcatctatccattctggagatgtaaatgcacctccatcattagttcctaaattcactacaataacatctggctgccatgattcaaaatcattgtaattaaaagcacctagttcttcatttatttttccattaactacaccgcacacttgttcataatacctaggtagtgcatgattaggattattatcccatccacaaagaactccccatccactttgagataatattctaaaatcagcatcaagttttttcgatgttataactgcataattatttgttgtactaaaccacatagatatccagtcatcttctaattttgctcctattgttccctctccagatgatatactatctcctatgaattcaatcttcatttttttctctggcactttttcaaatattccatcagtttttaattcatgaattagaaatatacatttatcatcagtatccataggttgaacatccttatatactcttacattttttataagttcattattcatacctctaaaaatgcatactaaagaatgtccctttgataacatttgtctactaacaagttcaccatttatctcaatacttatccattgctcataaatatcataatctgtttcaatatccatccataattcagaacctctgacgtttgcctcaaagccacttccagtccaaaaaagcgctatagaatcttcgttaaaagcatttctcccataaatttttatattttctatagcactaattttataatcttttaaatttccactcacaatacattcctccgttatacaatatattttcttagttctagttttttcattaaacgtattcatattacttatatattctataagtagctttatttaaacaatatcaaacctataaaacaatgctgaataatcgttataaaaatagaatattcagcacttatcaatatacaatttattttttattaatttctttgctagcagagttccatctattattccaatcaatacaaagctcatcataattattttttccctcagctgcagaatttattaaattaaaagcaaaacttcctccatatatgcctaagcatgcttcattatcaatcttttcaaatttccctatattctcttcagtaactctgtctggataaataatatttaaaccattagtctgtgccatcttttcatattctggtttatcattcttaaccagcattcctgcatctccagcataatttagaaaatctgtttcatctaaaagatactccatccacattttagcttcttctttattcttgctttctttatttattccaatgccatatgacggttctccatatagatagtaatcaccaccagcactcttcaacggaaaatattcaatagaatcagaatttaatgcatattgttttgcctcttcatacatatgaaaatttactactgcagaagctaaattccccttcttaataagctctaatccaccatcccattttgaactagtaaacggagactcaattagattttcacttacacattcatataaaaatttatatacttcgtaatatctgctgtcagatgaaaaaatattattttcattgaccatgctagtcatataatcattgctgccttcaatcgaatatattaatccattccatgatataagctgttcttcacctcttgcattagaatacaatggaactgcattagttctagttttaaccgctcttaatgcctctttgaggtcatctaatgattgtggcatctttgtaataccagcatcatttaaaatcttcatatcatacaatattccacctgaaactgtcatagataaagggatactataaactttatcatctatagctttaatatcactgaatctatatttatttaaagcctcaccaacactatataatggctcataataatctggataatctgataaattcatgtaagatggaataaccataacatctcctgccttattagcatttagccttacgatactgatgttttcatactgatctcctactgattcaatcttaatatcaatatctggatgtaatttttcaaaagatttttcatattcctctaatttatcagatatatttataaaattattcaaaaaaacaacttgctttttttcttcatgattatatccaataattcttaaagcaaaactacatattaacaaaaatactagtacccatattataatccattttttcttcatatatcctcttaccatatgcgtacttatatttaactataatattgcatatgttaaatataaatcgcaatatatattttatttagaatgcttttgtagataattatataatgcacctaacttattggcatcatttccataaacacatctttttaccaaaggttttatagttccttcaagaccacattcagtacccatcatataatcaagtcttttattaatttcgtttatataatcttctctttcgctaatagctcccccaagaactattacttctggatcataaatatattgaatattataaattcctatagccatattgtaataatatttatttacttcttgaacagcaatttcatctccatttttgcacatttcaaaaacttcaactccatttatacttcctttttctaatcctttaagtcttgcaatattattagctaaaccagctgtagatcctgtctgactccatgctttaaatttaggaataccttcctcatcaatctcataatcaaatgaacagtaaccaaattctcctccatgtttatgtataccaacatgtacttttttatcctttactattgaaccgccaatacctgtaccacatactataaatgccaaatctttattatcttttccagctccaagccaacattctccaagtgctgcacaatttgcatcattttcaatttccacttcaattcctgtaagcttattcaattcttctttaaagtttggtccatgaatatatggaattgcacttactccacctataactccagtttcactatcaactgcacctggagcacttatagcaatacctttaacatcaaactcttttttcatattatttgttatttctgctaatccattaaaaaaatctgaaatattacttgctattttaatacttccactttgaagtattttcccttcaccctctataacagaccattttaccgaacttccaccaatatcaaaaaccatataattattcataattagtaacctcatttcatattaaaatcatgataatgttaattttattatatttacaacacctatttttgaaaacatttactctaaaacttcataaatattgtttatttataataaaatatgtttactattactataacaaaaagcaaaaccttttaataaaagtataattaacttcattaaaaggtctaaagactattgtgaaaattgttaaaaatattaattaagaaaccattactccaagaattgtaacttctctatccttttcttcactaattacttcaatttcaatttcatatgtttttttataatcacactcctctaaaatttcagttacagtgcaatctccccatccatctttaaaatgagtatcaattaacgccttttctactccatttactcgtaccttaaacttcccactattttcagaaattgttttcttgtacaataaaatgatattgttacattcagtttctatcattaattttccaccttcattagctttgccaataaatctccatccattatgaaaaacctgaaagccttcttcatatttatgaaatccaataatctcttttggtcttaactccttattattaagtattcttccatttatatatctatcaccatatacacatttttttctaatgtattatccttaacttcaatactttcccctttattgtagttattcatatatatgtcttctaaaaaattcactaataattcacttattatttcatgaccatcatcattaggatgaacctcatcagtcagtaaatcactccattttaaattgtatttttcaactaattcattagcagtgtttctaaaacttatcataggaacattataattaaatccaatttttatttgtgcatcttgataattaacaccatctaccatggtcataaacacttctacaactgctggtttatttttactgcttaataattttcttatttcgctttcataagatattttgcaataatctgaatcgttatcattaactgctgcatcaacgaaaattatatctggatctttacttaaaacttgtttttctgctctgtgaacacctataagtgaacctgttgcacctacccctgcatttatatgcttaacatttactaatttaaatttattttcaaaccatttagatacaagctctacataacacttttcatatactgttgagttacatccttgagttattgatcctcccaaaaatgctattgttatatcttcacctttttctgccttttcatataattttagtattcttgaaatatcacccttatttactagtgacttttctattaattccttattcaatttaatactcatactaaaccctctccttaatacaatgatttatattttttattcaattctaaacttttctatcattttatttaatgattcagattgaacactaagctctgcacttgctgctgcactttcctgagctgttgcggaattttcctgtataacatttgaaatcttcaatatatcattgtgaactctatctattgcttctgcctgtttagatgatgcatcatttatttttgaaactaaatccgttgctttttctatattattaacaagttgccttaatgtactatcagtattattagctaatattttcccactatttactgcctcaatacaattttttataagacaaatactttcgcttactgcatttgaactttgacttgataaatttctgacttcatctgcaaccaccgcaaagcctttcccaaattcacctgctcttgctgcttcaatagctgcatttaacgcaagtagatctgtctgagatgctatttcatttattgcttcaatgattttttctatatcttttgatgcattttcaatattatccatagataatagcatgtcctgcatttttctattactttcttctatttctatcaataactttgaagtaataatatttgtattttctgcattttctgcattattctttacctgttcatttattttatcaatataatttgttaatttatcaacagaatatgcttgttcacttgaacgttttgataatatctgtgctgtatcagataatttttgagaattattatttacgttactactactttcctttattcctgatataacctctgttagtgattttgtaatattatctagtgatttttttatctctaaaaaatttcccttgtattcttctctagtattagtcattagatttccttctgaaatattgcctaaaataaatgatatttcatttatataagattttaatgtttttatcatattagaaaatgactctgcaagaattccaagttcatcttttgactcaacatcaatacttatgtctaaattaccttctgccatactctctactgcatcttttatcttatttattgttcttcctaatctgccacttagtcttcttgatatgaaaatacttataattattgaacatgtaattgttataatagctaatattgtattagtcattttaattatttcaatcttactaataagttcattacactgatcaatttttctttgcagtaatgatgaaatttctgtacttatttcctccattataggagccccttcacttctaaataattttaatccttcatcctgtctatctccaattacacttatggaaacattatttcttacttgtttatatttggctaagtttagctttatattctttatggcatccatttcttcatctgaaacaatataacctgatatagaatctaatgatttatctatattatccaaatatccatttagttcaacttttgccttatctctttcatcaccatctgaaaataaaaaatctcttacagcagaattgcttttttcaagttcaatccctaatttccctatatccccttgaataagtccatagttaactattgcataattatatttatttcctatatgatggagaaaaattaaccctaatacacctgatatatttccaattatcgaaatagaaataaaatatatcaataactttttccttattgatatattgttaaatttctctttgctgattattttagcctcaaaatttttcatacgtaatcttaagttctttaagccaattttcatatcagttcctccattcaagaaaagcagtaaatgttaaaacatctaccgcttttctaatatatttatcaaatagcaatgttacattcttccgtctgtagcatctaatccgattaattcattatgttcttttataaatttaacagtttcttcgactgtagtgtaagcaagtcctacataagtatctgctgctccataataaattgctatttttccgctttcagcatcagttaatgttgcacatgggaatataacatttgctacaaatcctctttcttcataccattcttctggtgtaagcattatgcttccagctctatataacacttttgatggacatttcttatctaatattgctgcgctcattgaataaactagcccattacaagttcccgtaactccatggtagaatattaaccatccttcatctgtttctattggcgctggaccacaaccgatttttattgactgccaccatccatttccgcctttttgcattacaattctatgttctccccagtattttaaatctggactttttgttaagaagatatctccaaatggagtatgtccattatcacttggtcttgataacattatatacttaccatctatcttcttagggaataatacaccgttacgattaaatggaaggaatggattttcaagtcttacaaatgttttaaaatctgttgtctttgcaattcctattgctgctccatcaaaatctccacaccatattacaaaatattcatcttccaccttaacaagtcttggatcatatgcataaagtggttgatatggcttaccatcttcatctacaaaatttattctttctttatcgaattcccagttaatagcatctttactatgacctaagtaaatatgtggtcttccatttattgtttctcctctgaatactccaataaattctccattataaggtacgactgcactattgaaaattcttgctactccttctactggatttcttccgattataggattttctgtatgtctccatattggtccgttaaatccttctggcttttcttgccatggcatgtttggtaaattatctcctaaaattctagtcattttcatatctccttttatctatatattatgttcttttttactcattaaattattgattattttattaattataattaaaaggttaagttttttaaaaattcttttccttcaattttcaaaatactaattactaatctatcttattcttttactgatcctgaaaccaatccactgtaaatttgtttttgtagtgttaagaatacaataagtgttggaatcattactactataattcctgcagaaattacttcccagtgtgcaccaaaaggccctttaaacttaaataaagttgttgataatgttaataagtctgcacttggtgtataaaggaacggagtatagaaatcattatataaacctactcctttagttataagtactgtaattactgctggtgaaagcaatggaagtattatcttaaagaatatttgaaaataatttgctccatctataattgctgattcatctaatgaaacagaaatattatctaagaattgtaagaatatataaatcgtcattatatctgtacctatataaagaataataggtgctagtctagtattgaataatcctaaagctgatattatctggaatgttgcaacctgtgttgctattgctggaatcataactgcaactaaaaacattccatttacaaatttggtgaacttagatttaaatcttgaaaatacataagctgccattgatccagtgagtactgctccagctaatgaaaatatcaatattataactgtatttttaaaaccattaagcatattaccttttgtaaatgcttctataaaattatcgaagttaaaaaaagattcaggtaatgttaatacacttgttgatgcatattctgtaccagttttaaatgatgcaaaaagtactgttaatattggtaatataaacactataactaacaatattaaaaatgcatatttgcatatattgtatatcagttcacttggtgttaattttttcatgctcattccctaaacctccttatttctaaatactaatttttgaatgcttattattagtatacaaagtattaataatatcattgccattgctgacgcgagtcctactctatgattttggaatgcataattaacagtttgaataatgaatgtcatacttccattaccaccaccagtcattatatatggtgtttcaaatgctgataatgcaccagttaatgctaagaataattgtaatcctaaaattgttgatattcctggaattattatatgtctaagctgttgccatctgctagctccatcaactcttgctgcttctaatatatctggtgatattgatgccattgctgctgcaaacattacaatgttatatccaacatatctccatacagaaacacctgccatagatacatttataaacttaggatcttgtaaccagtagtttattaatccatctaaatgtaagaaacttaatactgtatctaaagtacttcctggttgtaaaaagaatataaaaataaatcctattgcaacactatttattaatgatggaaagaaatatacacttttaaataaatttgaagctttacatccaaaagaaactaagtatgctactccaacacctaaagctatttgaataaaagatgcaatcaaatagtaaatactaacaaataaaggttgaaaatattttgggtcgcttaaaattgtttgataattttttaaacctacaaagtttttaaccttacttataccatcccagtctgtaaagctgtatcctgccattgatattgctggtaaataggtgaatactgcaagtaatactactggaaccattaaaaataatattgaaattataattttctgttttttatatggtaatgatgaaaatcctaattttcgcttttgcttgcttggaaaatctggcttaacatcaactttttctaaatctgttgtcataaatagcacctctctactttcttagtgaaaggcgatatctatgcacatatgaaatatcgccttttctttactttaacaattagatttctaattattttcctattgaatctattcctttaacccagctttcatttaatgatttcatataatcatcaaagctttgttttccatttccaagtccaatttcaataactgtcttaatccatgttggatcacttaaattgattaatgattctttttgtactgcatcaaaatcttttgcttgctctgttgtacctgctttttgttgtattaattcaacattaccgcctgtctttaagaaatcaggtaattcagttccttttaatgatgaaagcatgtttgaatcttgtggatatctttcaacaaagaacttaacaaaatcttttgctacttctttattttcactgtttttgtttacacccattctataatctgctgcaacttgaatattttgttttccatttacagtagatggtgctgccatgaattttatgttatctggattttgtgatttagctttaatttgtccaattgcccaagaacctaagcacattactccaatctttccatcagccattgcttgcttagaatattcccaatcagaagtcattggatcttgttcaacacattgatttgcaactgcatcatataataattttaatgatgtatatgttacagaacctggtaagaattcgttcttatcatagaacattttatttaagtaatctgtatctccagccattgaagtttcaattccatttgagaagtttgttaatgtccaagaatccttataatttgtatagtaaggaattacatctggacatttttcttttatttgttttaatgcattaacatattcttctggtgtttttggaagttctgttactccagctttatcaaatacttctttgttataaacaaatccatttgcatttgctcctgtagctaatccataaatagtaccatcaacgtttacatcacttaaataatcatatttttgtgataattcatcataagtacctaatggttcaaagaaatctggatattgattttttgttatattagcaggaatcataagaacatccccgtaatcatttgttcccattcttgtagaaattgtattttggtaatcatttaaattttcaaattttacagtaacaccttcatgtgttttttcaaattcctcagcatatgttttaaaagtttcatccatatcagttctatgtgttaaaactgttaatgtcttcccctttgaagatgagcttcctccactagatgtgctacttccacaaccaatcatagaagtcattgtcattgctccagcaatagctaaagccatacattttgtaaatttcattttacataccccgtttcttctaaattttatagctattcatataatttataatttttatttataattttttatttatatatatcctaaatttttgtatttaataaaatttaggattaatacctctgtaattgtttacttttatttgattatgttcctttctattggtccacaggcacagaagctgcatataaaacaactgaaggaaatactaaaaaataaaaatattattggtatagttacaaatctaagcataatacctgctgcaaatactaataagcatactgcaagtgttataattgaatatttaatgtttattattgataaaagatatgaattttttactatgtcttttattttcaaattaactaatatactcattgggtataaatatataaaagacataaacactattgctgaaatcactgaaattatgaacatcatgcagtaatatgctattcctgttaattgaaaatagtaaagaaatgcacatcctattacaattgcaacaatagactgtaatatacctaatataaatgattgcttccaattctttttaaatgcttctttaaaatcataaaaccaatctaccggctcatctttaaccatttttatagttacacttgtaagtgctccaatggctggacctattgtaactattggaatacaaaatattaaaaatataaaatttaattttaataaattggtaaattcacgacttaacgtctctattattagtggtaatccctgttttttaggagcatttctatctattcctgctccagcttttgcatagttagggaacaaaaatctaaacatttctatcactccatatttttatgttttaatttgttattgtttttgtagtttctttatcaaacaaatgaattttttctgtatcaaatttaatggaaacgccttgtccaatctcacatttataacttccaactgttcgaactgtaaatctaacatcatttgaatttacgtatatataagattcagctcccattaattcctttaattcaacttcaccatttatggtatattctttatctacaatagataaatcattaggtcttattccagctgaaatagtttttcctacatatccatcaaggcatccattttgctttttactctctggaagtagaatttcataatttgcaaatttcaaataaaactcatcgtctttctttttaagttcgcagtcaaagaaattcatctgaggcattcctataaaaccagcaacaaacttattacaaggacaatcaaataacttttgtggaatatcattttgttgtatataaccatccttcataacaacaattctatctgccattgtcattgcttcaacctgatcatgtgttacatacacaaatgttgtttgtaatttttcatgaagttgttttattacagctctcatttctccacgaagttttgcatctaaattcgaaagtggttcatcaaataaaaatactgaaggattacgaaccatcgatcttcctaccgctacacgctgtctttgtccaccagaaagtgccttaggtttacgatttaataaatattcaatatctaaatctttagctacctttttaattttttgatctataacttttttatcttctttagctaattctaatccaaatgctaaatttttatatactgtcatatgaggatataatgcataattctgaaataccatagaaatatctctttccttgggtgcaatctcatttacaagtctttctccaatatacatctctccacctgaaatatcttccagtcctgcaatcatacggagtgttgttgatttcccacatccagatggtcctactaaaaccacaaattctttatctttaatttctaaatttaaatcaggaacaacggttacattgcccggatatgttttaacaatatgtcttagtgatatgccagccataattagcctccttaataaactcttgtgtaaggtcttatttttacttacttgctttacttgatgtcttaattatattttttgcaacgcttcatgtaaacgtaaatcagcacttgcaataattttagtttatatacagtaaaatttgtttattctttcaagttaggattctaatttttatttaaaaacaaaaaaagaattacctaaaaataagtaattcttaaatcatattattctttatctctatataatctccatttatcattagcttctttttctatttttttagtatcttcagacgttatataattctgtataaatgtataatccagtcctatactttttcttaaataagtatatttatcatgaagtttactctcttcatcattttgagcagctatattttcttgaaaaactactggaatattaaatttgtttaactcatctatcattttcaaattctcttcactatctcgtaaacttgacattatgtctacagcatttgcatatctgtcttcttcaaataaaaactttaaaaatgcctttgatgcttctggatatttagtatttttactaatcccaattctatagtctccaatcatatttataacatttgtttctggtatcggaaacatacctaaatcatttttatccatccccaaatcaactaactgatttataaaatccgaattccaaattatcatagcagtctttccattaataatatcttctttacattgtgcccaatcataatttactatatcactttcacaatatcctgatgtatatattttttttacaaaatttaatgatttatatatttctccatcacttgaaaaaacatctttagattctccaattaatttatcttccatgtgaacattatataaatacggtattgtatctatccatgtattcatcatccaggattgtctataatttaatgcaataggaactattccattattttttatcttactacataccttaaaaaattcttcttccgttttagggtaagtatctataccaagattattaaatatttctttattataaattactccatgccataacgatgatgttggcatagtatatagtaaattatcacttccaagacctgatacataatcatacatattatcaccattaaaccctaaatcatctattggtagaaaataactagaaaattctctcttatttatatttgcaggaacaagtgttacatctggtaaatctccaactgctgcttttctttcaagaatttcttctacatcacctattaattctaaatttacatgcacattaggatatattttttcaaattcatcaacaagttcatttaattcattgctcttatccgtcctgttgcttacaaaatctatatttccatgaagaaaatttagctttttctcgtctttttcataattgaagcttttgcttaatgccacaatctgtatagcaaaaccaatcattgctaataaaattataatccagactctttttatatttttcaacactttaatcacttcacctttcattcataaacaatgtgaattaattctctctattatttctaaaattatttggtgttgttcctgttatttttttaaatgctcttccaaaagttattgaatcattatacccaaccatttgagctatttcatatacttttaaattcgtagttaataaaacttcttttgctttttttattctatattttgaaaggaaatcataaaatccttctcctatttcttttttaaataattccgataaataattttgacttaaataaacctcatctgctacatcttttaaggatatattcttattataattatttataatataatcttttgcaagcttaattacagttatattgttattaacatcattcaaatcgctatttaatatttcttttaatctttcatcttgtgttaaataatatttttttacattcaaagattcatctgcattttctttcattttcttaacaagtttagactgttctcttagtctccatattttatctgtatcatctaatatgtatacacttatattcaactcaataaagcaatcagatttattaactataaattcaaaaatatcgttataattattatttgtttttgtatttatataaaaaataatgtaaacagagtcattatatccaaatgatgaatattcaatatctttatggacatccataattccctttataaaatcatatagtatactgctatcaacctttttgtttaatactatcattttatattgatagttttcatttagctggagattttctaacaatggattttcaactttcttgttaagttccttacttgaaaataatatattcttaaaaaagtcctttttcaaaatttcaatagatttatctatgattttatcattgctttttatttcattaattctctcatcaacttctttcaatattttttttaattcatctctttttataggttttaataaataattaaaagctcccattttcatagtatctcgtacataattaaattcatcatacccacttaaaactaaaaatagcggagacttgtctaattcttttattgaattttcgattaactctatacctgtcattacaggcatctttatgtcagttattacaagatcaacttctttactatgattttttaaatattctaaagttaatgcgccattttgaaaacttgaaatcacctcataactttcatcaattttctcaatcattttagttaatcccattctaattatattatcatcatcaactactataattttcatttttcctcctagtgtacatatttcaagttagtaaaatcctttacatagaaaatataagaaaacgtataccatttttatgaacatgtcttatcattattgaataattgtatattctaatatatatttaaattataagttaaaatttaaatatttgaaatacattttttagtttaaaggtggatttatgaaaattaatagagatttatcaataaaaaaactaaccttacttatatttttatcaatatatatcatatttttaatagttacagctgtaaacttatactcttattctaggtatgaatttaataaaacagaaaagttaataaaaaactttaatttaaatttaagtactcaaattactcaaaaacttgacaatataattgacgtctcaaaatatccattaataatacctgatatagaaaagcttaacactacactatctaataataatacttatgatatagaacaatataattatctactatatttatgtgatatgatgcttattcaaaataagactataaatggagcttacatatttaatttaaatggaaatggagtatatactgctcgaaataataataatgatttattaaaaaatccatttcatgaaaagtggtttaacactgctgtagattcttcaaatcaggttgagattttctcaaactttaatgcaactaatgtttttagagatacaactaaagatgatgaaaacttaattgctataacaagaaaaataattgatataaaatcacaaaagactactggaattttactacttacattttctacagatgaactactgtcattgctgacttcagatattccttttaataatgaatctgtttatctgtatgattctgaaaataatttaataattggtacagatgatgctgaacaccaatataattactctgaatatattgatcaaagcagtactattcctgaactagtttattctaaagataatgaaaaacatatagtatgctataataacttgcaatcatccgattggacaatcataaatacaattccaaaagatgatgcttatcatattgatgtattatatttacttttcttcttaagtaatttaattttttgcttaatattatttattgtaatttatctatttttcttaaatagaatattcaatccaataaaatcacttattgaaaatatggaaagtaaagttgaaactaacttgaattacaacttcgcttataataaaaatgatgaaatagggatactaattaattcttataatgatatgaaaactagaataaacactttaattactataaattataaaaatcaaatagaacaaaaagaattagagttaaaacaactacaaaatcaaattaatcctcatttcatatataatacattagaatctatacacatgatggctgaaataaatgatgatcctgaaacttcaacaatggcagaatattttggaactataattagatatagtatgaataggcgtattaatacagttaaattaaaagatgaaattgaaataataaataactacatctatcttcaaagaattcgctttgattctttattcacaattgaaaatcttgttactgatgatgttcttaattgtgaaataataaaaatgataattcaacctctaattgaaaattcaatataccatggattaagcgaatgtgatggaaatggtaagataattattcaagctttaaaatccaatgataatttaataattactgtctctgataatggaattggaatcgatgataaaacacttgaatctttaaatgattatattaatgataaaaatgaactttttaatggaattgctttaagaaatataaacaaacgtttaaaacttaattatggagaagaatatggtcttgaaataacaagtatacttggaaagggaacatctatgatacttacaattccttatataattaattaagttgcaatgtacctaatatttattgaaaataaatcaaataaatatttaataccatcgaatataacgtttcttaatagaaaaagtatagatatgttttaaaataatcatatctatactttttaattagctatatagtaaatttatcaactaaatttattaaattatctgacttatctctattattatgtgctttatcaactatttcttcatttttagaacttatatgagacatattatctactataatgttagttgagtttcttacctcttttatagattccattaatccatcaatattattagtcatattattcatggaatttcttatttcttgagatatactactaaaatcttctgatatttgttttacacttactcctgcatcttgataatcaaccgttgcatctattattttgttataattattcataacatctttttctactatatcaagaagtctttttgatgttaaggataaagaatttacagcatctaatgcttctgttacctgattcttaatatttcctacagtttcagttgactgttctgctaattttttaacttcatttgctacaactgcaaatccctggccatgctctccagctcgtgcagcttctattgctgcattaagagatagaaggtttgtctgctctgatattgacataatgctatctgacatagttgaaatatttttaactactgatactttctttaaggcttcctccagctccccttacatttagaataaatctcatctaaggtattcattgaacttattgcatccttatgaagattattagattgactctttattttatccgaaagatccattacttttgaagatatattaacagatactgttacactattatccactttttgtactaaatcattaactttattcacagattcaaagcacccatccatacttgcagatatctcttcaactgctgctactgactgatccaattctgacgatatgtctgttatcatattatctatttctaaactacttgatgatatatcataactacttgttttcacttctgtaacagtttcatttaaagcatctacacttgaatttaaagaataaatcgcttttttaaattcactatttctaatattggaattatctttatatgacaaattgtaatttgatagttcttctgaatattttattattcttttcaattctttatttatattttttcttattattaatgaaataagaacactaataattatggcaattatggctaatatagtttgaattatagatatcttatttatattatgtaatacttcttttgatggcgctacaactccaagaacccatggtgtatcttctggattcttataagaaatgtatacttcttctccatctaaattcatatcagttatattactcttacctgaaccagcctctaaaataaagttttctatttcacttttatcagcattttcttctcctaagtctgctatgttcttataattaaatactagatccatattcttatgagctgcaattaatccatgctgagtcatcaaaaatgcatatccattttcacctatttgaatattctgcacaattgaattaacccttgctaaatctaaggttccacacatatatcccaatatatcctgactgtcattcattattggtactattattgtcgctaccgatctattattatcaatatcagcccacggagtatccattatgaatttcttattttcttttatctgttcaaaatacgaatcattagaataatcctttatttcatcatttgtataatatgcttgtccgttattatcaaatatgtatatagcttcaaatccccaagttgaacattgttgtattacaacttccttccaaacattgtaatccatacttttaacttctggcaatgaagcaacatactccaaatttttcatgctaatttcaaattcacgacttatagctctagcactatcattagttctgtctgttagtgtttcatatgttgttttaataatatcttctttagttctactaaacgatacatatgagatcaatgtacaaattatcactactaaaagaataatttgtaacattatcttattactcatactagaaaaaaaatttttactcttcattttatccccctaataataaattatatcttttgtttgttaatgctattactttttttaaaattatagttcaaacattttcttatgtcaatatattgtaaatacatatacaaaactaatgtacttaatacacataaaaattttcttcacatgcttttttagttgataatttataattacagtttatacattaaaaaaagtacctaaagccgtgctctagatactttttaacgatacatactatagtcttaataaatgaatcagctttccagaataatctccgtataagtcagtaacattaattcctgcattcataagtgctccgcctgaatatacttcatttgtttcctcatttttatacattgaatcttcatctagacctttaagttttattcttctgctatgataattaggtcttcctaaaacctgaatacatgttactaatacttcgttcttatcctttgcaactacagaccaacagtcaaaaccattattttcagaataattttcaattctgtagtaatctcctcttcttaccaagtcattatatttatgatacatttctatctgttttggtatcatatttctatcttcttctgatattttagttatatctagttcatatccaaaagttccgcttaaggctacataacctcttgtttcaaatggtgttgttcttcctactgtatgatttggacagtcacttacatgtgctcctatagtacttaatggatataccattgctgtaccttcttgaattttaagtctttcaattgcatcagtatcatctgaacaccatatttgtgggctgtaataaagcattcctggatcaaatcttgctcctccacctgagcagttttcaagtaataaatcaggaaaatctttagtaagtctgttcattaaatcataaacagcaagtacatatctatggaatatttctccgtgttgttctggattaataaagctgcttccaaggtctgtaatctgcctgttcatatcccactttacatatgttatgtttgcgcttgaaagtattttctttaagctatcgtaaacataatcaactacttcttttcttgtaagatcaagtacatattgttcacgacatagtgccggtgtacgtccttcaatatgaatacaccagtctggatgcgatttatataattctgaatctggagaaatcatttctggttcaaaccatattccaaattccaatcccatcttattaacttcatctactaaatacttaagtccgcctttaattttattttcattaacaatccaatctccaagggatgagttatcactattacgatgtccaaaccatccatcatccataacaagcatttctattcctacttttgatgcttcttttgctattgcaagaagtttttctgtatcaaaatcaaagtaagttgcttcccagttatttattaatatagggcgttttttatctttatattttcctcttattaaatgatttctatataaatcatggaaagttcttgtcatttttcctattccacaatctgaataaaccataacaacttctggtgctgtaaattcttctcctgaatctagtctccattcaaagtctgttggattaattcccataagcactcttgttgtatcaaattgacatccttcaacttgtgctaaaaagtttcctgaataaacaaaattaaatccatatacatttccataatcatctgttgcttttgaatccataagtgcaataaaaggtgcatcctgatggcttgtttcacctcttacagatgatactgtctgtgttccatggcttacttttcttctatcaatatgtctttcccttgcccatgatccatgaagtgaaatcatatcataatccattccatcaaaatctatacacattgataatacttttgttagatatattttctcttttccttcattgattatttttacacttcttgttattgcatctaagtcttcaaaaactgtgtacattaacactacttttaagtttaaatccttatctatacatgtaatttctaagcttgtacattcattttcttctccaaatgtagctggaagactttcaagtttacttttacctctataaatttcatgtgaaacatattgaagtttgcatgccgtatttcctttaaaatcctttacagaaagtgcagtctgtctaaaatcccctattccatgtgttgaatattctgttggaaaactgtcataaaaagatactctatctctattatttttagatggcacaaatggagcttcttctgttctcaataaataatttgcattttcatctattattttcttaccaaaatatacatgtcccaaaaattcttcttcatctataactgccataatatacgatgtattttttccatcaagtttaaaaactttatgttcttcaaagtatttaattcccataataacctcctaggttttgtattctaataacttaattgttatcttaatttcttaattcttattttcataaatagcaatattttatttaacaatattattatttctatattttttcaatttaatatatgaacataatttaaatttgtattaatttctgattatttgtatagaacgcactttacatattcatgtttttataatattaactcttttttaattcactattatttacttccatcatctttattgctggcaagattataaaattcaccttttttactaataagctcttcataagttccttgttctcttatatttccaccattaataagtacaattttctgtgcatcttttattgttgataatctatgtgcaaccataaatgttgttctattgttcataagatttttcattgccttttgaacatgaatttcagatttattatctaatgctgaagttgcttcatccaaaataataaccttaggatttcttataagcgcccttgcaattgaaatacgctgtttttgtcctcctgacaacatatcaccatgttctccaacattcgtgtcaattccatctggaagtctttcaattacttctttcaaacaagctgcatctattatttcatctaatttttcattactaacatccataccataagtaatgttatcttttattgagcctgaaaataaaaccgtattttgaggaaccattgcaatatgagttctataacttcttaaattaatatcattaatgtcatgcccatcaacaagaatcttaccatttgtagcttttaagaaaccaactacaagctgaagcaatgttgattttccgcctcctgattctcctacaaatgcaatactttcgccttttttaacatgaagattaaaatctttaagaacatcttcctttccatcctcatatctaaatgtaacattattaaactggaaatcaccttcaacttctttcataacaaacttaccacagttttcttcaatatcttctgctgcaagtatttctgatacagagtttatagaatcaaaaccttttacaatctgtggatatacatttattgcatttgtaagatcacccattatagatgaaaaataagtttgataaaggacaatatcgcctacttttatatatcccttaacagctaaaaaacttgtaaacacaagacatattatctgcataagctgaaatgttgcccatccccctgcaccaaatagtgcattaagcatatccactttatatccgctacttttaactttagatacttcattatcaactttatctatctctagattttctaatgcatgtgctctagttataggaaccatttcaaccatctgtgaaactgctgttgacatatcctcaatattttttcttaatattttatttgaactttgtatacttccattaaattttcctataaaaaatactgctatgggaattgtagctaaaaagaataatgatacataaacatttctagttgttgtgactgaaaatgctacgataacatttaatattattggaactactgtaatgcatattacattagataagttagttataagttccacatctcggagtaccttagattgaagtttccctcctgataaatgcttatgatatggtatagataaaacttgcagtttctttacaagctttattcttacagaactttctacatctcttattgcaagactcataaaacgagtatgtatcaaggtcgcaggaacatttgttattacgaggattgccattaatcccagattaattattagttcatttaccttaagatcctgagtattgcttataatattaattaaatttgataaaacaataggcataatccagacaggtgaatgctttataacgaaaaatatgaatgataataataactttttataatttccatcatataatcttataaaggtattaaatggcttatcataagcaggatttttattcttcataatacacctctactatttaattctagtttaataaatatatacacaaatgtgcatacgtttacttaaacaaataaattatatcatgatagtatttattattaatttgcacaatctactatttataaactattcttcagaactttatatgttatttaaactcaaaatcaataaaaggatacctttctagatatcctttaactctctagttacttattgattgtctgattatacttacctgtcattctataagtgctgtaagttttgctattagtcgtaattatttattaataaaaaaactaattaatgaggttatacaacttttaatccaattattccaattactataaatccaatacagattaatctagttatatcaataggctctttaaatagtattattcctaacgttacagttccaactgtaccaattccagtccaaattgcgtatgctgtacccaatggaagattcttcaatgataatgataaaaaatagaaacttgcaatcatacctactatagtaaatatactaggtataaattttgtaaatccttcagaatactttaaccctatagcccatcccatttcaaataaacctgcaacaatcaacattagccatttcatgcatttcactctcctctttatataaaaatgacaaaagcctaggtgatattataaaatatctcctaggcttttatccttccgtgaacatagtataaactatgcgttttatctcggaccagaccaatatttattttaaactgcggaaccctataaaacttttacttatttatattttatttttatgaaaataacctcatattttactctattaaatgtttagcaatgttttcgaaatttcctcaaatctttcatcagtaataccaagttttttcttaaatctttcatcatcaattcttgtaacaattatcttgtcaggagatatttccttgataatattttttatcttctgaattgattcttcatcatcattatagccattaattatagtaatttcaaatataaacttaccattatattgcttattaaatacaaccatatttgaaatatattctttaagtgtatatccatcaattggtctttgagctttttgaaaatcttcttctgttattgtttttatctctccaataacttcatcacacttattggctatttctatgtattcatctctacttagcaaatatccattagaaagaagtcttacaggtattcctttgtctttaatacagttaataatatcatcaatcttatcatttacaaaagcctctccttttgaattaataaaaactaattctgctttagtgtcctctatcttgagtcctagttctattaatgaagtacccatttcattaaatgatttctgtgtatcaaccttatatttagaccttccaataggacaaaatatacaatcaaaattacaatttttttctggaagtatgttaacttccaatactcttttaccatcttcaatataaatatctttataactgaagccactcatttgcttctcctcctaaaattactctattactaattctttattattaatgtctaaaattgaaattttactttctccacctaaattgtcctgtatcattttttctaaatgttttaatgcattctcaaattctattactctgtcttcatcagttaattcaatacataaaaatgcattctttgtattctctgtaagcattgttctaactgcttcacgccagttccaacatctacaaattgcacctttatcatctttgtatactatttcaccctcatatggtgatgagttttcatctgttccaagtggaataaattcctcatttgcaacagcagtagttaatcttacatttccaacaaatttatctatgtcttcaccaccacaaggtaatgcatatcttaatgaaatcgaattataaatatccaccaatggattaacagttcctatatgatttccattattaactctctttagtaaagcttcaattgaagaccttgcaccttttttagttttgaattttttgaatgcttccctccatacttgtattacctggttactactaaattgtacactctgtaaatattttaaagattccttttctgcttctaaaataatttctgaatattgctctatatgtcttatagagttatctatgttgttacaaataataatcccaattttcacattaggaaacaaactccaaaacgaatcttcaataataaactttttcattacaatccctcctatatttaaataattaaaaacaataaaaaaagcctatggaaatattattcaatatctcccaggcttttatccttccgtgtacacagtaagctgtgcgttttctctcggacctgccaactataaattgcggaaccctagaaaactaaactacatatttttttatttattaagataaaatatacatgaattttatcataaccaaacaattaaatcaacacacaatattaatttgttcttaaaattttcatttatgatgtgcttcaccgtatcagtagtaagtgatattcatcttccttatagacttctttattcaacgaatccaatacaactttcttataaatttaatatgagttattattcatacattctagcaaaaggatcatatctactattttcattccaaatatattcaatgcttttactaatttccactgctttttcttttccactaagatctcctataaaacctaatgacatatctattccagctgatacacctgatgatgtatatattttattatcagttacccatcgtgcttcttttacccaaagcacatctttaccttgttctgtaacccacttaaatgctcttttattagtagttgccctttttccatttagtattcctgtcttagcgagtaatgcagaaccagtacatacactgattatatatgctgatttgctagcaatatttttaatataatttatgaaattaatatcattaactttttctctagttccactaccacctggaacaaatagaattttctctatgctattttcattttcatataaattagtatctacccttacattttgtgaactttcaacaatacctccattgatagatataaagtttaatttaaaattatctggcaatctcccaaatacttcaacaggtccaaatacatccaatgtttcaaacttgtcaaataaaagtatatcaactctgtaaatcataaattatctcctccttctgtcttataacaatttaccattattaatgaattatatcactttttgtaagtattttatcattggatttttcataatatctacaacctaagaaaaacagcataaaggctatactgtttttctttatatataaattgcaacactgttttaaacaaagtctaaaataactttaaactatatttctttaataagtctatttattccttcttttatttgattattatttgccatacttatactcaaccttattaatttctcttctatataattatttaaataaaatattttgggatcctttaataatatattctggttatttaagcttttaataatctttgtaatgtttattctatttttagtttcaaaacttgcaaaaaagcctgagcttggaacatgccactcaatattattatttaaaccttttgttaattcattaagataactcattttctgagaatatatctttttaagctttttcctatgtgaattaaacataccactttttatataaatttctaaagctccttgtgaaattaaagatgtatttaagtcactccatcttttatatttttcgaaagtacctattaataatttgggtagtacagctgctgaaactcttagacctggcaatattatctttgaatatggttttaaatatattactctcgatgatatatccaaagcatatattggatctgattttttatcaatttccaaatcagcaagataatcatcttcaactatatatacatcatatttttcagctaactttaatatttgttttttctcactgttagaatatgaaaatcctgtagggttatgaaatctcggaattgtataaaaaaatttaatattgtaatttttaaatatgttctctaattcattaaaatctatcccgttatattttcttttaataccaatagtatttatattatttatctcaagtgatttaattactccataataagtaggttgttctataagcacattttctttattattaggaaatggcatcatggttaatatatttatggcttgctgtgatccagatgttataaaaacacattttttatcagtaaatacttgataatcctgcaattgttttactattacatcaattaaatttttcattccttgtgcatgagcatgaagaaaaatattttccttatataatttcattgctccgtctatacagtactggaattcatcatctggaagaatatctctatccaacttagatgttgaaaaatctattttcttatccaaaatatatttatttaagttaagattctctttaataaggtaatgtccacttttgggtatcgaatatactatgtgttccttttctaatatatcgtatactttaacagcagttaccttactacattgaaattcatcacaaagacttcttattgatggcaatttttcgcctattttaatgttgttttttaatatttcactttttatataacttaaaataatttcatatttcatcaaaacacctcctttccacatatcaatctgtactagcccacctcaaaatttttactattgtttgaaatcttagatttttctatacttttaatatactatagaattttatataaacaagattttttattacttttctcaatatagttttcaaattgttattcacttaactgctaaatcattaattcagaatatataaaattaataaactagattaatataatttacaaaaggagttttaaatgtgaaatatttatataatcaaactactaaaaaaactacattaatggaaaatccatcatctctaagctatacaaaattaatttcaattttaggtcttgctggttttatttctgctgctgataactggtttatttcaccttctctctctgcaattgcatcagaatttaatgtatcgagttctatagctgcgtctatactaactgcatatcttattccatatggaataatgcagcctgtatttggttttctaagtgatcgttttagtaaaactaaaatccttcagtttattgtatgtggacttgccttaggtactggtggttgttcactttccaattcccttgaaatgttattggtttgtcgagcatttacaggtttttttgcggctggaattattgcagtctcattagctttaattggtgatactgtgaaagcttctgatcgtcaaatctatgttggaagatttttaggaattatcttccttggtcaaggattaagttctggactaggtggaatattgactaagtattttagctggcgtgtatcacttgttttttttactatcgcctcaatacttacagtatttcttttacataaactcccatatgtatttcctgtacccatacatcataaatttttacctgaaattaaacgagtaatatttacacctaaaggaaaggtaatctttccactagctctgttaactggctttttattaataggtttatatagttttttaggtagttttctacatgatgttttgggtctggattatctacaagttggaactgtgataatgttttatggctttgcttgtttgattgctggctcccaagttggcaagcttgagcaaaaacttggaaagaaagcaacacttctactaggaagctgtttttctttatgcaccatccttcttttaatgatcttttcatgttggcaggctgtttggatagcaacaattagtttaggctttgggtatatcttcattcaatctaccttagcaacatcatgctttgatatagcatctgaatcaaaaggacttccatctggtataattggtttatgtctttttggtggtgcaggattaggtactgcttttaatggctggttactttcagaactagattataaatcgctttggcttatagtcactttagaaatcattatatttgttcttattatatctaaattaaactataataaaatatagctgttaactgcactttatttttattgaattattaattagatttattttagcaattatagctacatttaattattatatacaaatttttatatttacaggatttatcatcaatcttcttctagatccataataagaaggagaacctcctccatctggacttggttctcctccattacttagatacattattaagttatcattgatgttaagctctattgattctatatctctagttttgtttatggttattttagaaatcagcatgtgcaatagtttcttttgttgctcccttgatggcaactctgatagcatcttactaaaacttgatagtatttctcttacaaactcatacgaaacctcctgtacaccatcatctaggatattgctttttaggttatttacctcctgttggagcatttcttccctagattttatgtctgccattctgtctgagaagtcttttttagttattatctcttcctcataagcttcaaaaacctttttcttcttagcttctagcttttccagctccttcaaaatcttttctagctcatcttttgatggatctaccatagcttttctagttgtattcatatttactactatatcctttatcaacttatcattatttagtaattctgatagcttattaaacacatagtcattagctttattaacattgattgaattactatgacaaactgctgttcctttattcttccaagcaccgcaacagtaatattctatcctatgctttgtcccatcttttcttgtattagtacttctcataattaccataccagaaccacatacagggcattttagaattccagttaggggaaactcaccatcatagattctggatggctttcccttactatcttccatcattttttgcactttatcccaaagctcttgggctattattggttcatgtattccctctactattagaggattagcatttttatgtcttcttcttttctcactccaattttgtaggacattgtatcttatctttcctatatagactggattttttagtatgtcctttattgcatttaccgagaatggatttcctcttttagttgtatatccaaacttatttagataacttgttattgctttgtatccattgccttctgagtacattgtaaaaattgtttttataatctctgcttctacctcatttataacaagttctgtatcttttctctttttattagtcgaatcagatttttctttcaaattatatcccaataaaatattaccattccaacgtccttctctagccctagctaacattcccatctttacattctgagctattgttccacgttctagttcaccaactgctcccatcatttgcagtgagaattttcccataggtgtttctgtttcaaagttctctgaatatgatttgaaagatatgttattcttctctagcaaatccactatttgaagcaagtttagcatatttcttgctattctatttatcttccatgtaatcaccatatcaaatttcttatcatcagcatctttaagcatttctttcattgcaggtcttgcctttattgatttcccacttatgcctttatcagaatacaccttgaatatggtataatcattatcttcacaaaactttcgcaataaccgttcttgttcctcaatgctataaccttcttctgcctgttctggtgtactaactctacaatataacgctactattttggacatctttcctccacatccttactatcaaatttcttgatactagctttaaggatgatttcagatatcacctcaattatttcgattattgttgcttgctcccttttgctttccatcttcattcatcctttctagtatctaaatttataatatatatttgataaatatttatgattcatttattaaaaatttacttactatttactttagaattttctatgttctaagatttttatactttcgatttatttttatagtcttagagcttttattgctccaagacttgttgtttttattattttatttttactattattactggtgagccttcgctattagtatattgaatgtcaccaaaagtcattgaggttctatttgtaaagtctagctcaaatgcttctgaaatttctgttaccagtggtgttgagtacactattgcttttccattgctgtccttcacattgaagtcattactgttgttaggtagattagctccaattattacacttgtattactgaaggcaaattgcaatgtgtttggctttccaagatgttcatatccttgttttgcaattgtagctctattgcctgtttgggcttttactactgagaaaccacctttattagaagttgctcttgtgctatttttagctgaacatggaactgccttcattatgatttcagttacattatcttcttctattgttgcaatttcttctgtattttctgctgtagttgcttctatcgcttgtccttctgttactattgcttctgcttgtacaattatttcttgtgtatctttattcatatttaccacttcctcattcatgttatcttctggttgtattcttcttattactgccatattacttcatcctttcaatttagctttcatagtttcttagaaattccctgtgttccatttttgttttttcaaatcccccattgctgagtcctcatattctctaacattgcccctatttcccctatttcccttagaaaattggatgtattttcttatttttagagtgaaaaaacacttatatatttatatttattttgatagggttttaggggaactagggcaattccttattttatcttggttggaaagagggggtttgttcccctctttccctaattaacgaggcttggattactatttacaacatattcttttaggtcttctgtaggtattttcaaaatatatactacattacgcttaccttttggatttacagttgcacgatttgtatttttaccaacctcagttatcaaatagcccttttctttccattccttaataactactttaacatcttcatagtttaattctcttaactccttttccaatacatttttaattattgctaccttatagaagttcacttctgaatcaatctttccccagcaatctctaggtgtgaagctactattattgagtctgaactttcttacattttggcttattagttgtataatgtctgtaaaagctttttctccaatatctctatcttcaatgctttcaatctcattattaactaaaaaattcaatactgcttctaagtcaatttctaatcctaaagcttcattagcaatttctccgccagttataataattgcaaatttatcagcaactctgttcttaaacggattatcaggtattacttctaagcacctagatttccaatagctccatttagtatctattatgctaaagccttgattaaagatatactttataaattcaactccagcatacccatgattttcacttattatagcttttatactttcagcgttttcagctgatttagtccattcaacaccttcaaaagtaaaagttctgactcttaatcctccattattgttagctctttcaaaaattgattgctcacctgttgaaattattgtagttccccatttggatgcctttctttgaattattgtatctgttagacgagctttatcttctccactagcaattgtatatatttcttttgacatatccctattttttatcatagagaattcatcaaaaactaaaggtattccaaaatttcctcctagggaatttattattgcattgcttgtaccgttccaagttctgaatagccctttatccttagtatctggaattccaaaaggtgatactgctgctttacttgctgttgtcttaccagttgtactttttccagctatgtgtattatcaacgtatctgtatgtttatcttttctatgcaagtatcctactattggagctgaaaaacctatgcacatcattgtttcaagaggtatattaccttttatatcggtatgaaacatattagtccatgctccaagagttccactacaagacaaattgaatgttggatcttctggattattaatagctttaatattagcattatttgaaactaattcatttagtctaaactctaaatttctatcactatcaatatgccaccccacattattgtaaatatgttcatgaccaaccaacttcaattgttttagcaaatgcctccctagaaatttttcatcttctggtggtatatctacaccatatttcaataattctggtagcttatttgctctaagcatttgcatggtaacgtttatagtattgtatgtaccttgatatttatagagaagccttatatatgcttcctttgtatctatattagaaatagttttttcaatacaaataggttcacacatctttacattttgaacctttccagctacattcattggcaaatacaatcctttatcatttatggtataatccccaaatttatactccttgccactcattaactcttctgaatttattactactgcttccatatttttgtcccctcacattgcaaatttatctattgaagtgatataacctaggacggctataccaccattcctaagttatattattttagtattcatattcttgaacattatcctctatattttgtttttcaagattaaaagttttattgttttcttcctccaattcatcaagactaacaattgctacaacatttgaaaaagtacctgattcagccttagaatttccaatctgaattccaacttcttgtccaatcagatcatttggagtaaccccatcagttcttcctactgtcgtcatcaacaattgataaaatggctgattatcgtgttctatgagtaaaaagttttgaactaattttctaatatttccatcattcatatatacttcaaattcaacttttactctttgtgtaagacctgttgctgtatttactggagaagttccttcaattgaaattactttagcctttagaatttctccatcttcaaaaatactacaaggttttttcaatgaaattaccagcccattattatttgatggaatcccatctctagattttactgaaccactaactattttacgtactgccatatttgtgcatctccttataattaaatattggcaaatgcatttgctattttctttacatcgatgtttttaatttattagatatcttatttttatattaatatctttaacacactatgtaacggacaaaaaaaatggatttaaatttataaattttgtccaaaaaaataagccattaattttggcttattctttctagtcattatttatatattttgataaacatgaaattcgttgaatgtctttagtatatttaacattatataaaatacctaactcttttattttttctattaatacattaatatttacatcttcacagttgaatactgctttctcagcaaactcaacttccagtttgcgtacttcattcttatatagtatttcatttattttttgatttactaattgtagtatttcctgatttgtatctatcagtctctctaaattctcttcttttgtatatctttttaatttaaattgttctttcaatatttcatctatatacctatcatataattctctaaagtttagttccatttgcttttgaatatttataatattaataagactcttatcctttagtttatattcttcatcaatttttccttgttcttctgttgattttcctccctttaatattttttttgatagctcatttattttttttacctgttccttacttatgcttttatcagaatttattctatttaatatacctttaatacctggatcatctaatatttctaatattatattcactatcctatctaaaaatatttcactctgaatatattccactaatggctcaatcccccaataccttcctattgatttacaactatatgttacaatttttctaatactatcttcactaactttgttattagaatatttccttttcataatctctctagttatatccatataaccataatactcttttttctttttataacttcttttagtcgttcccgccatgctaggttttctatttcttttagattctgtattattcatttcatactcctaaatttctttatttattatgattatatcgaaaaaaagatggatttcaccatcttttatttattgattagaagaacttctttattatctcttctgcaacgccatatctactgcaagcacttgttatagcctcatcttctgatattcctttcataatcaattctaatatcaaaattattatctgtaatatttgtatcattttatacctctcatctcctataatgcaaaagaactccccaagattattcatcctaaagagttcttttatttatataatatatatttatttttatattggtcttttcctataattactttatttttatactatttaaacagactagtgtcttaaaaaatactgtgcattttgttcgtttaattccttttctctttgcctttgttcagctgtttttccatcaccaattagttcatatatgttattatctctagtatattgggtttgtaagtattcattcttagatatttctgttattgttccatcttcaaatatcttaaatgcaccaagtatacttgattctcctaaagctaaatcttcaaattttttattattttctttagtaagataataaaatctctttccattttcatattgtgcaacagttctagttcctgatactgtaaattgtccagaatcaagttgatttttatatctgttgtaaaagatttttaaagctgtatcataatcaaaatctcctatgttagcattttgattagaagaacttacatttgaagaattattaccagctgttgttgagccatttgtattatttgttacataaccttgccatctgccatcaccataaaaatgcgataattgaccatcaacatttatagtaccagtagccattgtaccatccgcctttaaataataccaattaccattatcttgaattcatcctgctttcatatatccattattatcaaagtagtaccatgacccgccaatattcttccaccctcttgagtagctgtttccttctgcataccaccatccattattgctttgtctccactcagcactagctcctactggtgctactgctagaatgcttgttgttattaatcccattgtaattatctttttcaagttaatctttctcattactattatccctccataatgcttttttgtacttcaagtactttctcttttggaaattgtttcatagttctattatcgtttaatacttggatatcttttgcatttttggacattctatttatatccagtaattattagatgcctaagccatctttcagaatatccaagctccctagatagtgcttttagatttttcccatcatattcttctaaccttttcaaaatatactttttagaatatagccttatagggaaagttatctgttgtcctttgtaatacttgtttatctttcttacggtttcaattcctaatatctgaaccatttcttcatagattccattgaaatcgctagtgtctatagctcgttttcttatttttattccccctctcgctgtttctaatctaataataacgaatctattttgattaatcatgtgcattcttccttgtaaaattccaaactatatttttattatatttttataccaatttacccattgtataaatgatacgataaaaatgtaaggaaacgatcatataagaatgtacaatttagtttttataaattataattactcaagatttattgggggtaattatgattatagaaacaaatatttattcagaagttaaaattaatacattggaagatcttcataagctaaaatcaattatggaggtaaacaatttgaaagtaaataaaagccaaatagctagggaacttggtgttgatcctcgaaccgtaggcaaatatttaaatggatacgtcaaacctaccactagaaactgcaaatctaaagtagaagcttttgatcctattataaaagagcttcttggtaaagattcaattcaagtattttattataagcgcattttatggcaatatcttaaagataatcatggattagattgcgcacaatcttcgtttagaagatacatttctaatcactcagaattcaatgagtactttaataataggaaaaaaggacatatatccactacttctcctatgagatatgaaacagagagagggaaacaagcacaattggattggaaagaaaatatagaatttgtgttaaatacaggagaagttattaatataaatgtttttgtattaatactttcatactcaaggtttagagtatataaattatctcttgataaaacacaagatgtgttactttcttttttagatgagtcatttgaaacatttggaggcgtacctaaagaattacttacagataacatgaaaactgttatggatgaagctagaaccaattattataaaggaaaagtaaataataaatttcaacaatttgcagatgactatggatttaatgtccgtccctgcatagcaggaagaccgaatacaaaagctaaagttgaagcacctatgaaactattagatgaaataagagcatataatggaaccttagattatgaaggtctgcataagcttatttcagatttaaacaatagaattaatagtacatgccatacatcaactggcaaaatacctatattacatttagaaaaagaaaaagatttcttatccgaactgcctaaagagcagataagaaatcattacaaaataatcaccacaagtgttaaagtaaatcgccaaagtatgatttcatataaatcaaatcaatattctgtaccaccagaatatataggcaaaaaactaaaacttcaagtgtatgatgatcaactacatgtgtattataacacaaatttagttactattcataaaatacaaaatcagaaattaaattatcatgctgaacattatactgaaattagtgctttaacatttaataaaaaatcatatgaaatgatagaaatagctagaaataatttaaaaatgataggagaagtataccaaaatgaatagtacatatacacaacttataaataatttagaatatttgaagatgaagcaaatgattactcatttggacgaagttattgattttacaacaaagaataatttagcctttgtagatgctcttattaagctaacagctcatgaaattgattataaagaggcaaatatgattaaatctatggttaaggttggagcttttccacatcaaaaagaaattaaagattttgactttaattttcaacctggaattaataaagatcaaatattagattttttaacattacgttttctagaatcacaagaaaatattgtatttttaggttctagtggtgttggtaaaacacatcttgcgacttctataggaatcgcggctgcgaagcgacgttacagtacttatttcattaagtgcaatgatttgttgcaacagctaaagcgagcaaatctagaaaataggttggatgctagacttaagcattttagtaaatataagcttcttataatcgatgaattaggttatttacctatagataaagaagattcgaaattattttttcagttaatcgatatgaggtatgagaaaaaaagcacaattttaacaactaacataaattttaattcatgggatgatattttttatgatgctgttatcgctaacgctatcttagatagagttttacatcatgccaatgttgttacaattaatggaaagtcatatagactaaaagatcattttaaacaagacgaagactaaaaaaactacattcttaaatgatcgaaaacttacattcatgggttgacatttatacccattgaagcttagtattcttctgccaaaatcattgtgctgtaatctatactatcaattacatatatttttatgtcatgctcaatagagacatggctttgctgtagattgtattgctccttgtacggaggaacttcttgctcatgctctattattacttttccctcttttttctttagcctaaaaatttgtaggtagtccaagtccattttagattttagttcatctatcatattccacattagaattggaatctccattggtactatttcatttacttgtctacttacatatttctttccattaaacatttttatcactctactttccatttatttttgcatgtgaaaaaagactacctctcctatgaaaagtagccttattagcaatctatttctgcgtatatatattcttcaccatgttgattctctgctatgaattttgaatcaaaatccagaagttcttctgcttcaataccatttacaagctctcgtataacttggtctttactagttccattcatccaatattctattaatgaatctttatccaatagcttatctacaaatctttcttcttctagcattgtttctaatttttctcttgcaaaatgagtcaaatcagtaccctttttatatattatgataccttcatctactgaaacatagccctcttcctctactgcttcaatgtactttattacttcacttatgtttagttccaagtttgaattattttttatccacagaaatacatttattttgaggttatcaacatcattctccccaatttctgttgctagtttcaatgccttatcaaaatcttgtagtagttcctctttaaattttccatctactttcgatattagagcttctacatattccaatttctttgcttctatgttgctatacttatttattattgaatttatttcattcatcatgaagctttgtattattgatgaaaagttagtattattcatagtcatttttaatcatctccatttcttatttgacttactatgttttcttaattatgcctttttcctttaggctgtaatatgaattatctcctataattatgtggtcaatcaacttaatacctaatatttctccgctttctcttaatctttctgttatgagcttatcctcattacttggtgttggatctcctgatggatggttatggaatagtattattgaagctgaattgcttagaattgcaggcttgaaaacttctcttggatgtaccagtgaattatttaggtttcctactgaaactacatttattgcagttggttgattctttgcatctaggcaacatactagtagttgctctctgtctgactcttccaaaaacctttttcctagctctacagcatcttttggtgcttgtattcttcttatgtcgtacagtatgcttgattcttttaccatctttattgacactacattgattctctttgctggctcttttttgtccattttttcttctccttttgcatcttattgcatttccctgttgtccccgtttgtatttttacatttcccactcggaaatgcttactaccactgatttgccccgccttccccggtttcccgctagatttttatgctaccactatttttattttagatttacaaaaacaaaaaagcctttataggaactattatttttaccggagattcgggatttacgggggaattgttgctattactaggtttacaagtggggattccgccccgttatttttttcttccggggcttttacaaaatattatttattattatgaactttctattacatctgaatattgttttatagtaaaataaactatgtagaatttaccctatcactaaactctacatagaaaaatcctaattactattaatttagcaattaggattttttattattcaactcttgttttagcatatcaatgaattcatctgagaacactttctcttttattgctaattttaacaaatcaagtaattgtatttcagttacatcaagacttcgtggaacgtatctgttatcccctcttatagtatctttgtataatgcaaatcttatttcctgtctttgcttttctttgacctctatccgctctatgcaactgtagtaatcatcatcttctatgcttactttattatagattttgcaatagctcgtctcttttattattttggtttctgtttgctttggcatttcaattacaactccttttctattagaatttcgtgaagctccttagttgaaaacactacaatagaataatcatcggataatagaaaaagtgatgaatagtaatcaataccatcatcaccctttataatgtctgtatactctggaattagtccttttatactattagcttttatttctgcaacatctccttttgattccaatagtcctatatatcctcctagatctttgtctacgtctctattagcaccatagttatcatctagtaatgttattatttcttctgcctcttttagaatttcctttgagtattttgtttttagcacatctaattgttcttttttgtgcagttttatcatccttattacctcctttgtataatctagttgtaacatttgatagaaaactatttgtaattctaacgaacattacatgtctagtaattcttaatattcttatctattactctgcctacgccccgatagggaatatacatttcatacttaaaatagttttttatttaaattccaaaaggaatctaaccaaatttaatatagtttagtataatactcctgaatagaagatagatgtaccctccttgggaggtttatttagaacctatacccgtaaattagcgtatcattccatcaggtagaattctatgtttagctggttgggtttccctttgggaattacccgtgtcacaaacaaggttataagctatctgatagattggaagttctattctatctcaaatttaattaaaaggagatatatactatgtctaaattttttaatagtcctgtagttggaatcgatgtttcagctgatttttcatatgctgcaatactcgcaccgaatggtgacgtttataagaaatcttttaaaataaagcatgatgccaaaggctttgaccacttagttaatgaaataaaaaaagtggaaaaagagtttaacatgaaaactggcattttcatggagtccactggcgtgtaccacttatctcttttccactatcttaaaaataattttgataacacatttgttatcaatccactcgttactaagtgtaacaaaaatgtggccataagaaaagtgaaaaatgataaaaaagacgccttatctattgcaaacataggaaaattccaaaatattaagttatctcagccaaatgatctcgataattttcttttgaaaaatcttatacgagaatactataaacttagagattcatgctcaacttataaaaagaaactatctgctgatttaagagttatatttccaaattataatactgtattttcagattctacatccaatacatcacttgaactcttaagtaattatcctactccaaaatcagtgatggatgctccaaaacaagatgtaatgacaattcttcttgaaaaatctaaaaagagtgtcacttggtctgaaaaaatatattcaaaattaatcactattgctgaagaagcaaagattatcggcgttccgctaagcggtttagctattaaaatatctagttctttagcagtgataaaagcttttaaatcacagatagataatttattaaatgagattaatactttaattgaatcatctgaatttcccgagtctattaaagaaaatattaaattaataaactctattccaggtataggacatttaacagctattactttaatagctgaaataggtgatattaatggctttattaagcctaaacaccttgtagctttctttggtatagacagctcggttaatcagtcaggaaaatttcaaggtactcaatgtaaaatatcaaaacgtggaactcgaatcggtcgaagagcattatatgctgtagcccttgcgtccattagacgcagccgtactggaattcccataaacaaagttttattagaatactatcaagttaatctaaaaggcaaaaaggctaaagttgctttagttgctataatgcataaaatattaaattatatttttgctgttcttcgaaatcaatcgccctttgagcaaagagatcctaagctacataaacaaatctttttagaaaataaatgcttaaatactgcagcttaatctaattccattttttgtaatcgttcgtattttcaaacggtctgtttgctatgctcttttttaaaattaatatttttttaaaatttacttgactattattagctggtctatatttaaataattaaaaacaataaaaaaagcctatggaaatattattcaatatctcccaggcttttatccttccgtgtacacagtaagctgtgcgttttctctcggacctgccaactataaattgcggaaccctagaaaactaaactacatatttttttatttattaagataaaatatacatgaattttatcataaccaaacaattaaatcaacacacaatattaatttgttcttaaaattttcatttatgatgtgcttcaccataactaatcctaaagtctttcacgtcttaaagtagattttataaacagttgcttcaatgtgtctttatcatcatcttttattgcattcttaattttatcaagctctgcttcaaaactctctattgattcaagaagattgtccttattcccaagaaataattcactccataagtcttcatttatgttagcaattctcgttaaatccctataactatctcctatgaaacttcccgtttctcttccttctatatcactattaacaagtgcaactgcaagagtatgaggaagctggcttgtgtatcctatcatttcatcatgatattcaggagtaattctccttactcttttaaaacctaacttataaactaaattctctattaaatcaagattttcaggtttatttctttcaactggagtaattatataattagctccattaaaaacttctgcactagcaaaatctataccctttttttctcttccggccataggatgtccaaaaacgaaatctatattagaaggtaatatattaattacatcttcaacaaatagttttttgattcctgtcgcatcagttattactgctccatctttaaaattttccttattatctaatataaacttcttaactaatctaggatataaagaaattattataagatcagcatcttttactatttcacttccagaagtaaaaccatctttaataaaaccttgtctttttgctttttctaaagactcttcatttatatcaattccatatacgtcattataacccgctttttttaatgccatggtaaaagaaccaccaattaccccaagtcctacaactacaattttcatatttctgccccctttgtcaattgacaattgaaaattgacagttgacaattactgtgaattatttttttacttatcaaatgattaaatttgtttatcttctaattctgctactgcttttacttttttcattaatatatcaaattcatctggtgttaaactttgttgaccatcactcaatgcattttcaggatcattatgaacttctatcataagtccatcagctccacaaacaaccgcacttttagccattggttcaactaagtatgaaaatcctcctgcatggcttggatcaataattattggtaaatgagataatctttttacaacaggtactgcttgtaaatcaagagtatttcttgtaatagtttcaaatgttcttatacctctttcacataaaatgacctgttcattaccaccggccattatgtattcagctgacataagccattcttctatagttgaacttaatcctctctttaataaaataggttttcttgtcttacctatctgctttaaaagatcaaagttctgcatatttcttgcacctatttgaataacatcaacatcttctacaaagttatcaatgtaatctgtagacattatttctgttactattggaagtccagtctcctgttttgcagtttttaacaacttaagtccttcaagttcaagcccttgaaagctgtatggtgaagttctaggtttaaatgctccacctcttaaaaagtttgcccctgctttttttactcttcttgctatctctactatctgttcttcactttctactgaacacggacctgcaattacacctaatcttcccctccaataatagagctaccaacacttacaacagtatcttctggcttgaataatctatttgcttttttaaaaggctcctgaactttcataaccttatctacaccttttaacacttgcattttcttaggatcaatcattgaagtatcacctatgatacctacaatatagtttgtttctccctttgaaatattagttataagacctttagattcaattatgtcctttaccttttttacttcctcttctttagcatttgacttcataacaattatcattagtcatcctcctatactacattatttttttaatttgccctactgtgcttattatcctacattttataatataacccatttatataaatctttcaattgattttacttaacaattgacatttttttgatatataacatagaaactaaaagagatggattcataatactgaatccatctctttaaaaaatctatatacttttatgtaatatttgaagaactgtatttaaatcttctacagctatttgtcctggagctgatgcttttttagcagcaccaaatgttaatacagaaccgaaacattctccagctaatctgcttattactcccattccagccatagacattgttattataggctgatctgcatatttttgtttcatttcatttgtagcacataataaagttaatacatcagcttcactttttggcattactgctatcttaggaagatctgcctttaattctgtcattttagttaatcttgaaactatttcttcttttgctggtgttttaaagaaatcatgattagacataactactttaacaccatttgcatgtgcagtttcaactacttctgatacatagttatcacctgtgaataattcaacatctactaaatctacttgtttagttttagctatttcacaatttaattttacataatattcaacaggtacttctctttctccaccttcttttttagttctgaaagtgaataatattggagtatcagctaatacttttcttatttctcctagtatttcttttactttttctatatcttcaacattttcatagaaatcaactctccattcaactatatcaagcttaattccttttaaaccttttacttcttcaattaactcaacgttgttagttccaactactggtactgtgatctttggtattccttcacctatttttacatttctaacttctactatatttgacattgtacgccctcctaaaatatatctatatataataataaattattatcactttattatgtttttcataagataaaataaatttgaaacgcctctttattatttcttatgattttctaatttttacttatgatttgtatataaattgataagatcatttccgacaacatcccttatattgttatagacactttgagatgcttctatcattttgtctctaagattttctgatatgggaataatctcagtacctgttgatttaataatatccattttttcttcaactcgctcatctgatacttttcttgaataatcaattgcaacttgagcagccttattgattatatcttgatcttctggtgataatttttcataaaatttttcactaactataaatgaaatcaaatgtggtaaatgatttgtttcaataatatatttctgctgttcataaagcctatttgatactattacttcatatggattttcttgtgcatctatagtcttttgttgaagacctatgtatacttcactaaatgacattggtgttgggcttgcattgatacttctccaaaattgtaagtgataaggattttccataattcttattttttgacccttgtagtcattaaattcttttaccattttatttgttgacattacacgaaagccttggtctgagtatcccattaacttatatccagactttttatatgcatctttcattactgataaaaattcttcattatcaaccgtctgtcttacatcttcaatatctgtaaacacacatggaagatcgaatattgatgcctctttaataaaagatacttgtggcgctgtattctgcactacaaaaggaatatctccatccttacaactttctaaaagttctctatctccacccaatacactattagaatatacttgaatgataatcttgccatcactcatcttttcaacttcttcagcaaacttttctgcaaaaatttgtgtaacagtatcttctggactagccgttgctatcggccatgcataaacttgtttttcttcttctaatacatttttgttacatcctattaataatgaagaaatagtaattataattcccaatataagataacttaatgtttcttttttaactctcatattacaccacctaactgcctaataataataaacttatctctggtataaatgtaatcaatagcaatgctataatgaagcatattatcataggcagtgcttttttagtaatatccattactggtatatcagtaagagaacttgcaacaaataaatttacacctattggtggagttatgaatcctattgctagattaacaatcataatgactccaaaatgtataggattaattcctatactatgtactattggaattaaaataggcgttaatatcaatattgcaggtgtggtatccattaccattcctactactaataacactaaattaatcactaataacagtattattttattcgtaaagttaaccgaaatccattcacttacaagttgtggtacctgcatcaatgttaatactcttgaaaaagcaacagatgccgcaagaataaataaaataggtgcataagttcttactgtttcaatacatacatttaaaagaacttttgcatcaatagttttatatacaaaaacgcttattattaatgcataaaatacagacaatactgctgcttctgttggtgatgcaactcctgaataaatgcaacctaaaattattaccggagataataatgcaaagaaactttcttttaatatgttaactaaaccttttttcttcaattgacctattacattttctattctctctctatcttcaccattctttttacaataagctatagcataccccatcaataaaaaagctataattattcctggaataattccagctataaataagtcgctcactgattcacctgatgttgttccaaacattataaatggtatacttggtggaataataacacctagccctcctgcaacagcaactattgctgttgagaattttttatcatatccaagttcatttaaaataggtattgtcatacttccaacagcagccactgttgcaggtgctgaacctgaaattgctccataaaacaaacatgtgacgattacagcacatggcattcctgctgtaaaacgccctaaaaaataagcaaatatatcaaataatctttttgatattccacctttagccattataattcctgaaaatataaacattggaactgcaagaagtggaaaactatcaattcctccaaacatagaccttacaatatattgaccgctagcggtaaacgaaggagagataaaacctggcaatactgaaactatccctaaagatatagacactggaatagctattaaaagacaaatgaaaaatatcataaatactataactgatgtcatgtaattatccctccctacatatcttaaattctataatccatctttgaattattcttataattgctaagctaaaacctattagtggtgcagattgtactaaatacataggaataccacatgctggacttacctgaccactttctattgaagactttaaatataaaactgaaaaaggcattaaataaaagaaaaatatcagttcaattgtatgatttattatcttaaatatggctcttcctttcttaggaaatgcctctacaaattgctctatctttatagaaatacacttttttgtacaataactaatactgataaaaccagaccatataaataaatatcgtgttacttcttctgaccatgacagggaattattaaacatgtatctagaacacacctgcactcccataataagcgtcataagaatcaacaatattatcatcagcaattcttcaaaataattatctaaccaatttaataatttcaaaatatctctccttactataataatttagttatctatataaacatctagataacatatctacattattatatcttaaataaatctgttattatagacaacctacttaaatgccacttcaaatctatattctgtcttttgtctaaaagagttgctacaaaactactaactttttcgctttataacaactctccctaaatagatttattaatatttaatgtctagcatttctttcatgtattctattggcatatcttcgccagtccataatttaaatgctgctgctccttggaataacatcattccaagaccattcattgttttgcatcctacttcttttgccattcttaaaagttctgtttctcttgggaagtatactacatcagatactattaagtcaggtcttaagaatgatttatctggaatataagtttttccttctaatggtttcattcccattcctgtagcattagtaaataagtaactagttgctatttcttcttttaatttatctaaatcatctaaatcataaagtgatgctttacaattagttttttcatttatttttcttactgtttcttcagcatttgcccagaaatcatcttttctattgaatattgaaagttcagcaacaccatctaaagctgcttggatttctattgctgtagcagctccaccagctccaactattgtcattttctttccaataacatcaacgccattatcctttaatgacatcatgtatccagtaccatcagttatatgaccagttaaaactccatcttcattaactattgtattaacagctccacacatttctgctgctggtgatattttatctaaatatttatgaacaacagtcttatttggcattgatacattagaaccttttaattgtaaagatcttataccttgaactgctccttctaatgaattattatcaacttcaaatgcaagatatgcataatcaagtcctaattttgcaaatgcagcattgtgcattgttggtgaacttgtatgacgtattggatacgcaataagtcctattaactctgtatgtcctgtaattctcttttccatctttaatacctctctatcctattatctattttctaatcaaatatattcttaataaatcaaatcctatttatcttttttcataagtatgttatatcttatatttacaactattgcagctactatacttactgatgcaagtactgctgaaacaagtaatgtatattgaacaccaaatgattttgtaacaccaccagctattgctgtaattgtgaatgcgcataatgctccagcaatcattatcatactaactgcttttgccttagatgctgggaacaaatctgacattgtagcaactaccaattgtaatacaccaccagcacaagttgcaccaattaagaatcctccaatttgagcaactgttggacttggagctaagtacatccaaagtaatgttcctaatgataatgctggatatattaatattaatctaactgatttaaaccatttaactaaaactacatttagtaatactgcacatattgatcctaatgcataattagaacctatttgacctgctgctgattgagacatatttaagaatgtcattccgtaatctttatttatgtttaaaaatacttggaatgttgctgttgcagtatatcccataattattaatgctacaccttcaatccagaaattagctttaatagtttctgctgaattttcaacaacttcttctttctttgcttctggttctgcaaatggaagtttaattaataataatgcaattaatactaataaacctatacacattacaaatgtccatccaaaccacattccattgtctgcccagaaaacgaccataactggtaatatatactgtgcaattgctataacaagctttgttaaaatactagcaagccctgatgaattaactaagatttccataactgccggaattacacctgagtctaaaaatccgtttgctactcctgcaagtattgctatacaaaatgcaacttgaacatttggagcaattaatattcctccaaagaaacatatatatactaaacatccaattataactgtcaatcttcttccaaacttatctgaaattgctcctgaaaaaggatatgttattaatctacctattcctaatgcagaaattacataaagtactcctgccgcatctgtactccataatgcttgaagggaagttgtattttgtgataaaatcgctgccccaaacccatgaacaaagaaacttaaatataaaataaatgctgtcgggtataatttcttgtagttttgttttactactctttcttccatattgttcgtactcctcttataataatgtgttttttttaacaaattaatttagttttatttacaacctaattatataaattttcaaacaatttgaatacaaataatattgttttacactcaaattatattgatatcttttttatttacttaacgttattaagccattttatagattattttttaaattatattgttattttacaaaattttatttactttttattttatcaatgagttatactgttactatctacctaaataatgtataaaaatcattactatacttaaaggaggattaaaggtgttttcttttagttttaataaaaaatctcaagatatatttaaggataaacattaccctaaattaagaagaatttttcataattataatacccctgactggacatataactatcatcttcataaaaattctacagaaatagtttatatagctaatggtaaagctacatatactattgatatggaaacattcattttagaaaaaggacatattttgataatggaaaagggagttctccattctattagctctgatacagaaaaacctgtagatgcctggaccataattattgatgattatacaataaatggcttttcagaatctaatagccttttaaattcaagtacatatgcaataataaaaactggtatacatgatttgcttataaaatctataatggaagaaatacgtactttatgtatagatgaaacactaatatctcaatttacatgcaatatgcttgccacctcattagtttcattaatatatggacttcttccagaagaaaatctatcaattgaaaagaaaaagtcttcctttgtaagagatatccttgtatatataagcgaacattataatgaaccaataactttaaaaaagctttctgacgtatttcatgtaagcgctggacatataagtcatgcctttacgaaggaatatacagtatcaccaataaactatgccattgatcttcgtatatgtgaagcaaagcttctattattaaatacagatgaatcacttacatcaatttcaaataaagttggatatacaaatataagccatttctcaaatatatttactagcagagtaaactgctctccgttagaattcagagaaaaacattcaaaaagtaaaaaaaatagttctaaagctaaatcctctgatatgaacactcaaagcactgttcttgtttcaaaaaatacttatgatgaaatacaagaattaaaagatactattgataaattaaaaaatgaaaataatattttacaaaaggccatgactattttagcaagcgaaaatatcacaaatgattaaaaacaaaaaagcattttctaaagatagaaaatgcttttttgccaatataataaaatttactattaagcttaaactaattttttatgtgaatcttatacagtattatctaaataatcccaatctatctagtgtttcaatagttagatttctaccttcagtagttccttctattattcttcttgctcttacactatcaccgatattcattatttcaacatctgtatctttaaagtgttcttgtaattctggtaataatgttgctacgcctctcatacctagacatacaaatccaaaatcaaaatctatatcttcattgtttccatcaacttcaactaagaaactactatctttaacttcaagaagagatgtgctcgtcatagctcttacttctttttccttaagcattgccatattttgaatcttagtaattacatctaaatcttttcctataacaggtaatctttctattatagtaacatcagcacctttttcagtaaagaattcaacaacatctaatccaactgctccaccaccaacgacagatatcttcttacctttaacattcatttctttaaagttttcaatttcatttattaatccaaaaattgaacgaacttttgaatcttctttatcaattctatctaaaagtccagttattggtggaagtaatggaattgaacctgttgcatttataatcacatctggtttcaagttacttacagcttcaactgtagcttctgtacctgtaaatataattaagtttttcagattattaactctgttgattaagtaatctgggaaatcatttattctatctttagctggtaacttagctatttctctagcaagacctccaaggtatgatttcttttcaaataagaacgtcatacatccagcttcagctgctgtacatgctgcttcaagtccagcagtacccccaccaataactacaacattagtatgcttatttacttttctgccttctaatgtatcttcaaatacaacatctggatttattgtacatcttattggtctatttaatccaattctatgtccagcacatccaatattacaagatatacattttcttaatgtttcttcttttccactttgaactttatttacccagtttggttcagcaataagtcctcttcccattccaactaaatctgctttaccttctgctaaaatatcttcagcaacttgtgggtttcttatattaccagttgttattgttggtttattgaatttatctctaacagccttagacatgtatgctctccatccatcttctaagtagttagcatctatttgaaaatatagagaatcatttaatgcggccgaaacattgtatatatcaacttctgcatccaaatattctaagtattctaaagtatcttctaatttatttccgccttctaacaattcatctgcactaattctgatcattatcgggaacataggtccaacttgtgctcttactttttctataactaatcttccgaatctcgctctattttcagcacttccaccaaattcatccgttctcttattaaatattggtgataagaactgacttattaaatacgagtgtcccatatgaatttcaactgcatcaaatcctgccatttgagctcttcttgctgcatctgcatatttatctgcaatttcatatatttcttcctttgataatggtcttggaacagctcctcctgtttttgaaggtacatctgaagctgatgctgcctgcattccaattcttcctggaacagccgatgcccctgaatggttaatttgtactgatacacatgtaccatatttatgtaatctttcagtaaatttatataaacctggaataaagcagtcatgatttaatctaagctgagttgttccattagatccaagtggaaagtcaacacatacattttctaagattattaatccagttccgccctttgctctttgttcataataacttatgtgctcttctgttatttctccatttgctccaccaaaattgcttcccataggtggcataacaactctgttttttattgtcatagttttcactgttaatggagtaaaaatattattgtatcttttcatgctcttctctcccataaaataaatttcttgaaaattcttgataaaaaactatcattcttgataaaaaattaacttttttatcaagaattcttcatttatcgctgtatatttattttaatatgtgataattcattaatccaattcatatttttaacattatctatagattttatctatagataatgttagtatattattcaaacaaatatttttataaaaaagatcagctaaatgaaaggattgaatgtacatgaatctaaatcatctaaactactttagagtcttagctaaggttgaacactatactcaagccgcatcaatactctcaataactcaacctagcctaagtcatgctatttctaatctagaaagtgaattgggtacatatctatttgaaaagcaaggtagaaatgttaaattaacaaagtcaggcaaactcttcttgaaatacgttgatgagtcattaaacattcttgaaattggagaaaaaaaattaaaggattttcttgatccttcaaaaggcaaaattgatttagcctttatttatacacttggagctgaatttatacctaatacaataaatgaatttcttaatgattcctcaaataaaaatattacatttactttcggacaggataatactacaaatataattaatgggttaaaatcagaaaaatatgatcttgcattctgctcttttgtggaaaatgaacccaatatagaatttttccctgtaattaagcaagatttagttttaatcatttctaaagatcatccattgtcttgtaaagacaatatagatttaaaagaaactgaagattatccttttgtttattttaataaagaaagtggaatacgaccaataattgataatcttttttcacaggcacaaataactccaaaaataatatgtgaagttgaagaagatactgctgttgcaggattggtttcaatcaattatggtattgcaatacttccaaatatatcaatactaaaaaatttcaatgtaaaaattatccccatatcaaatttgaattatgaacgttacatctacatggcttcacttaaaaatagatactcaactccatctgttaaatcttttttcaaatttataactgataaatacaataaagtgtgatatagaatttttcaaccttttaaagttatcaatagatttgactcaactatcaattatctaaagaataaaaaatatgccatccttataataaatattttttcaaatcatttattataaggaaagcatattaactatatctactattttactacatcaaaattcatttgtgctataacattctttaatctttcaattacttctatcatatctgaatcattaaccacaatttcatcagcatattttttatataattcatatctttcattatataaattaataactctttctttaccatcttttaaaagaggacgttttgaaacatctacatcttctagtattttttcaactggtctatctaaaaatattattaatgcatcttttttcaatgcatcaatattttcttttttcttgactacaccaccaccagtagaaatcaatacattcttttcctttgaaagctccctgcacatatctgtctctatatttctaaaataatcttctccattttcaaacaattctaagattgatttagatgttctttcttgaatatattcatccatatcataaaattttaaatctaattccctaccaagtattttaccaatagtagtttttccactacctggcattcctataataactactttatccttcatttcctacccccaaaattaatgatagtgaataacaaaaactaattgttcactactaacgattaagttttctgcctaattatttaaagttttcatttattttagaaaatactttatcaaaaacctcatcatctatatccatttcctgccatacttcttcagacttgattgcctgacctactaacatttcaagaccaccacatacctttttatttaatttttccccaattgctaaaaattcagttactcttggattataaattatatctatcaatgtatcaaagttttttataatattctctcctacagggcttactcctgtctttggatacatacctactggagttgtattaataataacatcacctttaatttcttctatctcttcataagttgtatactctactctatcatctttataatcagattcatttttatgatttcttgatactaaatatattttttttacacctttatcaagcaggtatgtaactacagcctttgatgctcctcctgtccctaaaaccatagtaattttaccttcaagttctacatcatatttctttataatagttccaaatccaaagtaatcagaattatatccatataactttccatcttttaaatagattgtattaacagcacctattttttctgcttcttctgaaattgaatcaagatatttcataacttcttgcttataaggtatcgtcacattagtacctttaatttttaaaattcttaatgaatcacacaatttactgatatcttttttttctacttcaaatattttatatgcgccatcaatatttaatattgaaaaaatttcatcatgtatttctggtgaaatactgtgaggaagcttttctcctaaaactccatagaaatccattgttaatccccctttttatttaaaataattagatttaaaatcttaaatttatagcatcctattacattaagcattaattatatattttttctataaccacctaacagcttaaaataaggactattttgttttattaaatttaatgcagtttctacttctttactttctatgttcccatcaaaatcaacatacaagaaataattccaagttccttgttccattggtcttgattctatctttatcatattaatgttgttttctgcaaaatgacttattaatttatatagagtaccagccttatcatctattgaaaatactacactaaccttattacattctgaatcagattcaagattttttgatattattataaatcttgttgtattttggctctgattatttatattttcctttattatatccagcttataaatttcagctgcccttttgcttgctattgctacttttgatttctcttttaaatcactaactaactttgcacttactgatgtactatgaaacggtataagcttccattcaggatggcactttaaaaattcagtactctgagcaaatggttgtggatgtgaataaacttcttttatatcatctagttttgtccctttaacacctatgatattttgatcagctcttatacactgctccccaacaatataaaattcatatttagataaaagatcatatacttgagctattgcacctgtagaagaattttcaataggtattacaccataatctatttcattatttttaactgctaaaaacacatcttcaaattcatcataagcttttggatttttaacatttccaaagtatttaagcattgcctcttcagtaaatgatcctgaaactccaaaaaagcctatttttttatcaacattattttctttatccaatacttttgacttatttattatttcagcattttttgctttctcttcttcctgcatttttctcttttgaagatgtcttgatacttccattaaatcattatagaactcttcaagttcaccagaataatctttattttctaaatatcctatattcttttgtattacttcatcttccctgcccctattaaatataggaagattattttccatcttatattttgcaacattaagaactacattcattctttcttcaaataactttgtaatttctctatcaatttcatcgattcgaactctataactatctaaatctgccattttataagtttctctcctttataatacttactcctacaaaaccaaatcaagtattccaattgcagttacagcttcaatgactggaacagctctttgaactatacatggatcatgtcttccttcaattatcagttcagattctttcttttcttcaatatcaatagttctctgctttttagctattgatggagttggctttattcctaccttaaacaatattggcattccatttgttattccacctgtaattcctccattattattagtataagttttaaccttatcaccatcataataatattcatcattacactgagatcctctaagctcactcatctcaaacccttttccaaactcaattccttttactgctggaactgaaaacattaagtgagcaagagttgattcaactgagtcaaaaaacgggtttccaacacctgcatctattccaattacagtacattctattgttccgccaacagaatcacagtcacttctcgcttcaagtatagcatttctcatcatttcttccttttcactacataataaaggaagttcatttatctttaagttatctaaaagttcctttgttagttcaacttcatcaaaacttttatcatatattgttccaatactcttaacatgtgccccaacatttatgccttttatatttaatatctgcttacatacagctcctgcaaaaacaagtggtgctgttattcttcctgaaaaatgtcccccacctctgtagtcattaaaaccgttatatctaataaaaccaggataatctgcatgaccaggtctcattaaatccttaagctttccataatcctttgaatgctgatcactatttcttattacagcgcataaaggtgtacctgtagtttttccctcaaagaatccacttaatatttcaggctgatccccttcttttctagcagttgaaagtctgcttttcccaggtgctcttcttgccatttccttcagtacttcttccatatcaatttcaataccagatggaagcccatcgattgtaattccaattcctgctccatgggattcaccaaaaatagatacctttaatttatttccccacattccactcatctaatgcacctcctaaacttataaagtcattccaaaattcaggatatgattttgtaacacattcataatcttttattattatcggctcttcacatatagttgatgcaattgcaagtgtcatggcaattctatgatccttgtgactccatactgtgcatccacccttaagttttgatacaccttctataataagtccatcttctttttctgtaatttttgctccaagcttattaagttcagatgtaactgctgcaagtctgtcacattcttttattctaagccttcctgcattaatgacttccgtagttccatcacataaagatgctgcaagggatacaacaggaataatatctggacattgagaaccatcaataattgttgatttcagcttcttatctacagttccaataattccttcaccattctcttttatattaactcccattctttctaatatatctataacttccttatcaccttgaagtgactttaaattaagatcattaacaacaacttcatttaatactgcatcagcacaaaggaaaaatgctgcctgagaataatcaccttcaactctataatctatactcttataattttgatttcctttaattataaattcctcataattattatttattatttcaataccaaaatctctcatggcacttaaagtaagatcaatgtatcccttagattccagttctgtagttattattatttttgaatctccatctaaaagcggaagtgtaaataataaaccagttataaactgtgaacttatatttcctttaactttaaattcaccacatttcagttttccttcagtttttaaatcaagaataccttctttataagaatacttaattccttgattatcaaatatctcataatatgtatcaagaggtctttttcctagattacctcttcctacaaacttatttacaccttcaaacaaagccgctataggaactaaaaatctaagtgttgaacctgattcattacaatctattattctctcatcacttgtactgttattaagtttgttttgaggtgattttatacctattacttcaagacaatcatcttttttctctatgactgctcctaatgatttcatagcttcaactgtagctataatatcatctgaaaaatctatatttgatactttacaagtaccatcactcaaagctgcacatattactgctctgtgtgccatactttttgatggagggattttaacctctccttttaatttcttcggataaactttataatctcccattattgcacctcactctatttaaagaattccacattagttttttctaaaaatgatttccctattgatttaagtaacacaacttttaaaacattatcaatatttttcttatctaatgatattgtttctataatctgtgaactttcttcaatgtgaacttcataaggaagaccatattgaatcaatatttccttaatatcttttgaaacaccctgttcagtaatttctttatcttctgaaattttgcttatcatatacatccctatcgcaacagcttcaccatgactaaattttttaaagttataataagcttctattgcatgacctaaagtatgtccgaaatttaacagcattctttctcctgtatctctttcatcattttctacgacacatttcttaatataacaacagttgtatatgattttttctatattattcataacttcttcttttgttttaagatttttaaggaaatagaaaaattctctatcctttatacatccatacttaataacttccgccataccatctctatagaatctgtcatctagtgtttctaatacttctggatcaattaaaacaagttttggatgatagaagcttccaactaaattcttacctctatcaagatctacagcaacctttccaccaacgctactgtctacttgagcaagaattgatgtaggaatttgcacaaaatcaacacctcttaaaaaagtagatgctacaaatccacctaaatctcctattactccgccaccaagagttatgattaaatcacttcttgttagtttaaaatctaataattcattatatacaaaaggaagcgtgcttattgacttagtttcttcacctggttctaaagccatcaatctaacatcataaccttcattaattaacctacttttcaccttatctccataatgtgaacctacatttttatcagttagtataaatatctttttacctttgaatactttttttatctcaatattaacttcattgagagatcccttttttattattataggataacttctttctcctaaatcaacaattaattcttccatactactctcctccttaatttagttagcagttaacagttagcagttttattttaaattattatatttacttttattagaaatcataacttctttaaaacttgaaaaattccataggaattttctccctccaactgttaactgttaactgttacttgttaactaaactaactgttacttgttgactagattaaatttctcttccaaccgctcctgcgataactctaagttcttccattaacttagcaaacttctcaggtttaattgattgtggtccatcgcataatgcatttgctggatcattatgaacttcaattataagaccatctgctccaactgctactgctgctttagctaatggttcaaccatccagtatttacctgccgaatgacttgggtcaataactacaggtaagtgacttagctttttaacagctggtactgcacttaaatctaatgtatttcttgtgtaagtttcaaatgttcttatacctctttcacaaagtataacattctcatttccaccagccataatatattcagcagacattaaccactcttctattgtagcagataaacctctctttaaaagtattggtttattagtttttccaagttcctttaataaatcaaagttctgcatatttcttgcaccaacttgaattacatctacattttctacaaatgtttcaatatcatatggtgacattaactctgtaactattggaagtcctgtctttgcttttgctttctttaacagttcaagaccttcatattttaatccttggaatgcataaggtgatgttcttggcttgaatgctccccctcttaagaaattagcacctaattccttaacttcttttgcaatttcaacaatttgttcttcactttcaactgaacatggtcctgctataactgcaattttctttccaccaattttaacaccattcacatcaacaattgtattttctggatggaacagtctatttgcctttttgaatggttcctgtacatgcattacactttccactatttcacttgcttcaatacttgatggatctacttgtgttgtatctccaactaatcctaaaacgcttttttctgttcctataacaggattaacctttaaccccttcgcttctatttgttttgttaatctttctatttgttccttttttgctttttgttttaatactactatcattttataagcccccttaattcaatggacagttaacaattgataattgacagttattagattagataatttatttatcatttaaacttttaaagtatgttctaactatgtatcaatctcttttataaactgctttattatcttatttacttgttgtatctttaaatttttataaaataaaatagagctcacgttaatgagctctaaataataacttaatataaagtttctttttctttaaaaaataaactatagtggattaaacactcattaaagatatattattattcagttttttgcaaaagaaatagccagcgctaaaataaaagccccagaacataaagtaaaaaaagctataaagtttttgcataactgattttataatatcctttttcatgttttttctccaatcattgtatttttagtctttttaacattatatcaaactatcatattttgtcaatatatattgatatttttttatttattttaacgattatatgattatttattaattcatctctctatgaaaaatctattttgtgtatattattttaccttcaatatctatatgtttcttaagattttcatttgttattgaattataatttattatatcaaaaaaatatggcaacggataaatctcatttaaataatcattcaattttaaaatggtattattgcttatgagttctcccaaaactgcaatatcaacatccgaaccatttttataattccccattgctctacttccaaaaattatagccttttctatctcttcacactgttctaatgctttttttatatatcttatatctctttctaaaagcccatacattgctataactccttagataacttatcatacattttttcaagctctggaagataaattgatattatttcatgtgtcattttagatgctaattcttgatcatatgtatgtgcagtcaaatttctatccgataatgcatctatccatacatgaccattatctatcaaaccaatctgaaatgcctgttttatagtttctcttggacttttaaccatatatccttcactttctaagtaatccttcaatactttccaagcaagttcaaaagccatctcaaagaattgtatcattcctgctttttctaattctgtagaaatagattgacttgaatacttctttaataatttataagtcttttcaaaattttcaaatctctgcttccatctaatttcttttagattatccatattccacctctgttattgtttatatttttattataacctagtttttatttttataaaacactatgaattgtttatatgattaataaaagcagttatgaatttgttaactatcaaaattcataactgcttttaaaattaattttaaagttaaagtataggagacactaatctaattaatgactcttcaattcttagtaataaacttctgttattatatgtttcctttgttatctcttctgagaacgccatgtcttttctaaattgttcttccccatctaatgcaattctatcgtcataaataaatgcattaacttcaaaatttaacttaaagcttctaatatccatatttgctgttccaatactcataacgccactatcagaaaccattgttttagcatgaataaaaccattattataactatacaccctaacaccagcatctagaagttcacctatatatgaactggctgcccacttcataaagaaatgatctgccttgcctggtataattattcttacatcaactcctgacaacgctgatattctcaacgcttctaatactggtgcatcaggaacaaagtatggtgtttctaaataaacattctttttggcattatttattatctttatgtaagcattttttatatattcttctttatggtccggtccacttgttactatctgcatggacacatcaccacattgatctttatattcattcatatacttatcaaaatcttttatattctcttctgatgcgtaacaccaatccaataaaaacctttcatttaaatcatttaccgcatcaccctttattcttacatgagtatcgcgccaaaaaccaaattcaggatcttgatttatatattcttttccaacattaaaaccaccaacatatccatatactccgtctataactacaatttttctatgatttctataattaatacgtgtatttacatgtggtaaaattcctgggaagaacaaagaaaacttccctccagcctctatataatgttttaatgtcttcttggtaagagaccttgaacccatggcatctactaaaagtcttacttcaagtccttcttttgcctttttagttaactcatctataattctctttcctataatatcctttttaaaaatataatactcaacatgtatgtaactcttagcattttttatatcctctataagctgtttaaatttatcttcaccattaacataaacatctacagcattattcactgtatattttgaacctgaattattaaaattcattctctgaagatcactaaacttatcaccaccgctatgtttagaaaatagcttttcatcttgattgcttgccattctctttttttcatctgaaataattttatccttaaaaattttctgtctgcttaaattctgaccaaacattaaatataatacaaatccaacgcctggcaaaacaagtaaaataagtaaccatgcccatgttgttgtcggatcttttctctctataaatattaaagataatgaaaaaattatgtttaacactacaacagcaatagctacccaataatatatatgcatattcccatccttccttcgtaattacttaaaatacaattctagtaattatatgtttctaatatatcatataattactattttatcacagattagaactgtaattaatttttatattcttaaaatttacgctatttttacataataataaatactttctttcttatttcttctccttgattttttacaaattttaatatataatgagtctaaaattacatattaagctatgagtaggagtagtaacagtttgtatatctttagagagttattggttggtgtaaaataacgttatattattgtgaacttgtctatgagcttatctgtttagaagcagatacgggataacccgttatagtattcaagtgagaagatttatttattaagtaagtcttctaataagagtggtaccacggaataacgctttcgtctcttgattgagatgagggctttttttattttaaattaaacaaaaatataagtatgcatttaatattatcaggcaaacagttttttaaaaatcattctttagttaagatttatgtgatttttttaaactgataactgttaactgcacactaaataaattttggaggtaaagaatgtcaaagtatagtactaaaatcgatgaaaaatggcaaaaaatctgggaagaaaatgaaacttacaaattcaatcctgaaaatactgataagaaactttatacattagaaatgttctcttatccatcaggtgctcaactacatgctggacattggttcaactacggtccaacggattcatgggctagatttaaaagaatgcaaggatacaatgtatttcagccaatggggtttgatgcatttggattaccagcagaaaattatgcaataaaaactggtatccatccacatgattcaactttaaaaaatatcgaaactatggaaaagcaattaaaatctatgggtgctatgttcaactgggaaaacgaagttgttacttgccttcctgattattataaatggactcaatggttattccttcaattatataagaaaggcttagcttacagaaagaatgctcctgttaactggtgtccatcatgtaacacagttttagctaatgaacaggttgttgatggtgaatgtgaaagatgtggatcattagtaactaaaaaagatcttactcaatggttctttaaaataacagattacgcagatgaattacttgatatgattgatgatttagactggccagaaaagactaagtcaatgcaaaaacactggattggaagatcatatggtgctcaagttaacttcaaagttaaagattcagatcttgaattcgatgtattcactacaagagttgatactttaaacggagtaacttatgttgttttagctcctgaaaacaaattagttgatgagcttacaactgctgaaaataaagaagctgttgaaaattataaagaagaagctgctaaacaatctgatattgaaagacaatcttcttctaaagaaaaaactggtgtattcactggatcatatgctataaaccctattaacggcaaagtagttccaatatggattgctgactatgtattagctacatatggtacaggatgtgttatggctgttcctgcacacgatgaaagagattttgcttttgcaagcaaattcaacttaccaattgaaagagttataactgataaggctggtaatgaaccagaacttccattctgcgaacacggaatacttgttaactctggtaaatttgatggtttaactactgctgatgctaaaaaggctatcgttgaagaacttgaaaaagataagcttggtgctatgaaggttaacttcagattaagagactggcttgtatctagacaaagatattggggtgctccaattccagtaatatactgtgatgattgcggaatagttccagtaccagaaaaggatcttccagttaaacttccatatgatgtagaatttactccagatggtaaatctccacttggtaaatctgaagatttcataaatacaacttgtccttgttgtgggaaacctgcaaagagagaagctgatacattagatacatttgtatgttcttcttggtactacttaagatatccagataacaaaaatgaagatgcaccatttaattctgaattaatcaataagattcttcctgttgataaatatgttggtggaccagaacatgcatgtatgcacttactatatgcaagattcataactaaagctttaagagacatgggctacttaaactttgatgaaccatttaaaagtttaactcaccaaggattaatcttaggaccagatggattaaagatgagtaaatctaaaggaaatactatttctcctgatgaatatataaaagaatacggtgctgacgtattcagaatgtatttaatgtttggatttgcttacacagaaggtggagcttggagtgatgatggtattaaatctgtttctaagttcattgaaagaatcgaaagaatattagaatcatgcagagaagttataaactctacagaaaacataaaaacaactgtagattctgcagaaaaagaattaaacttctggaaacacactgcaataaaaggtgtaactgaagatacagataaaatgcaatttaatactgcaatagcaagacttatggaacttacaaatgcccttaataaatatcttcacgaaaatgttaagaatccagaattcttaaaagaaactataactgattacatcaaactattagcaccatttgctcctcactttgctgaagaacaatggaatcaactaggaaatacttcaagtgtattcaatgaaagattaccagagtttgatccatctgctctaattaaagatgaagttgaaatagcaattcaagttaatggtaaaatcaaagcaaaaatcatggtttcttctagcttagatgaagaaggtataaaagcagcttcattagaaaatgaaactattaaagaaaatactaatggaaaaaatatagtaaaagttattgttattaaaggtagacttgttaatatagttgttaaatagtattagatattaaaaagggatatggcagatgccatatccctttttttataagatatttctttaagcttttcgagaagttcaaaaaatcccctaaattatattctgtattcttgactatcaaagatttcatagccctcagaagcatatcatctgctaaaataaaaatctttaaaatttctacacaagcttttgaatatttataatttaaattctaaatattcaacttatttcatataacgtctttctaaaatatcaactacctgcactttcatatgatcttattccaattgtccatattttatatgctactgtaatggatattaatgaaataataacagtaagcaatactcctacttgaaaagattcttttccaaggaaatatgctgcaggataatatccagtaaaagcaaatggtattattcctattaatatgaatttaataaccttaggatatataccaattggatattttgcaaatgaactaatctgatatgtcataaataaatatgaaaaggatgattttgtccagaatgctattgatgctactgcaagctttattgctgaatatataattgtagaaaatattataactacaactaatattattaatttttttattccgaattgtatccctaattttgctgatgaatataccgtaagcataactccaactattatttcaccaagtccatcaggttgtacactttcagatataacctgaaataatggattaagaggacgtaaaagatatctgtcaaactctccttcaacaatagtcttccatgtaaaaatccacagataatctgtaaagacatggtctattcccctaggtatctgagccattccgtatataaataatatttcataaaatccccatccatctaatgttggaactgaattaaatataagctgaataaatattattcctgtaaattgaaccaaaagaaatcctataagtccaagaactaaacttgctctatattctatgagaaccttaatgtattgctgaaaaaacttattatataatctaatatatctcatcataatattaacctcccaatatggttaagttctttaccagagccttatacataacttttcctataatcatcatgactataacccaaaatatctgtcttccaaatgctatgcatatttcataagaacttagcttgttttcaaaaatcatacaaggtgtatatattattgatttgaaaggaaagaaatcaaatatattctgtacaactttaggaaaaaatgctattggtacaagtgcacctgaaaaaagtgctgtaaccgcttgcattatctgatttacccccacatatttgttatcttgaatgttaaaagccccattgaatagctatagtaaaaatttataaaataagatagtattacactcaaaaaatacataattacattaggaattgtaagtcctatttgtgttttcatagcaataattaaaactgctgtaaatcctattataaatactaaaataaatccataaagcatacctccaaagccttcaaaaagcattcttttttcatagcttattggctttataagatttgatgctattgatccattcctcacttcccttgatattgtattgcctacttctgtccctatcaatccttgagtgataaatgataacagtacatatactatcatgtcattataagagaacccatttagagttccttgtgatgaactgctataaatagctttccaaagatagtacgtgacagccaagatcatagtatctcctaatacaaacattattgtattagccttatatgcaatatttctttgaaaaacgtttttggtaaaggtaaaatatgatttaatgcttaatgattttttcatatattatacctcttttctatagattttttttataatgtcatcaatacttgtttcctttacagaaaaatcttgaagtatataattttccataaagtattgaattatctccatttgtgaaatcttattcttattgaatgttatatttatttttccatcctcatcacttagattcaaatcattattatctagattaaaataagaattaatatttatcttatcttctaattcgtttttcttaattaatatagatacattagtcatatatccatacttctcttttatttcgcttaaacttccatcgtaaatctttacacctttatcaattattattatcctgtcacataattcttctatatcttcaaggtcatgtgtagttaatataactgttgtattatatttcttatttatttgctttattgcatttctaactttttcttttacaacaacatcaagtcctatggtaggctcatcaagataaagaattttgggattatggataagtgatgccgcaaggtctgctctcattctttgtcctaatgaaagagttcttactggtcttaacataaattcatctatttctagaacctcattaaaaaatttcattctttctttaaagtcttctggagaaacactataaatatctcgaagtagagaaaaggtttcacttaaaggcaagtcccaccatagctgagttctttgtccaaaaactacacctatattcattgcattttctgttctattttcatatggaattatgccatttacttcaacttttccacttgtaggagttaaaattcctgtcatcatttttattgttgtagattttcctgcaccatttgaacctatatatccaacaacttctccttcttcaatttcaaaattcatattatctacagcacttgttactgtgtattctgttgaaaataaagattttatagcacctttaaatcctggatacttcttatttgtcttaaattccttggttaaattacatactttaatcaaaaatatcaactcctatactggcaggttaattaaacatatctttatgcataatttatattaattttaatgcccacccaagtcaacattatttaacttattttgtaataaattcaaatagttttgtgatttattactaaataaactaaaagaaaaaactgccagaataaaatctgacagttataaataatgtatttatttttcaaaatccttatacattaaacttggctgtataccagtattattttgatatttcccactattgtataaatcatattcaccatgaatatcatgataataaatctgacatatgtcaacattaggataaattcttataggttgaacacagaatatttcaagagtccagtatcctgcaaatccaatgtctccaaaacctgctgtaacatgaataaataatccaagtcttcctgtagatgaacgtccttcaagcattggtacaaatttttctgtttttgtaaattcattagttcttcctaaatatagtttacctggctctaataataatccttcttctggtataacaatctttttagttggatttggagtcttcatatccaatacattattttcataaactaatagttcattaaataatgataaattatagctattgggattaatcctgttttcatcaaaaggttcgattaatatatcttttcctatgttctttaaaatttcttttcctgataatatcattttcttcattccttacatatctgaatttaatatttccttgaactcatatagtatttttgtaactttattctcatttaaaggtttatatcttttaatataacctgacgattgaagttctgtatataaatctttacacatgccaacccaattttctggcacataaacccataatatatcctcatatttacaactaagcataaaatgctccattccccaaaaagaatactcctcaatttcatgaagcttcataaacttcttataatccttaactacttttaatgttaaagaataattgtatatatctacgtaaaaaaagtcaaacttttcgctctccgctttgaatgcatctgtacatattatttttatctttttattttctttaaaattatccctgtacaaatcaattatgtcttgactcgtctcataaacaataacttcacttacattttctttctttgccatttctaaagcaacatatccaagtccaagtccaactattccaacttttccacgagcatagcatatagcttcataggaactttctatctctcttggatcaattctcataacacacttatcctcttttagaagttccactatttctatattatattcttcaatatttttatacatatatccatgaatatcttttttcttaaatattcttctatctattttatataaacccttattcccatcttttatagcattattatattcttttaaaattgtaagaatatattctttgttatatggtttcataaaaaaatcctttctcgcaatattcaaactttattaatctattaataaaaaattatatcatatatgtattactttttttgtcatatgtagtataaaagtaattataatttcatattttaatttgtctttttattttacattttatatgctatactaattttacaatgacttttgtcattaactttattaaaagtaggtgttaattatgaaaaacattactataagcgaagaagcttacaatgagtttaaaggatttttagaagaaaataacataactgattttaatattagaataaattttgctggattcgcgtgcagcggtccaatatttaatatttcaatttctcaagcaactgatgcagacgaagttgaaaagatacatgatatttcatttatttatgaaaaaactttaattgatcaattcggtggatttataatactttcatctgaagaaaatgaaggtaatggcttaagcctaaaacctgtaatccagcctgaaggcggatgtggtggttcttgtagcggatgccactaatccattagttagcttttaaaagctaactattaacagttatggtcatacataaaacttatttatgtatgactttttcttctatataaaattaaacttaattggaatattttttcttaattattagcatataaaatctttagctatagacatcagctgcaagctgatcttctgcctctatgttccattctacttcaatatagtcattgcttatgtcatatataccgttaagcatatcaatccagtaatgatttcttataactttcttttgtttactttctccactatgtccatttagcatatttccattgaagtcattgaaatattcatatattctcactgacatatcctccattgctttaaaacaatccaagtctctgtcttctaaaataagcttactctgctcatttttcatttctttacttaaagtcgataacatatactcttttatttttccatgaatatctttttgtattaccttatcagactctatgttctttgcaaaaattgatactgaacgctgagtataatctgcatactgttcccacagttttataacgtcacttgcaataacatcataattcttatatagtttcaaaatttcttcatttcttatgctgccactatctaaacttgtatttaatatatccataattccttcatttctttgtcttatctcttctatttcaacataagattcctggccaatattatatttgtaactatatattttacatgcagaataaatattagttattatacttacaaccaatactacagaaagcaaaacaatccaatccttgctttttagttttattttcaaaaacacccaacctttctttattaattaatgttacctaaataaattatatatattgtacttagtaaatctatgtatgcactatatttttaaagttatgtatttatttttaatcaattactaaatacaacatataaattttataaatcacgtttattttaacatatgttatctcatttgcatatcttatctcgcccaatcatgtataacttcattgaccatctgaagacctatattcccttcaagcttttcatatttttctctatgtattctttttacttcaccataagattcttttaaagataattcatcatctccacagattacccataatgtttttttattaaaaggcttaatttctaattctttttcaccaactccatcagtaaaatatactaatatacagtttttcatgtttttatctcttatatacttaaatactggtgaaaacaatgtagatccattttctctacatcttttttgaatatctttctcactacgaagtttatatacttttcttatttcattatcacattcaattactgtaactttattttttgaagcatgagttatacttaatatctcaataagaatttttttcatttcatcatctttcatacttgcacttatatctattgcaacaactacttctgcttcatttttaggtaaagtccctcttaaatcaaaacgttcaggctgtcttctgtttcttcttacaatagtttttttatatcctgacttcattgctggtattgcatttttcaatactagctcccatgatatttctggtttttcatcatatgaaagtattattttttcaagcccttcaggagtatttttattataagcacttattgctgtttttttagttaatgagtttatactttcttcatctatatcaatttcatcccatatttcatgagctttatccatttcaagaagaaattcttcatttccattttcattaaatttatctttttttattctagattttatagatttataaatttcctctgcatactcttcaacacttctattttccgctaaatttaaattatgctccatatttatggactcaagttttctgctataaccaggaagatcctttatgtactgatttattgaaatatctaatgccactccaacagcctctttgctaaatctatttttaagctgtttttctcgctcaaaatgaagattcattatatgatatatctcatgttttaacaaagcagccatctctctcttagtacagttaagaaagaaaaaaggattaaaatacatattgaagccatcacgttttggaatagttgcaattggaaccttaatgtcaaaccttatttcacgttttatactaagcataaattgtccaaaaaaagcatcctgtccttgaagaagaaatagtatgaccttttcaacaatatcaaaaaatcttcttttataaaaatctccacattttttcttttcatccattagaaaaacttcttttagaagttcttctctttcttcattaaaatccacataaatcacccctttttcttaattaactatttcattttatgaactttataattaatactaaaatcatatactaacttcaccattaattattaattaaaatatctcttatttaaaaatgttaaagaatgcttctaaaaacttgtcattatcaagcaatttttcataaatactctctctatagtctcgttttatctctttcattattccaagccttaaatctcttggatataaatcaagcaattcagaaaataaatttaaatttctttcgctattattttcttttaaatagttaacagcattttttactaatatatataatctagaatgattttccttttgtattttttcctttaattcaaattcaagtacatcattttcaaatatatcatcaactttaattaatggtttttttagattcataataaaactactaaaatcatttgtaatacttgatcctacatttcctttaactacatttaacaatgtctcaaaaggatatttatctttattatttatgtaaatattatatgattttgatactctttcccaacttcgaggtgtagctttaattgtttcactactgtctggagtatgaagatactgtggaaatactgaaagaaattctattatatgttcatttatatttccttctttgctcattccccatcttatccattccttaatatctgaatcaagttgaatccatacaaatctatcttcttgtgcagggtctaaatcaacaacttcatattgactattataaaaaccatcatttctacttgaaggattcatagctgcaattacttttaccctgtcatttaaaatatatccgtttatttctctgtttagtattaaattcattaattcctgtgcaactgaatgatcacatctgtttaattcgtctataaataatataacctgcgctgtttcatattcttttaaaagcctatctatttcaacaagtttatggtgtgttgcataaacagtagtattattatttacaataggaagtcctcctatttcaccttcttttagaagatttgcatctatagtaacaagataataaccattatctcttgctatatatttaattagagaagtttttcctataccactttctccaattatcaatggtacttcatttgattcaagtactaaactgacagcatttatacattctgaataattcattttcctcacctttcctcgttctatattgacagcttataatcaactaaaaatttctttgcattcttgctgccatattccctaataaaattaattttatccatttctagtatttcaagttctaagaagtctcttatgtactccctgcttatatcctcttttttaaccatatttactagtacttctacaactaaatcaacatcaatactttcataaatatatttgaccacattaatattagcttctataaacagcttaatttcatctaaatcataattattcatataatttatagcttcaccattagatttaacagcttctatctttgccttaagtgtaggtttatttataaatttaatcgctgcataatatgtttgtattgctttaagctgaactttttcacttggatcctctatatattttattgcatcatagtctctactcaccgcaataatctgaagttcttcacttggattttcaataaactgtatcgcccatcccttagttcttaccgcttcctcaataactttaggtgtttttattttaatgtattctaatgagttccatgcactttttacacacataacagctacatcttcatccatattaataatatattttgctgctaatggacttctttttatagcttcaatttgaaggtttttttcaggattatctatatactttatatttgttccattattttttataagaaacaatttaaattcattatcacaatcttctatttcttttatatattctggattattttttaacttcaataatatttcatcttttttcatataattctcctcctttttttattaaacttagtttactacagaaatgtttttatagatagatatatgttttaactctccactactacgccaaaattaaagaaagctatgtttaagataaaacttaaacatagctcttactaatctttatatctttcaatttctcttttaacagaaaaaagtaaactgttgagttcccacacttccccttcttctataagcttattaagtgtcttttcatatcttgacgcctctgcatgtttgcctaaggacataagggttaaaagtgcattcataatacttgtaattaaatgtgacttaacttcaaataatttttgagcatcctttatttcatcctttatttcaagcatttcttcatctaatctaaatgctgcatcagctgaacgtttaagcttttctttaagcttttctggtatatgctgcttatatttataatttaatgaatgttctattgttgcccagaaattcattgcaagtgttcttatctggaattctgctaatatttctactggtccttctgccatattaacaggatactttattatcatatgataacttctatatccactgcctttaacatttcttacataatccttttcataaagaatctgcatatctctacggcctcttaaaagttctaccactgtatctatatcatcaacaaattgacacattattcttattccagcaatatcctcaagttcatatcttattctatctataggtataccaaacttatttgctttctcaagcatacttgaaacttcttttactctccctgtaacaaattctataggtgagtattcatttttttttctatattcttttctaattgatcttaatttaacctttaactcatcaactgcttgttcataaggcattaagaaattcttccaatcatttatagccattgatatcaccctttttatcatatcattctttactattatagcaaaaagtttaaattatgtataatgattaatcaaaatattcctttattttttaatatacattattaattttcttaattatgatataattaaatatatatatattttttattactttgaggtaactttatgatgacagatgatgtacgtaattatttatttgataagacagtaacttgtcctgtatgtaattctacttttaaagcaacatgcgtgaaatcaaaaacgccacgaatagactccaaggattcagatttctttatacgatatagtcctaaggttaatccttatttttatgatgtatggttatgtaattcatgtggttatgctgctctgaagtctgattttgaaaatatcagaaactacagaaaagaactcgttatgagtaacgtaacaccaaaatggatccctagaagctatcctagaatagcggatgaaaaaaatgccattgaacgctataaactagcgcttttaaatgctgttctgacttcaagtcatgacagtacaaaagctatgatttcactaaaaatagcatggatgtttaggcttttaaatgataatgtttctgaaatgtcatttttaagacaagcattagaaggatttagaaatgcatatcaaaatgaaccattccccatatatggacttcaaagagattccttaacctatcttattggagacctaaatcgaagggctggaaatgaagatgaagctttattgtggctttcaaaaactatagttaacactaatgcttctcatagggttaaagaaatggcccgaacaattaaagatttaattaaaaataagtaagctactattgttacatagcaggaggtatatttaatgaatatttttaaaaagaaaaaaacaacaaataaccaaattgaagaaaaaaatctaaacacagaaattgaaatggcacaagaacaaaatgatgaaagtctaaattcagctacaattgataaggttaacattttaaaaaataaaacagaaaatataaacgattcattaaaaacactatctgattctgtttcattgttaacaacttctacaaataacaattcaaaagaactttctaatacaaaaaatatattaactggcttcagttcgagtatggaaggtttagcagaaaatattacaaatgttcatataaaagtgttagattcagaaaagattgctgattcaggattgaatgtaattgataaccttgatacttctctaaaagatcttgaaagctcttttactgtgtccaattctactgttaattcattagtatcaaaattggaatcagttaatctaattacagattctatcagtcaaatagctaatcaaactaatctattatctttgaatgcagctattgaagcagcaagagccggagaagcaggtaaaggtttttctgttgttgctggggaagtaaaacgtcttgctgaaaattcagaatcagcagtaaaaagtataactaaaattcttgatgaaattaaagaagatatcatgagaacatctaaagctatggatactggtaactctgcattaaaaattcaacataactcattatctgatgctaaaactagtttttcagatataaaatcatcaatcgaaaatgcagctgatgaaattaatacttgtataactaatctagttactgcttatgaagctaaagatacagttatttcatgtgttgatagtctagaaaagaattatgcagaacatgaattacttactagcgaaattgcatctacaattgattcaaaatgtaatgaaattcaagctctttcaagtgaattatcagaaatataaatataataggagatagtttttaaagaaaactatctcctattatattttattatacctatatttcttaaattccaacttctctaccatacacttcaaattgacttaatacaggaaattctgattcttcctagtacctaatcaaattcgataactttagccatgatatttttctagcccaaaatttagatagatcctattttttataaaaatttattaaagaattctcttagggttaaaatctatataatctgctgatgttaaaatatattcaacatttccccacaatccatttaacaattttccttgtaatacaggaccatgtaaatgaccatatatgaccttttcaacactatattcctctattatgttaacaaaatcagatttttgaaatttctcattagttggtggataatgaagcatgactattattttttcaaatccttgcttccttgccgcatctaatgataatttaagtcttataagctctcttttatagattttctcatcctttaatgtaaatttatcaccacctggacatatccatcctcttgttccacagatagcataatcttcataaacataaaagttattttgaagaaattttgtgttttcatacattgcatttaactttgaaatactgttccaccaataatcatgattgcctttacttataatcttctttcctggaagttcattaatccaatctagatcatatatgctgtcttcttcttttaaagaccatgatatatcacctgctataagcaccatatcatcattagttatcttagaaagccaattttcttttattttatcacaatgatttttccatttatcaccaaatatatccataggtttttcaacattaaatcctaaatgtaaatctgaaatagtataaagtgccattaaattttcacctttctcttttgtcttatctcttcttatccagatcagtaataaacgctattacatgggcaacagcttcatataattcttctggaatctccgttccaacatcaacattacataacaaatccgtaagttccttattatatactataggaacatcattttcctcagctttttctattattttatccgcaatataacccatacctgatgcagccaccgttggcgcatcactattgaattcatattttaatgcagctgcctttttcctctgattcattattttctccccttcataaattaattataaattatataaacttcaagctattttcataataagttaatacttctctagatcatttcatatataaaacaattatctacaattataatcttagattataattgatttaattttactctataattaaatttagtacaaatactaatatatatatttcaattaacatgccaaaatttatgttgaaatcactatttcatttttagattataattgtaaaattcatagtacaaaatatatttttttacttgcaactattatacttttaaaatatctatatggatttattcagcactatcattataataacctcaatatataatttaaaccttagtatctatagctgatattgttacatcattgaaaaacgctcttgtactcacaatatctgcacgttgttcttttgcatcaactttaacgcttacatacactcctaaagttgcaagaccatcaataagtccttttttatgattatctaaaacaaccgtatatttatcatcacattttaaatttacatctattctattttctctcattgttaaatatccatcaacttcacctaaattagatgtttttatcgacaataccatctttgtattagtagtatctattttctttccttcttttctattatctttaattataagctgacatggatacttattcatctgacctgatatatcaaaatttaagcaataatattcattacttattgaattaaatacctttatatcatttatattttcttttattagattagttatctttcctgaaactgattcttgtgttgatgtatttgctaatagttcttttacaacatctttaacattatcaattttagaccttatttcattttttatactatcaactctattttcatcatctactgtatttataagattacttataaaagaattagtgttttcagcttttttaggcattacaaaagatttttcttgtactgatggatcattctttaatgtaattgcttctgcactacctttaaaaatatcattttttacaatttccttaatatctggtttttcaatattggttttattttgaactatttcagttatctttttaaattcagtatctgtaagctttacatcttttccttcagctttacttaatatatcttctactcttgctttatttgtagactctataagacttgacgcttgagttttaggtttatcttcacttaaagcagtatctcccacaatgtcctttatagattgagaaatatttttatcatttaacttctccattatagatttatctaaaacattttctccttcaattgcactatcacctgctaatgttttcaatatttcaagtacatttattttattatttgatggatcatgttcagcatatacctttgaaaaagctgctgtatttaaagaattattgtctgatttttcttggtgtattggttgctttgtagtatcatttatctgtatatcttttgcactaagctctatatctgatgcattaagtttttctttaatagataaaagtattttttctattgaagaatctcccttaaaaagtttattaaaactttctatattatcttgtgtaaaatcaatattattttctatgaatgtaagtatatcttcttcactcatatttttaaattcacttataaatttagtaagtatttccttcatagcctttccttgatcactatttatatctatacctttactggctatatacttctcaagaaaagcatctagttcatctggatcgcattgaattttttcactaaattgaagaattgtttttatctcatttatattttcctttgataatgaaaaattatgcttaaccattttttttaaaagttccacatcttcttttgataagccttctttttcaactacttcctgaaaattttcatctccttcatcaacattattatttgatgtatcacctttaactagttttaatttaagctttccattttcaaatccatctacttgaaattttacaagcttaatatcatctaaattaacttttccatctaattccgcaataaactgccaaccatctgaaagctttattgttacatccttaccatcacccttatcaactattcttccggtaaatttttcacccacttcaaatgttaatttactagatacctttctagtgttcatattatatccgttatttatattccaaattcctggcatctttaatttcacctactttattatttttattatccccgtaaccttatactgaattcacaattcaatatgtagttaaatttaaatctatatattctaataaatattttatatataaatcaaataaatcctgtaagttttcatatttatttttccttgcttacagaatcaaaaaaagtgaaatccaatataaattttcaattaaaatatacttctaatatacttatcgtaagtaatatctataaattaagaaaaagctgcttctaattttagaaacagcttaaatctattaaaattatttaatttctattttattgtagtttttcttacctctttttattagcgctataccatcttcgaaatcttcttcagttaaaactcttgagacatcagtaactttttctccgtttaatgataatccgccttgttcaactaatcttctaccttcttttttagatggtaagatttttgtgcttgccataatgtctatgatagatgaacctaattcttccttagtaatagatactgtaggaacatttgacatatctgcaccaccagcaaataatgctgtagctgcttcttcagcctttttagcttcttcttctccatgtacaagctttgttacttcaaatgctaataccttcttagcattatttatttctgcaccttctaatgcacctaatcttcttacttcgtccattggaaggaatgttaataatgctaaacatttttctacatctgcatcatcaacgtttctccagtattgatagaaatcatatggtgaagttttttctggattaagccataaagctcctccaactgttttacccattttttgtccttgactgtttgttaataaagtacaagtcattgccattgcttgaccttgtgcttttcttcttacaagttcaacacctgcaatcatgtttgaccattgatcgtctccgccaagttccatcttacagttatattgttgatttaatacatagaaatcatatccttgcattaacatataattaaattctaagaatgataaacctttttctaatctttgtttgaaacattcagctgtaagcattctgtttactgagaaatgaactcctacttctcttaagaaatcaacatagtttaagtttaataaccaatcagcattattaactattaatgctttatcatcactgaaatctatgaatctttccatttgcttctttatagaatcaacattatgctgaatagtttcttttgtcatcatttgtctcatgtcagtcttaccacttgggtcaccaatcatagctgttccaccaccaattaaagcaattggtctgtgtcccgctttttgcatatgagccataaacatcattgcaataaagtgtcctacatgtaaactatctgctgtagggtcaaatccaatataaaaagttatcttttcattttccaataattttcttgtttcttcttcatgagtaaattgttttatgtatcctctttctaacagctcatctaatacatttgccattataaaatacctcccttaattcagttgacaattgacaagtgacaagttaatgataaaatttctttctgaaatttattattaacatatatttaaatataagaaattacattcactactattgcaaactataaatataataattttgcctattatctattgtcacgtataaactactataaatagtatatcctcaagtgataaatttggcaacataacattaatactaatactagctatgctcttttggattattgtccatatcatctttacaattttttgttctattgcatcctggtagaataactttaaaactatgctcaattcttgaatttacaaatctaactttacccctattcttaaaagcatctcttattcttgtaaatccctttccattgtttaaaaatctctttttctcatctatagttataagcttttcataaagccatatatttctcttattatagtttgtcctctctccttttatattttcatctataaattcacctggacttgatataataatgttattattatcaattgttatctcaactattctatttaaatcaaaatattctctataaagaactgcattttttatactctcaataattgcatctgaaggatactcttctggcattatttctaaaatctttttttcagccttatccaccatatctattagatttccttgaattatatatccctcaccataatcatcatttagtttatttactatttttatcatattatttggtatatatatataattgatatcacaaaaaacaagaagtcctccataggtgcactttaactgctcaccttttctatcatcgtaagctattcctgaacttaaaagtaaaaaatccctattttcatctgtaaagtttattcctttacgtttaaaatatttatttactaaatccatatttaaaacatctatgttactccttataagaggacatgtttctattgtaagacttaaattttcctcaagaagggcaactaattcctgttttctcataacatctgtagttgaacctcttcttatataaaatgcgccattttccctaatttgatatggcttctgtccaccatcataaatagaaataacaccaatagtctttccgttaagatcaacaaaatctacccttaaggggatcggtggttcacatcttgatgttattatctgttgaatccgttcctccttaaacatatcctcactttgtatccctattattttcttagtcttatcctgaattccaactataatatatcccctttgaccatttgaattagctattgcacaaatatccttggcaagttctttttttcctgtttcagtagataaatctaatttcaatttaaaatcaagtttaagaccttcttctttttttattaaggaccttagtttttttatatccataaaaacctccattgattctacataaaactatttaataagtaaatataataaaatacaaaaaaagtagatacttattaatataatactaattataaattaaccatctacttaaatatctatatagtttgtttttttaaactttttgaatacaaaaccttattctttccttgtcttttggattcatataaaaggtcatcagccacttttattagttgctttatatctttactctcttctggataaaaagccatcccaaagcttgctgtaacgctatcacttaaaccgtaacaattaaccttactattttctaattctttacgaataatttctattttattaaatacactctcagcatctttaatgtctgaaatatacattattaattcttctccaccatacctagcaagtaaatcattttcttctgtccacttttttagtatttttgcagtattcttaagaacctcatctccaaattgatgtccataagtatcatttacatttttaaaatcatcaatatctaccattactactgcaaatttcctatcttcattttcttttattgatttttctaagaaatctaaaaaatactttctgttgtaaattcccattaaagaatctgtttgagttaaattttctaattgtctatataaaaatgaattttctattattattgcaatttgatttgcaatagatttcaaaaatattttcaactctgttgtcataaaattaaacattttatgttctactaatatatacccaataaatttacttcttaatactattggtattcccattattgaatgtatgtcgactttagcactaccagtctgttttattatattttcatcattcattataaattcttcttctttgcttatactagcaatctctgtagatgtaagttttatattcatgctatctatattgcttgcttttatacttaattcaccattctctaaaatgaaaatagttgaatatgttactcctaaaattcctagtatcatatcatttatcatactgattaaattatcatcactaagatatgcattcatatatttacctatttcaacaatattagatagcgcatctatgtttttttctaattttatattcttattcactaactcctgcatatgcttttctgaaaattgctgatatgtttcatattcagatttcaaagaattataaagttgtttataattaatcacatttctcaaccacccttgaatcataaaattatgattatcaacctaaaataatataaactttatttatattaaaatataaatttaagcttaatcagctataaatcatacatgaaattctataatactctaattatatgatactgtattttttttactatatcaagttgtcaatttccatatttttattaaatcattcacattattggatatttaatacaattttcacttagaaatattaattatgttttttatataataacatagagtatacatgtgtttatctcctatgtataccctatattttaatactatttcaatgttattttatgatataatttatcaacataatcaaaattatctgcaagactataattttcttctacaaattttcttgcattcattcccattgtattccttaattctttatcttttataagcacatctatcttatctgttaaatcttcaacactagcttttttagcaacaaggcttgtaacacctggcttagtagattccataagtccaccaacatctgatacaactattggtgtcccacagctttcagcttcaactgctgcaactccaaaactttcactatctagtgttgatgggaaaactgccacatcaaaattttgaaactctttaacaacatcatctggatttacaaaacctaaaaatgtaacatcactgtctatattaagttctttacataaatttttaagataatcttcctgacttccttttcctccaattctaagttttaaattaacatcaggatttctatcttttagatttttaaatgctctaacaagatattgaattccgtatttttcttccaaagtttttatcgttccaataataacttcatctttttcaattcttcctggtacaaatctattgatatcaacaccaaatggtgtaacttcaatgtctttatctgtatatttctttgtttcatccttcattacattacttgttgagtaaatataatcagcttttttcaaattatacttaaccatcattttatgaataggagacttaatagggaaatcataaacatcacttccccatactgaaattatgtatggatgataatttgccaatgcacctaataacccataacttgttgcatagtgtgcgtgaagtatatctggttttatttcatttactaattcttttactctcttaatctttttaaaatactgtaatttatttttgtcagtggattttttcataactgtatcattaatatctaaagaatgtacagtaacgccttcatactcaccatttcccaaagatattacatgaatatcatatcctttacttttaaaataatttaaccatttatgagtatgagcactgtttatatcagccagataacaaattttcatatctagtcctccaaatcttttcttaatctatcaattaatatgaaattactaaagataattctaccataatctttatattttatctattaacatgtctatacagttgagagtcgataatataagttttatagtttaggtgaaaaatattaattttcttcaacttttattgtttaggtttcttgatttaataatacaattctttaacatttaaaattaatccacaaatttgacttcattataatttcctcatactgaaaatactagaccagttatataaaaaatataatttttttgtatgactagtctaaagaataaaaaactaaggctatttaatcttaaaacaattaaatagccttagtacatatttaaatacttttatttttctttatcttcataaatttcccatggtcttgcatcaagatattttataaaatcatctctaagctcttctttcttcaatgcaaactcaattgttgcctgtaagaatccaagcttatctcctacatcatatctttttccttcaaaattatatgcatacattgcttcctgacttataagagtcttcagtgcatcagtaagctgtatttctccacctttaccgggctttgtattttctaatatgttaaatatttctggagttattatatatcttcctagtatagctacattacttggtgcttcctcaatagatggcttctctactaaatcttttactttataaactttatcttcaatatgaataccatttacaattccatacttagaaacactttcttctggtactgtctgaactcctaatatagtagtattgtattcattatagcaatctataagttgttttaaacaaggtgtgttactatctacaacatcatcacctaaaagtactgcaaatggttcatcccctacaaatgtttttgcacaatgtatagcatgacctaatcctttaggttccttctgtcttatgtagtgtatatcaaccatatctgatatatctcttactaattcaagaagttctgatttcccagatttctctaattcaagctctaattctacagatttatcaaagtgatcttctatacattttttatttcttcctgttataataagtatttcttcaattccagacgcaattgcttcttcaattatatattgaattgttggcttgtcgactattggaagcatttcttttggttgcgcttttgtagctggtaagaatcgagttccaagtcccgcagctggtataattgccttttttactttcatatttaatcgtcctctcattaaagattttattaactctttgtactcatatgttatcacttttacatgtgtaaatcaatttaagttttaaacgttttaataataatatgaccatattattaactctatatcaatttaattatttattttacatactacatatatattatcgtaaaattttattatgaaactttattattttcattgattaatttatattatttaaacacatcctgaaaattattgttataaaattaaagaattgttttaatgaaagttatataaaagatacttccaactcctaatttactttctactgtaatatctccattgtgagctttaacaatagccttactaagacataagccgattcctatacttgttggatcaattgaattctctcctttatgaaatctattaaaaatttttttcaattgttctttctcaattccttctccattatctttaataattattactatatttataggtgtttcttcaagagtaatctcaatttcccctttttcacctgtatgctctatggcatttttaattatgttgcttatagcttccgatatccactttctatcatgataaaatataacttcatcttcattttcaaagattatcctttgatttttttcttctgcttttactcttaagggattaatactttcattaatagtattatttaaagaaatattatctttatgatattcaactacattactttcaagccttgcatatttaagcagtgtttttacaagccactccattctttgaagctgctcattactcaataaaataaaattttcaatttcttcatcagacatattcttataatcttttaaaatttcattatacatttgcaatgccattaaaggagtctttaactgatgagaaatatcatttattatattttttaaatttatcttttcattctgtaacaaagtaagattgtttttaattctttcttccatttcattaaatcttagctcaaacttacttaaactcccagtataatcgaccttaaggctattatcaaaaaatttattttcaactatattttcagctctatatgttaaatacttcaactttttataaagtggatttaagattactaatactccaaatataacgatcccaatagtaattagcgttaaaattattatcataacaaatacaaccttactcacatcattaatgaggggattattataatatttaagatcataattatatgagtatcctgaaagtatctcttcccctaatgaagcattttccactttattatttgtaattataggtattatatctttaactaactctggatttttactttctatggtaccgataattgaattattattgtttataatatttctatttatattattaatagaattaatatgaattagtgaaaaaaccatgccttccataattaaagctattataatgaatatccaaattttaattctctcatctctataacataatggtgacatcttaactcaccaccttaggtgcccatttatagccaactccccttatggttatgataaacttaggactttttatatcatcttctattttttctctaagtctttttatattaacacttaaagcattagcatcaataaaattaccctctatatcccatactttctctagcatcatatctctagttaatacatttggtgcattttccataagtaatagcataatcttatattcatttaatgtgagagaaatttcttcaccatcttttcgtactatatgagcaccgttatctaattctagattttcacttttaaaaacttcctttatattgtttatagcattattttttccttttcttcttaatacagcatttattcttgatacaagttctcttatttttaccggttttgatacatagtcatcgccccctaaatctaaacctataacaacattattttcttcatcacatgctgtcataaaaattattggaatgttattctgtgcttttcttatttcagaacacagctcatatccatcaccatcaggaagcattacatctagtaatattagatgtatgctatcatttagcatatttcttgcactttttaaattagttgcgtgatcaacttcaaacccctcttttttcaaactatatataactgctaaagccactgctctatcatcttcaactaataatattcttttcatatttcacctctagttattcctcatttcttatgagttcatttatttctagcttttttaacttgctataaggtataaagctgcttaataagttaattactaacaatataaatacaccaattactattaataaattagatatataataacttcttccaacactataactaaaaatcataccaattaccttaaatgatattaatgatagagctactcctatagtaccagaaataaaccattgcactattccctctaaaattattatttttcgtaaatctcctttttgtattcctatagctaaaagcgttccaaattccttttttcttaatataatgtttgtatatcgtgtattaattatgttaattgctcctataaatacaactaaaaacagcatagtataaattaatactgctaaagcatccatattatttttatatgaatctaaagtttccttttcctgtaaataataacctccatttctatttactatatctttaatttttgatatagctatttgtgtatcaatattttcctttaagtttatgcttgtatttatatacttatatgtactgattaagttattcattatatctttgttcttgtagtaaaattcatcactaactattatcgttaatcgattataatatccaaatctattaccactaattaatttatcactatcaatgctccctaaaatccttgcttctattgggaagttactattttcatttagatataattttacttcttgttctgacttttctttaaaaataggtttaggatgattgaaacctgtattaactattacaaacccactttcattaaaatcctttatatttatattcttatctgtaacagaattaatgtacggaataatttcattcaatgaagctttatcataaattaaaatactaccttcattaaacttaactgtattttcttctatattttcaattgatttgtttattacataatatttcgtaagttcaggattaattataatatctccaattgttattgtagaacccatactgatattcattaaaatatcatctgctacttttaaatcattaaactctcttttatagttatttcttttatctaaaacatcttctaataagtaattatttgaactttcaatatcataagttgaactaatgtcgtaagaatttcttagttcatattcatattgctttaaatttaataaataaaatcctgtaaaagaattaaatattattaatataattgtaagactagcagttataataaaaaaacttcttctatttgcacctatatttctatatgcaatttcacctttatatccaaaaagaaatcttataatttttgattttcttttatttatatatgtaattttcaaattatttactttacctactttaatattttttaaatccaaaccatttcttattaataaaattatccctataaccatgttaataattgaaaaaacaattgtaattaaaataacattatagtaaattttaaatcctactccataactataaacgcctattactttaataaataaaacatcaacaattaaccaagataaaatatttcctaataatataccaataattaatgaaattataaataaaataatccactcttttataagcagatatataatcttatttttagttgcacctatacatcttaatattgaaatttcgtttcttctatcttgtaagtatccacttaatgatccataaataaataatatagtaagtaaacatatagttaaatagataaaaaatatagttactttttcactattaatattacctattttattagatcctcttaccccataaacttctagcaacatattattatatttaatattctctttatagttccaagctttttcatcaatattacataaacctataatttcttttatatctcctataatactttttttatctttcattattatggcagcattaatttttttaattgtattactgctatttaaaaatgttactccagttaacgtatgacgaacagtatccttattatccttataaaaaccaacaattatatattcactatcatctatattcaatttatctcctatttttttatttaactgtgactttgcagataatgttaaaataatttcatttttgctattgggtaactttccttcaactatctctagcatagaatcaaatacttcatttatgaaaatatcatctcccgaatatatctttaggctccttttagtatctttaatagtgatatctatacttttttcaatattataaagtccacatttgtctaccttaacattattttttatcctttctattgaatcactactaaggtcttttaagattacttcataatttccttctagctgcttaactctttctatattaaactcatttatgaaattttttatctgtcctactgaaataagtaatagtatacttgtcattattcctattatagttaatatattttttttacgattcaccttaaattgcctatttattaaatcactatattttttcacctattacctcacctcatcaacaactattttcccatctttaatggcaataattctatctgccattttagcaatattgtcatcatgagttattaaaactaatgtttgattatatttttttattgaatatttcaacaaacttataatatctctagcatttttagaatctaaatttcctgttggctcatctgctaatatgattgaaggcctatttattaatgctcttccaattgctactctttgttgttgtcctccagataaatctgttattagagtatcccttttattttctaatcctaaaaattttattatttcattcttgtaatcttcatccactacaccatcgtctaacaatacaggcatctcaatattttcttctactgttaatattgaaattaaattataaaattgaaatacaaaacctattttccttaatctaattagtgatatttcatcatcacttaatccatttaagctaattccatctatataaacttcaccacatgtaggtttatctataccacctaaaatatgtaaaagagttgattttccagatcctgatgctccaacaattgcaataaattcacctctttctatctctaaattaatattttttaatgcattaactttattttcaccttttccataagttctatttattcctattgccttaataattttcattttaacacctcaaattacagtaatagtttaaaatcatatcatatatgtgcacaatattgattattttcttatagtctattataactttaataattaacgtatagatacttaattttatcccaaaaggactatagcattgctatagtccttttattaattcttaatatcctttttcttaaatgttacaaatgtaattataagcattattgctgaaataaccactaattgttttgcacctaatatataatttaattccataccattgctttttaataaatctgaaaaatatggtgtaaatttaaagtatgaaccatttatatacggtataatggtatttattaaccacgtctgtttaaatccaattaacattccacttaaaggacctgatccaaaatatagtagcattccaagagcaactgctaatgctgtatttcttgctaatgttgatatcataaataccaaacttgctataaataataaactacctgttgatactaataattgtggtatcatatacttaagataactagtttctactatacttccattgatagtttctagaactggtacttttaatgtttcaaatccaaaaactacacaactgcttatagttaatattgttacacctaatattacaatactaaatccaactattaaaatacttaacagcttagataataatattttccatctagcaactggtcttatcattaataatcttatagaaccattggcatattctgatgcaactattccaccaccaattattattaccataagaactgctaatattacatacacttcatatgtagagtctattacacttctcgcatctttaacagttcctaaatccggtatattattttccaatccataccaaagttcttttattttatgtactcttttttcgttagcatttttgtagcttttaacatattcatcataagaagtaactaagctatcattatttaaactaacactaaatgccttttcatcaagcatagctattcttaaatcttgaagttctgattctatagacttaatagaattatttttccagttattattattataatctattttattttcatatctaaattgaagtaatgataaatcctgttcaaattgggagatatccctctctgcaatttctttttcttttttaagttgctcaagtttagctttaccttcctcatccgttgggtttttagctactaatttttcatattcatccatatctttttgacgtaatgcaataaattctttttttcgttgaatttctaattctgtatgtctgttataatcaaaattattaataacatcttttaattcatttattttagctatatattcagcttctatttcttttttcttttctaatgttaaagtataataattttcaacctgtttaggatcttcactacttaaacattctaaaactacttctttagaatacccttcaagtacaaattctatagcggcaagcttatatagttgatactttagttgttcaatttcctgttccctccagtcaccaaaaggtattctattatcactaatcaattggttatattctttctctatagaataatactttctttgtattgctgctttttcacttttatcattttgtaaactatctatttgatattgtaaatcttcagccataaattgggatgattcaattctatttttcgaataatcatttggctgtatatttttcattactattggtaatataatagccgatataagtatcaacgctatcattatattaatacttacctttttaaactgcttcactaattcattatatgttaaacttaatactttcatataaccatccttcttatcttatttgatccttagatcctttagttacttccataaattcatcctcaagagattttcttattactgttatggtgaatagagcaatattattatcaatcaacaatttgtttatttctggtaatttagatttttcacaacatactttaattccataatcatcaacatctacagctaatttactataattctctttaattaaatttttagcttttttcttatcatcaacttctataagaaaaatatttatattttgcgattcattattttttatatctcctatggtctttatatcaatcatctttccaccatcaatgattccaaatctatcacacataagctccatttcgcttaaaagatggcttgataccatcactgataagccgtcttcttgtgctagttcccttaatgtttgcctaagttcttttatacccattggatctaaaccattagtaggttcatctaatattaatagctttggtttgtgtaataaggcttgtgcaactcctaatctttgcctcattccaagagaatatttactaactttatcatttattctgttacccagcttaacaagattaacaacttcatcaattcttttttttgatattccaccgtgcattctagcatacaactttaaattgtcatatccactaagatatccatacatttcaggattttcaattattccaccaacaccttgtagtgctttttcaaaattctttttaatactatttccatcaatatatatttcgcctttacttatactataaaggcctgttatcatctttattgttgtagtttttcctgccccatttggacccaaaaatccaaatatttctcctttattaactgtaaagctaatatcttcaacaagagcttttccgttcattattttacttacattttttaattctaaaactgtgctcattttttctcactctcctaatttttaacctttgtcatgtaatttcatcatcaatattattatcttttttattaattaaattgatatttacacttttatttttataataaatagatttatatttattaacaccaatcctttaactctttttaataggctacagtgattattatatttatatatgattacaaattaatttctcttttcttacaatttaataacaaagaataatagaattattctcttcttatattgcagttcttataataactatttcactcttgtattttaggttaaaaaaagaaagtgcgaacaaaatgatgttttcattttgtccacactttcttttctctataaaaatcttatgcgaaatatctatctaataatcctttgaatgctttaccatgtctagcttcatctctagccatttcatgaactgtatcatgtatagcatctaagttagctactttagctctcttagctaaatcagtcttaccagctgtagctccattttctgcttctactcttaattctaagttcttcttagttgagcttgtaacaacttctcctaataattcagcgaatttagctgcatgttctgcttcttcgaaagctgccttttcatagtacattcctacttctgggtaaccttctctatgagcaactctagccattgctaagtacattcctacttcacaacattctccttcaaagttagctcttaaatcagccattatatcttcagaagcaccttgtgctacaccaattacatgttcagatgcccatgtcatttctccactttgttccatgaacttttctggtcctactccacacactggacacttttctggtgctttttctccttcataaacatatccacacactgtacacacaaattttttcataataaaactcctcctacatttatctatatcattttttatatcaaatcttcttttacttttagtaatgtttttcttttgtttttatctcttctatgtttattattatataataataattatctattgtaaagagtttttttacaataaatgtttttatttttatatttatatgaaacatatgtaatttttagttttcttttcgttaatatatgaatatattttatcttaaatcttattttttattttatattgatttttttatttaatagaactataatattggaaaatagtaaaatatagggaggctttatttatggcagaagaaaataaaaaatgtaattgtaataatgaacctgaagttacttatcaaccagaaaagaaaattgatacttcaaaggaatgtgatccaaacagtcctgattacccttgggtatcatgtggaattgataaagataaaaagaaagaaaaataataatttattaaactcaaaaatattttagtaacatataatgaatgaactgtccagacatatatttaggatagttcattcatttattttttttgtgaaattcgaactactttaagcaaaatatcatcatcttttttatttcaattctaagataattattgttttaatttttattagcaaatatacaattttatgctaaatttttcattgttttttaaacaaaaacaaatgttttgtaagtttttgttgataaatccttaatgaaatgctaatataagttatacattaattaaattttaatttcttaatttatgaaattagaattgatttgaggagagtttgttatgaaaaagaatactaaagacgttttaataataggttttgctctatttgctatgttttttggtgctggtaatttaatattcccaccatttttagggcatgcagtagggtctcaatttcttatagctagtataggatttatttgtacaggtgtcggtcttccacttctagctataattgctgttacaaaaggtgatggaacatttgaaacaatggcatctaaaatcagtcctaaatttgctattttatttgctacattgttatttattgctataggtccaatgcttgcaatacctagaactgctgcaacaacttatgaattagctgttcagcctaatttacctggtataagccctcttgtttggatgtttatctattttgctataaatcttgtattcgtgttaagaaagtcagctatcatcgattcaataggtacttatttaacaccactactactattaattcttgcaataataataattaaaggtgttctgtttcctataggtgacgttatatctactggtgctactggtgtacttgctacatcacttactgaaggatatcaaactatggatgcactaggtggtttattatttgctacaatgatttcagcaagtataatcgctaaaggatactcaaaagaagaagttattccaatgacattaaagtcaggctttattgctactttaggtttagcatttgtttatggaggattaatgttccttggtgctcaaactacaagcactttcactggtgaactaacaaaatcaaatgtattattatttatttcaggaagtgttcttggtaatattggttcaataattataggattagcaatggctcttgcatgtttaagtacatcaataggattactttcagctggtgcttcattctttgaaaaactatctaaaggtaaattatcttataatttaaatgcaatagtaatatcattaatcagcatagttattggttcattaggagttgataagatcgtcactatctctggaccaatcttaaatgtattatatcctgttgctattacattaatctttacaacattatttgatcaatacataactaatattaaagcagtaagacttggagtttatacttcattagtgttcggtattttaagtataatcccaagtatagatttatcatttataccacttggaagtgctggatttgcatggttccttccaactgtagttgctataataatcggatatataatattccctaataaaaaagatcctattggttcttcagtcttagaatagaaaaaataaaagtttgctgttacaatcagttaataacagcaaacttttttaatttttatataattaattattagtaatttcaatatagataaaagccagtcaaaatgactggcttttatctatattatttctatttatttctaaattcaattcttccttggaattgttcttccatatctgttgttttaaattctgtaaatgggaattgtactggcattcctgtctttcttgacttatatgctgcaagtattattgacattgctttcttaccttcttcaccacttactaaaggttctctatcgttatttatagcatctattaggtccttaaataatggtgtatgaccttgaccataaacattgtctatcttaacattaacttctttcttaatagcttcttcatcatcaccatcaaatctccaagtttcaagttcattgttagcaagaccacctatagctactgctccattttgcccaaaaatgcttaaagtttcttctaagttctttggataaacacatgctgatccttcaactattccaattgcaccgtttttaaatcttataattatagcaccaaagtcttcagcctcaatatctctaaggaaagtatcacattctgcatatactctttcgatttctccacccatcatccattgaagtaaatctatattatgaatacattgattcattaatgtaccaccatctaatgcccaagtacctctccatggcgcttgatcgtagtatcccatatttctgttccaaaggattcttgcagtaccgtttactaacttaccaaactttccatcttccatagcatctcttaacttttgtactggcttattgaatctattttgatgacatacgcaaagcttaacattattttcttttgcaactttaatcatttcatttgcatcatcaatagacattgccattggtttttctattaacgcacttgcaccttttttcatagaataaattgcaatttctgcatgatatccactttctgttgcaattgtaacaacatctatgtcttccttatcaagcatttctttataatcagtgtatgcatgaacacaatctgcattacatccagacttttctatgtactcatctctctttgcttctgctttttctaaaactacatcacaagtagcaacaagttctgcttcttctctattatttactaaagcctcaacatgcttataagaaattcttccacaaccaattatggcaaactttaattttttcatatgctctctaccttcttctttaatattattagtgattaaatatatattgcagccgtaaacctacatatgatataaaaacttttttagtatagcttttaaaattaattgtccattatcaaatgtcaattgcaatatattctttataaaattatacacattttttaatcttaaaacaattttatccacaacttaatgtaatattctgttattaatcttaataattaactctaaaaataacatgatgtttttcccgaactgttaactttaaattattaactgctaactaaattaaatgcatttaaatatagtgctgaatattatatatatatctagaaatacattactttttcttatatattctaaatttaaagctaatttatcaggcattattgtattaatataaaattcatctggattttctgcctgaccaagaagctcattttcatctctataccttatagatgctaaatctgttattcctggctttacatctaaaacttttctttgttcttcattatacatgttaacgtatcttggcacttctggtcttggtccaacaaggctcatatcgcctttaaaaacgttaattaactgtggaagttcatcgatcttatattttcttaagaaagctccaattttagttattctgctatcatttccaacagtaatctgtcttccaagtttttctgcatcaactaccattgttctaaacttcaaaatttcaaattcttttcccttttcacccactcttatctgtttaaaaaatacagggccatctgatccactctttatccttatagcaacaaaaagtaaaaatggacttaaaactattagacctaaacctgaacaaacaatgtcaaatatccttttaataaatttatttaaagtattcatttctctactcctaattatttctttaaggcatttaagaacttatctgccaatccctcatacatatgattatctaatacatattttttaccatttccgcccattttaatcttttcttcttcacttagatttttaatcttcatcacagcttcaacaacagcctctggattttctgccggtacacttataccacagttactatccttaacagggtcatttgaagcttcaactgcatatattactggaagtgatgccatcatataatcaaaaagcttattaggacttactccatagttaaataaattctgtttctttaaacctatataacctatatctagaagttctaatacattatccatattatcctttaatacaggatctaagaattcaatatttgttacattattagctttagcatattccataagttcatttttaacattacccttaccaactaatacatacttaactttttcatcagttgttttcttggcagcatcaatcatagtatcaagaacatttgctggtgaatgatttcctgtgtatccaactaagaaatatccttgttcttttaattcctgtaatctttcaattgttttttccattggtgcttcatttttttcacctgtaagaattccatttggaacataaacaaacttatctgttgagaaacctctttctcttatatgtttatctgcatttggtaaaatcgaaacaattacatcagaattcttaaatgcaaaatcttctgctctttgaagtattactattgctggattcttttctgagaaccctccaatttccatagggcttaatggccacaagtcatgtatttcaaagcataattttgcattgcatctctttgcaattctatgtgctggataaatatctaatggatatgtagatgaagcaattactgcatctggcttatatttatctgcaagcatcttataattcgttctaagcttccacataaatgtagaaatattcttaattctacctacaccattaccttgatattgtggtgttttaacccatacatatgttattccatctataacttcttcctgaaagtctttttctattactggattattttttcttaagtgagaaaaattagctccaagtatagttacattgtgacctttgttcttccactctctagccatgtaaaatggtctaaactccataccgtggtagtctgaacctgcataatgattaataagtaagatattcattgaaaaattctcctttaataaaacaattggtttatcaattgtataaattgcctatttatagtattaatagtattcccattataaatacatattaacttgatttttaacttattaattatatcatagtcttttggcaaaatctatcttctgttattggatagttactgctttttagcatatttgaaattgagtaataaaatacaaaaaaagacaaaagttatttaaagtttaataacctttgtctttacttaaaattctataaattataaatatctaaatcttaaactttttaattgtctcattaagattttcaataagttcatctaatttacttgttgtttctgcaatttgctgcatagatgcactctgctcttcatttgctgctgttacttcttctgttgcagatgaattctcttctgtcactccagcaacttcctttatagaattagatgttgtatgtgccttttcttccattatgtttgaagcatgaaaaacttctaatacaacactttcaatttctttaaatgtcttttctatttcagtaaagttttcacttacagattttgtagtttcaactccatttgccacctctgctgcaccaaacttcatttgcttatcaataacctgtacttgttgttgaattcctcttataatattttcaatttttttagcagcttcatttgactgttttgcaagctctccaacttgacttgcaactactgcaaacccctttccttgttctcctgctcgtgcagcttctatagaagcatttaaagctaaaagattggtctgttctgctatttcacttataacattaactatttgtccaatttcattagatttctctaataaatttaatgtctgttctatactttcattatttattttttcaattgatttaatattttctactgcattttgtactctttcggtaccaatagtactcatcttaattgaatcattaacaatttcattcatatagttgcacttatcaacaacactcttaatttcatctacaagttcaccagtaatttccgaagctttatctgcattttcagcttgatttatagctccccttgagatttgttccatacttttagtaatttcttcacttccaaggagcgactgctttattgcttcatttacatcatcagctagtttattaacctcattagccgaagtacttatatcaactaccatatttctaagctcataagatgtattttttaaagtatcagctacttgtccaatctcatcacttctattaatatttaattcacaagttaaatttccttgtgctatttcacttgaaaaatcacataactttcgtaaaggctttgaaaacttattagccataaatataattattcctgctataataattattatgattactgaaaccatagcaagtgtagtaactaaacttctgccttctgcaaacaattccctttctgaaataacacttgcaacacgccaattagttaatggtattttcttatagaaagcaattgatttattatctcctacaccaaacttaaaatcaccggaatcactttttagcatttcttttcctaagttaaccatatcagaatcatctaactcagttatctttgacttcataataagtgattcatcaggatgtgttattattgttccatcgtctgaaataagtatgctatatccattttctccaaatttaaatccattaattttttcttgaatacgagaaatattaacagctgatatcatatctccgattatattatctgaatcatccttaactgctgcaccaattacaattaaagtttttccacttccctttgatattactggattggatatattatatgaacgtcctgtcattaaatccttataccattgtttttctgatacatcaccattaacagtttttccatttgcatactgagctcttgatattccatcattattaaaatttataacagctgcattgtcatattcccctggataatccttttccaaattcaatattctatttttattaaattcatccactgcttctatatttgaactaattaatttagcagtaggtgtatttgctgtacttcttacttctaataactttccatcaatccattcatttataatgtcagacatattatttacattttcagtcattctttttattgtactgttttcaatactctcattgaacttatatacagtataaaaactcaaaattcccatgcctattattactataggtaatatatcagataatagttttaatttaaatgaactcctctttaatttttccatctcaatttactccttatactttaactttgttaatatgtttataccattattatcttttttgtatcatttctacttattttttcaaatatatacatttttcattttattactattttaatcaataatattctccttaattattactattacccatattttatttatatttaaatcttatatttattaaattcaacaaattataaattttaattttatatagtaaaaatagatgtttagtactcgcaacattgtatgttagttattatatatgataaaataacattagaattatttcatatataattaaggaggaaatctctatgaaaattttaactgttataggtgcaagaccacagtttattaaagctgcaacagtatccaacaaaataagaagaaacggcaacactgaaatattagtacatacaggtcaacattacgacaacaatatgtctgacatcttctttgaagaattaggaattccaaagccagactataatttaagcattggttcatcaaatcacggtcatcagactggaagcatgcttatggctcttgaagatatatatttaaaagaaaaacctgatatggttttagtttacggagacacaaactccactcttgcaggttctctttgtgcaagtaaattgctaattcctgttgctcatgtagaagcaggtcttagaagttttaacaaagcaatgccagaagagcaaaacagaatattaacagatcatatttctgaacttctttttactcctacacttacagctgtaaataacttaaaagctgaaaatgtgacaaaaggagtacataatgtaggtgatgttatgtatgatgctgttaacttatttaaagaaagagcaaaagaagtttctactataactagagatttagatttagctccagaaagctacattctttctacaattcatcgtgctgaaaatacagatagcatcgaaagactaacatctattattaaagctttaagtgagtgtggaaagaaaataatccttcctcttcatccaagaactaagaagttcatctctgagtataacctacatgttggagataatattaaaattatagatccagtcggatatttagaaatgcttgcattacaagaaaactcagctaaaatcgtaactgatagcggtggagttcaaaaagaagcttacttcttaaataaaccttgtataactatgagagatgaaacagaatgggttgaaactgttaataatggttggaatgttattgttggaagtgactctaacaaaatcaaagatgcaattgaaaactttaatccaactggtactcctgcatctgcttttggtaacggagatacttcatctttaattacaaatataattgaagattacttaaaataaaaattaagagttatatgttaaaagtaaataacgtataactctttgtttgacctttagctaaaaaattaatcatattaaaaagagatttcaataattattttattatcgaaatctcttttctttatttaaatattcccttggaaataagaattacacaagtttatattctttcatatctgaagttcttctgtattcattatcgctgtttctataaacttgaatacaacttacagaaagtccaatcataatccagtaagagaatacatatgttatggaactaggtccaaagcttgcaggtgcaaatgcaattaatgctgctaccattgcaaaacacattgtgcttcttttcttgattgctaaaataaaattatatcctagtaagtataaatagtatattccaaatagtacaactccaggtattccgaaatcacctaaaatttcaattggataacagtgaggactatatatacttcctgtattaccttgatcctttatatattgttctacattaccaacaccaaaaccttggtatctcttttcacttattactccacctaatacatctttaattattgccattctatttaatgatgaatattcactagtctcctcaccttctatcatactatgaagagagttaagtttattggtaagtgttactgtattttcaactttttcaccttcaattggttttatattcatcatattaggtgcatataaaaatcctaataccaggccagccacaatagctatagggtaaatcatttgctttatcccaatattttttatattaatcactgaatataaaacaaatattacaactccaaataaaaatgctacatatccagttcttgaagtagttattattaccaatgcaaaagcaataacagaaactaaactaaaccatatttttgctattattgagttgaacttataaattgcaaataaacatattggcataagtattgccaattgtgcattaaggttatttgtattataagaaaatactattggtcttgcttgaattatatttatgtgtaattgtgaaagtgcatttaaaaatccatcaatgtagtgtcttacaggaagttgttttcctaaaagcacttctattaatcctattacaacaataagtgaaactaaatataataataatcttatagtcgtatttagtctttctttatttatgttataagccattaagcaacctataaatgcaaacatcattaaatatatagcaatatatttaattgataattttctatttatagcccagaaaacacttgcacacatatatacaaaccataccatatacaaacctaaaacttttttatcaagctttaggaacacttctttatttgtaaacaacttatacaatgacataagtgtaaatatgcctaaaataatatggaacatataaacagactgtattcctggtacatataaaacataatcatatattacagatactaaaagtgttgtataaagcacactatatatatctctatctcttgcaataaatactgctcctactaaagtagctatatacattgcacttataaggtaacttccattcattactcccataatacaagcaataataataactaatcctaaagctatatttctgtatttctcttctctagacataattactccttatctgcattttcagcagcaacttcatccacatttttataatgataagttggaactatcatctgcatcacatgtttaatttcatcaatatcatttaactctaacagtttacgtaactgttcaagcttaatagttaatttatccatatcttcgaaggttggttttcctacgtatattttattatgaactgtatcttgtaaaccttcttcactcattagtagttcttcataaagcttttctccaggtctaagtcctgaaaatacaatctttatatctttattaggttcaagtcctgaaagtcttattaaatcacatgctaaatcatatattttaactggtttacccatatcaagtacaaaaatttctccaccttttgcaaatgcaccagcttgaagtacaagttgagctgcttcaggtataagcataaagtatcttattatctttttgtgtgtaacagtaacaggaccaccatgggcaatttgtctcttaaataaaggtataactgacccgttacttccaagtacattaccaaatcttacagctacaaattctgtctttgactgtttatccattgcttgaacaatcatttcacataatctctttgttgcacccattatgtttgtaggattaacagccttatctgttgaaatcataacaaatcttgatacacctgctgcacttgcttcaagtgctaaattaagtgttccaaatacattattcttaacagcttctttaggactgtcctccatcaatggtacatgtttatgtgctgcagcatggaatacaacatcaatcttatactttgtgaaaacttcatgaagtctatcacgatctcttatagatcctattagaacagataaatccatatcaggaaagtcttctcttaattcattttgaatatcataaacgttattttcataaatatcaaacaatactaattttttaggctggaacatagaaatctgtctgcaaagttctgatccaatagatccaccagcgccagtaacaagtatagttcttccttttatataatcctctattcctttattatctaactgaataggatctcttcctaataaatcttctaaatcaacatctttaattctgcttactgtagcatctccactaagtatttcatacattcctggtattatctgtagcttacagttagtatttttacagatttcaataatttccgacttatttttagagtctatagatggaattgcaattacaattaaatcaatttcctgctctccaacaatatatggtatatcatatctattaccttcaatttttacaccagatattcttttaccaagcttacttttatcatcatcaataagaactataggattatatttaagttctcttcttgccatcatttcattaataatcatagtacctgctgaaccagcacctactatcattactcttctttgatctgcagaatacttaaatggtatatataacagagttcttctatataccctataaagaattctgtaaccaagtacgcagaaaatacttaaaagtatacctacaactgaaacatttaatggtattgttgaaccaaatattctagtatatcctattgataatatacctgctagaatatttcctccaacaccaagtagaaactcatcggttcctgttaaatgccacaagctttcatacattttgaatagataaaaacatacaagatatataaggcttaaagcaatcacatcatgggtataaatctttgaaatttctgtaaatctttctcccatgactatatttatagaaaataaatatgccatattcaccatgaatatatcaattatcataattattaaagttttccattttttcacttcagctttcctccaatctggaaagatttttgctcaaaagcaatttaaaccttttgaataattctatcttattttatttaaaatttttataaataatttaggacattttctcataccttcgcattgaataaaatatctaatattatttttatccattttctgaattttatatctctttaatgattcctttacctgtcctttatttaagaactcaaataagtcatcatggaactttggatcttttgataaaattgaaaatacatgtgatatagaatatggtattttatattccacaaggaacttatcaatttcttgtaaatctcccttatctcttatgtattccaataaatccacgtaagagtagtaacaatcaagatgctttaatgatacattttgagtcacactgttactccagataacataaaaggcaagaaccttattaacagaaattactttattagcttctaataaagttttaactataaatatcatgtcttctccatattttctctttgtatcaaagaaaatattattatccttaatgactgaagtcttgtatataccacttctcatacctatagtaatttcatctgcaagctgctttaatgctgcttctcttccagttataaaatcacttaaatatttagttctgctctcaattaatacatttccattagcatcaacttcgctataatcacaaaatacaacatcacaatttgttttatctgcttttttagtcattaattctataaattctggagctatgtaatcatcagaatctaaaaatgtaatatactctccaacagccttttttataccttcatttctcgcagtgcttactcctgaattcttttgtgttataattttataattaatatcagaaccttctaataattcttttgcaatatctatacttttgtcttttgatccatcatctataagtaaaaattcaaactccttgcaggtttgattcataacagacttaacacatttttcaatgcaagcttctacattataaacaggagtaattatagatacttttaccaaattattcactccttactcaatcattatttaatttaaacctttcaaacataaatcttattaattctagttatatatctttttaataaaattaatacatatatattttaatattaaatttgcatacacaatattaaaaattacaaagtaatttcaacattaattgtcaattaaattaaattaacttccaccatagaattatactaatattaacttgcatatgcaatatttatgaatacttcttaagcaaaacttcacaaagtggttttaaatacttttaagctttttaatttcctttgcatgccactgacgttcttcttcttttggaggtgtcatataatcaccatataactgtgtcaaaatagcatggtaattctttggtccataaaaataatttccttcaaattcaagctttgtgagttcaaaatagtcttcttttttataaacatactcactccatacagtatctaaaccatatcccatatatggagagttaacatcattccattttactaaaaagtcaaaaaatttctttcttcttttatcaggaaataatcctctgactatcttataaaaagtaaatgtaagtctatttttcaaacttaagttttctggcttttcacgaattcttataaaactctttaatatattgtaacttaaagctctctgaactttgtatacaaaattactttttggaagactatcgtaagggaatacatcaatatatacaccattatgcatttcactattttctgctattcccttttcaattaaaatagttccattatatcttattttacatggaacctgataaatatcgtatttatcatcagtctcaaatgtttgaagaaataagtgatctggtaattctttctttgcaatctcaagaaatttttcatagtcttctctaagcattccaatgtccatatcatcatcccatggtataaatcctttatgccttacagctccaataagtgttccagcatctaaaaagtattttaatccatgtttttcacaaatagcatgaacgtcttttaatatgtccaccattaacatctgagcatctcttaaacttaaatcctcgtaatcactttcattatgttgagttctatcattaaccattgttttatcctttcttataatgtagaaattattttttgttatataatatgttgcaataattattctgcatataatttcaaaaattctgtaaggattttcaccttaattgtcacttctcaactgtcaattgtcaattgcaatatatgttccaattttaaatttacaattaagaattattaactgttaatttaaatcagcttctttttccgtaataattttctatgatgctaggcttaagtaaaataactttactcaaaattaaatacttcaatctatctttttctaatttatacattttatatcttcttaaatcttttcttactgtctcatcattaataaattcatacatatcatcgcgtaattcttttttagttgcaaatcctataaatatatttactattgcagctggtattctacttgtaaccattgctttttctaaagctttatcattaaacttttcttttatatactgaagagtttcaacattagaataatagacatccttatagtttaaatttatattgttcattgccgattctccccattttacataatgggcgtaaatcttatttatacaatatactctttcagaagatgcatatgcttttaccataaatgagatatcttctgcaaattttctcttttcatcaaatcttatattattatttattagtagtgaacgtttaaataaatttgccattatgtgagtataagtagtcccatagattagcccaagagctgcttcttttccagacacttcaccataatttaaatccttcatattatttgttatttctttttcgttactttcttcaaagacatatgcacaatataaaacatcaaaatttccttccaatattttatcataaaatcctttaagcatattcttatctatataatcatcagaatccaagaacattatgtattcacctttagcttcttctattccaaggtttcttgctgaacttacaccaccatttttcttctttattattttataagcaacatctgaatccttaagataattatctgcaaaatcactactatcatctggtgacccatcatctacaaataatacttcaaagtctttaaatgtctgagcttttaaagattctagtgtccttattattctgtctctaactttatacacaggaactacgacactgatctcataattcataaatttttcctcactttcaccttatatattacatataaacagttttatcaactaatttattataccacaatatcatccgcttcaccgtatcttagtcaattgataactttttactcctaaaaaaggttataaaacttgcttttgggttcatttgcaggctacaattattttttgtataactggtctaaagaaaaaaggatacctgttatgatatccttctatactaataattgatccttattcatttaatgctattctaattgcatttatttctttttctgaaagtcctgttaaatcaataattgtttcattatcatcataaactatccttgcctttcagcttgtttagttagaattttttagtttttttctgatatacatttaaaattagatttatataaccaatttactgcttactctaaataacgctcctatatatctcatataatttatcccaagttagttttcccactataccatcttcaactagatcattccatctttgaaaatccattactgcttctcttgttccacttccaaatatcccgtccacatctacttctggtataaatggatattttgaatgtattgtatttaaccacacttgaatctgctgtacatcttctccacgttttccttttttaattaaataacctggatattttataaattttcctgaagcatctaagatgtgtggttcaatatttttataaacctcaagcagcttactccatgtcttttttcccacaattccatcattatcaaggttaaattcctgctgaaatgatttcactgaattttctgtatctgtatcaaactttccagttattttaacaggaagaatactatcataaaatgcacctatacatattaataaatattgaagtatctttacattagttccctgtgatcctaatttcagcacttctgttggtatttcgcttggaatctgtaatttctctccctctgattcaagttctgctaactttttaactccaacatatatttgagagattttataccaagttttcttaccaacaattccatctgcagtaaggttaaatattttttgaaattcttttactgcattttttgtagcatcattaaactctccattaacattatttatttgaggtattgctggatagttttttcttattctgtttaactgtgtttgaattacttttacctctgatccactatcccctaacttcagagcttttcctggatatgattctatatttccttgaatataatctgcatttctaaattcaatattataaccatagtatttttctaatatttcaaatgcagaataaccattattagcatatgttacagtaccccattgagataaacctgcacatgtaacagtagttccattacagtattgtgctaataaaggttctttaaattcatgcttactaatatattcattaaatatctcatctacaacttcactaatggtatcaaatatatttctaccgttaacaaaataatgatcatatgcagttgaattagtaatatcaaaatcataccctctacttctgtaccattcagtatatattctatttaaagtaaatgatatctgagcatatatattacttgctattgcttctttaggccatgttggataaatttcacttgatgcaacattctttagataatcagtatattttactgtaacattttgtgcatatgaagatggactacctaaatgaacagtaatatattctggaattacaacttctcttagtattttaggccctttaccttgtaattcaatatcatcttctaaaaatactttctctacttcttctttttcttcaatttgtgatttctcagacactaatgcattaggtggaatttcaataatctctattgcatttctccctcttaatttaggcgtcatttgcactttttgaattgatgtaactccactaaatataggaattccttttatatatttattttgaaaactattgctgactattaaagcatcatatactttatatggcttaatattagcatctggttcttctgaaaaatacttatcataagtatataaatttacaggctttgtttttccgttcttatcaggtttcgtaactttttcattaactatttgtgaattatctgtactcaatattataatctctgcatctgttactggtagcgcttcttctccaatatataggaagaactctaatttacctactccaatgaaatcaccctaattaattactaccatactaatatatcaattttgatatttttatgtgacatacaatataattaataatattttaattgcaaaatacatactttctaataaaatatctataatagttttttatttctatacatacaaatatctgcttcttgttgaattttctctaaagaagacttatctcccttaaccctagtacaatatccaaatgaagtacctaacctatattcactctctttattgtactcacttattaacttttctaaatattttagcttaatttcaatattttcataattatcttctaatgaaataactataaactcatcgccgcctattctcccaacgaattctttatttttaaacacttttaataaaatttctgaaaatacacaaagtgctttatctccaatgttatgtccatatgtatcattaatcagtttaaagccatttaaatcaaaacctataatcgtaatatttttattgtatttattttctaattttttcatcgttaacttataagaaaaatgattgtttaacttggttaatgaatctgtacatgccatcttatgattttcaataatggtataaattaatcttattatcaatagcattaacaatattccaaatattacaaccataatttgagaactaataaatttatttaaatttttcattacctctgactttggaaacagatatacaacataccaatcagcattttcaattggattaatactcgtataatatacattattgttcaatgtgacatttccaagtaatggtttatttatattagttacatatttcaaaaattcaatattattatcttcattaatcataccatcattgaatatattttttcttttatgtacatattccatattggtatgtgaaacatagtatccttctctatttattaaaaagcaatatccttcttttcctattgttttatcttcaaataacttattaatcttacttaaatctataacaccacataatgctccaatcttttcattttcttcatcatatatagatacacttaaagttgtaattgaacgattttcattaacttgtaaaaagggttcagaaagaaattcttcattaaatattatatccctataaaattcttcattaatttgattttttatttctcctgtatttgtatagtgtccttgtcctaatatatccattattatatagtgattaaaatccaaattcttagtctttgatatcaggaattcatactgttcttgccaatccattttgtaaatttcttcaaaccccgctatatattctagtattttaaaatttttatcaacatactcttctattaaaagcttagtgttttcagaaaattcctccaagttattttcaatatattcaacattatttttcaatgaactataataagatataaaagaaaatgtcaatgttgcacaaaaacatataactgttaataaaattataatcttatcaaaaatatttatttttatactagttccatatttcttaataagaaatttcatatcctacctactttcttctttagtattcttaaatgtcgttattttttaaactttcttaactattttacacaaacattatctttagatatatgcatattttcatctatataatttccaaattataattgtaaagctcatagcacaacatatatattattttaaatctttaaaaactttttatgttacatatgcgtctataaaatataaagcatccaataagatatatctaaatcaatgaaaaggaggtattggtaccaatgaacaaaagttgtttggaaaaccaaatagcagattatgttatccaatataaagaaaatatctactgcttggcctttagctatgtaaaaaatgctgatgatgctttagatattgttcaagaatccatatataaagccctatcatcaaaggattctctgaaaaatcctaattatataaaaacatggttttacaggattgtagtaaatgcttctttagattttttacgaaaaaaaagaaaaattgatgttgtagattcagaaattttttctagtttagaccatggagtaattgatgattatgaaaatgttgatctccaaaaagcattggataacctgccatcaaattaccgtacaataataattttacgatactttgaagatttaaaaatagatgaaattgcagaaattctcaatgaaaatattaatacaataaaaagccgtttatataagtcgcttaaaattttacgtataaaaatgaatgattctgaggaggtttattatgaaagataaaaacttacaacaattaaaaaagaactatatggatattcctattcctgtagaattagattttatagtcaaaaaatctttagaagacaatggagtaaaaatcaccaattctagagctaattttaaaggtataaaaatagcagctgcttcaattgctgctgcagtagccttatttactgttggagttaatagtagtccagtgtttgcaacatcattatcaaatgtaccagttgtaggtagtatagtaaaaatactaaccttcagagagtatactgtaaatgaagatagttacaacgcagatataaaagttccttctatacaaggtttagaaaataaagaccttgaaaacagtttaaatgataaatatcttactgaaaataaaaaactatatgaagagttcatggccgatatggaagatatgagaaataacggtgatggtcatttaggcgtaagtagtggttatgttgtaaagacagataatgataagttattatctatagggcgatatgttgtaaatactgttggttcttcttcaacaacaatgaaatatgataccatagataagcaaagtgaaatcttaattacgctaccaagtttatttaaaaatgatagttatgttaacatcataagtgaaaacataaaaaaacaaatgatagaacaaaataaagccgatgaaaataaattttattgggttgaaggaatagagaaagatgtggatatggatctattcgaaaagatttcaaaagatcaaaatttttatattaattcagaaggtaaacttgtaatttcatttgataaatatgaagttgctcctggatatatgggagtagttgaatttgtcataccaacagaaattttatcagatagcttagttagcaacgaatatataaaataaatatagttaattaaacaatacaattagaaatacttcacaattacatttaatgtttattaaacatattttaagaaacattaatatatattacagtacaaaaaggtgatgtcacactattttttagtgcaacatcacctttcctaatactatttaatattttcataaatcttaagttctatttgtactctcactatttctgattatagaattaaccaaactatccaacctagttagttcttttatatattgtattaaattttataatttttgctgctctccaaaaaattcataattaatgtattcttcacttacgccaagttctaaaagtgcattatttaatgctttcataaatggtggtggtccacagaaataaaattgtgaatttaaatccaggttatcttttatccaatcctttgttacaaatcctttaaaatcatagtcttttcctagtatttcatcttctttaggatcactaaagaagacatatcctttgtttttactcatttcgcataaagctttaatgtcatttttaaatggctgcatttttgaattttgaactgcttgaataaatgtaatattatttattttatctgcactatcataaaacattgataataatggtgttattcctattcctgctgatatgaatactgtaggtttatccttcttatgattttccaatgtaaaaattccataaggcatcattgcttctattgaatctcctatatttaaattatcatggagatagttacttattaggccattttgaactctctttacacttattctataaatatcttcattaggcttcattgataagctatatgttcttgttacatctctatatttctcgtcatcagtttttattgtaaaaggtaaaaattgtcctgctttatgctttataagtttacttccatcttttgctttaaagtagaatgatgtaatatcctcagtttcttttattttgtcaactaacattaactctttagttccactccatggctttccaacttcatttttaatagtatttcctgaatatttttccattatttcttcaatctttgatctttccataatatatccctccgcctcttcatttattatattttataccaataataattattattcaataattattattccttttttgatattaatttctatattatataattttacctaaaatatagaattattatacttacttactattataaattaaattgactgtatcaaattaggaagcctatttgatcaataggtttaatgttacatttatttataatttttttcatagtaatattatgcgcaaaaaagagaattcaaatttatgaattctcttttttcaacagctagtatcaaattatttttatacaacctcttttttatcgcctagtatcaaacttttttatatatccagtttttattaacattatgatttttacttttttttaataatttccttttcttattatcttcctaataatcttaacaatctcccaccatcctgtggatataaatcctaatactatagcaaatattaaaggataaattcctattttttctgttctaaagaaaccattaagaataggtatatacacaatggcaaaaaccataatcaatgccatgctgtttacaattaatcttaccttactacctttttcttttataagatgatatagtaattccgtatttgatctattaaccaaaaccaatgtaacattagctactataaaggttattaaggaaaaacttctggcatattctgatgatattcctaaatcaatcatataatgaaatggcataaatgctgctaaaaacataactactccctgaagcactacttttattgttaaatttcttgtaagtaatggctcttgtggagatcttggaggattttccattatatttgcttctgctggctctccttcaaatacaatagagcatgttggatcaataataagttctaacaacataatatgcattggcaaaagtaacggtggcaaattgaacaatggtgcaaacattgccattgcagctattggaatatgaattattaaaatatataccatagcttttcttatattatcatatactcttcttccatccttaactgactttacaatggttgtgaaattatcatccattaaaatcatatgagctgcttctttagcaacttctgttcctctttgtcccattgcaattcctatatcagcactttttaatgctggtgcatcattaacgccatctccagtcattgcaactatttctccatttttcttaagagctttaacaatcttcatcttctgctctggtataactcttgaaaatacatcacaactctttacaacttcacataattcattttcacttaatgaatctatctcattaccaacgataactttatcagtaaattttaatcctatttcttcacctattgccatggcagttttggaataatcaccagttatcattacaactcttattccagcttttttgcaaagctttattgcttcttccaccccttctttaggtggatcttgtaatccaaccaatgctttaaaagttaactcataacattctaaatcctcataaactttttcactagtacaatccgctaaagctaaaactctcaatccatttgatgccatcttatctatttcaatatttatttcatccatggtttctttatctaaattacaaagtcctaatacggtttctgccgatcccttaactgcaacataatacttattatcttttatatatatgttagccattctctttgtttttgaatcaaaagctatttttttagataaatcatatttatatagagtttccaattgagataaattagcagcttctaatattgctttctccattggatcatatggatctttctcacaagataacaccattaaatcacttaattcttgattttttaaatcttcattattgaaaattctcccatcactatatatactcttaactttcattttattttgagttattgtcccagttttatcaacgcataatacagttgcagaccccaaagtttcaacagctgatatctttctcatcaaagtattattttttgccaacctgtaagctcccatagataaaaatactgttaatacaactggaaattcttctggaattatagccattgctaaacttattcctgaaagtatactgtttaatatattaaaactgtaaaaataagatgctaccattacactaatacacaatataactccagctatagctatatttttaactaatatactcacctttttttgaagtggtgtaggctcatcttttgcttcactaatagcttttcctatttttccatactcagtattaattcctgtaaattttactattgctgtgcattttccaaacacacataaagtgcctgcatataatatatcttttttccaataatcagtgcttttttcactttgagtagttgaaactttcattacatattcactttcaccagttaatatagattcatctactgaaaaatttgaaggctctaaaacaatacaatcagctggtattctctccccctcggaaagaaatactacatctccaggaacaagctctgtactttttattaatatattttttccatcccttaatgtattaacctttggtgatgtcaaatcttttaatgcattcattgttttttctgttttccattcctgtataaaagtgattgaggctacaaaacctacaaatactaacattattgcaccatctttaggagctcctaataaaaaatataccgtggctgcaattaataaaagtaaaaacataggttctttgaatacacccagaaatttctttaacatatttggtttctcttgaattattaattcattcattccatattttctctgaagtttttcaacttcttcactatttaaaccgcctaaattataacccataaatttcctccaattatcatttgataatattatatgcgttttatatcctatttgtccatagtttttctacattattaattatcaattgataatgaggttcatgagtataaaaaagactttattccaaattgtatataaaaaactttaaactctataatttatttcttaacaatattctccttaagcatatcccactgactacttgaaatatgttataattctaaatataaccaaaaggaggattcaacctgtgaataaaaaaagaatattattaaaattatcatctttacttttatttacttctgtatttctatcaccattaaatgcatgtgctgaaaccttttactcaaagccttatgaaaaaatgaagcttgtttggagcgatgaatttgatgaaagtgaaataaacaaagacaactggacttatgatataggaaaaggtaataacggaagtaacaatggctggggaaataatgaacttcaatactatactgatagaagcgataattctagaattgaagatggaaatcttgtcattgaagcacataaagaaaattataatggatcagattacacttcagcccgtttaaaatcaaaagaacttaaagaatttacatatggcagaattgaagcacgcataaagcttccattagaccaaggattatggcctgcattctggatgcttggaagcagttttactggagatgacaaatggccttactgtggtgaaattgatattatggaacatgtaaataaagagcctgtagtatctggtgctcttcactgggataataacggacctcaaacttttgggcaaagcgttactgttgataatctagatgattatcatgtttatgctcttgaatggacaaaaaattatattaaatggtatgtggatgatcaattattctgtgctgctgacatatcagatataatcatacctaatcttgaaagaaatataaaaaataatgatgcattccatcaaccatttttcatattacttaacatggctgttggaggaaactggccaaaagatcctgatgattctactgattttccggctaaaatgtatgtagattatgtaagagtttatgaattaagttaacagttagctgtttatagggaaaaccgaaggctttctttaatttttttatacttctcggattttttattcccaccctcttatatatctataaattatgcctataaccttttttaaattaaatgttgttgatatatataagttataatttaaaatatataatcaataacatctataacaacatttaattataattaagtaaattagaataaaaaatagctgcaccatgcttacagcttataatttataattgatagttttaaatttataatttaaaccataaaaaaaatcatgttctataaaatgtacgttatagaacatgattttttattttaactttggtttttaattatggctttttcaaatatatcaaatgcaaactctaattcttccttacttaatacaagtggtggatgccacgtaatacaatttcctgatgatactttaaaagataaaccttcttccaaagatgagtataatattctttctgataaatcagtatctttttctttagttattctatctttgacaaactcaaaggatataagaagtccctgtattctgaaatcacctatacagttatacttattcatcaattcttttcctctatacattgcaaactgagataagtctctgcaattctccataaggttatttccatcaatatattctattgccgcacatattgctgcacatccaattgcaggcttttcatgggtataatgtcctaaagatatgtcttctgcaacatcatatcttttatttactaagacagctgcctgtggtacaattcctccacccaatccttttcctaacactaatatatctggctcaattccaaaattctgatgtacataaaattctccgcttcttccaagacaagttggaatttcatcaaaaatgagaagtattttattttcatcacatattttccttagtcttttgaaatattctttaggcggaacatgtgtatctgttgctcttattggttcaagaagtattgctccaatttcaccttcattttctattatatattccaaataatctaaacagaaatctgaaacttttatattatcatcactatttattaaatttctatatccattgtaaggtattgattttatagcccctggcattaatggtccaatatcttttttaaatacatattcgccacctactgatattgtatcaagacctgccccatgaaatgattcccacatagatataaccttatgccttccagttacctttcttgctactttaagagcaagtcctactgctgcacttccagatggagtaaataaaactttaaaattctttgatgttgtcttatttatcaatgcatctgctgccttgactgctatatctgatgtatatcttcttggtataaaaggaagttcatcaagctgattctttattttttctataacatatttatttttatgacctacttgatgaacactatttccatgaaaatcaagatatctttttcctcttgtatcgataatataacatccttctacatctgaaacagcattcatacaaggcgtagacatagactgtcttaaaaataccctttcatcttgtcctataatatcaactgtattttcatctaaattgtcattccatagttttctattatgagtgaaatttgcatcaccttccctaagcaagcttttcattgattgcatatggtctttttccttctttaataacttcattaattttttctataagctctggaagttcttttattgtatttatagtgaaatgagctcctgcttccataaatccagcctttgttttctctattaaattatctttttcagtttgtgataatttattatattcatcctcacttagtcccatatttgaacttccaacaataacaccaacactccatactcctgctgcaagaccttcttttatatctgaattagtatcaccaacttttactactgttgaagtatcaactaattttaatgcttccatatttctataaatcatatatggatatggtcttccatttgaatttgttgaatctggtgtcacatagaaatctggagcatagcctttttcttttgcaccttttgttacaacatccatcatagaatctgtgtatcctgttgttgatccaatctttaagcctttatttcttaaattttcaattgtttcaataacgccttcaattggagttgtatagtttgaaagagacttcattaacattggctcaaacttagcatataaattatcaatatcttcttcattatgtaatcttccgtacttttctttccataagtctgatattctgttcatttccatcattgtttttatatgatctcttttaagcattcccattggaattcttgcttcttccattgttacatctattccagcttgtttaaatatttctataaaaacattcactggcgcaaaacacccaaaatctacagctgttccagcccagtcaaaaattattccttcaatctttttcatgattatttcatcccctttacgtactcttctattatttcacaaagtttatttatatcttcttcatatatttcaccaatattaccaattctgaatgtatcaatatctgtaagctttcctggataaataacaaatcctctttcttttatgaagctatagaattcattgaagctgaaagcatctgttggaaaagcaaatgtagttattattggtgattgtttttcctcttcaatataagattcaattcctatttccttaagtttttttcttaaaaccaagttattatttttgtaacgattatatcttccttcaactccgccttcttctttaagttcatctaaagcttttgagaatgctgcaactacatgagttggtgatgtgaatctccacttaccatccttgtccattcctttatattgatcatataaatctaaagataaacttcttgaaattcctttgcatttttctaatttttctttctttgcaataacaaatccaaagccaggaactccttgtatacacttatttgcactacttattaaataatctattcctaatgcttttatatctattggaattcctccaaaactactcattgcatctattattaatgttttattatattcttttgcaattactgataaatcttctattggatttaatatacctgttgttgtttcacaatgaaccattgctatatgagttatttccgtatctttatctaatatttctttaactttatccatatttggatgttcatcatatccattattatatataacatgatttaatgatatatgttctgctatttgtccaattctttcaccatatgctccatttgcaattattaataacttatccttttctcccactgtgcttgtaataacagattctactgcaaaggttccgcttccttgcattaatacagccgtataatcttcttcatgaacatttcctatatctaataattcttttcttattttttgagttatagatttatattcatcatcccatgtacatctatcgaataacatttctttttttactgcttctgttgtagttaatggtcctggtgttaaaagtttataatttttcattgcatatcactccatctttttatttatatatttattttctcaattacttagcattattaaaaaattgttgatgctgttctaataaatcaacacttaacttttcttcaaattgtttagaatatttgggtttatttttttcacttacagtttcaccttcatataatgcaactggataatatttaattaactcttctcttgaatctttaactataacttctgcaatttccatagcaagtttacgttttttctcatcttttttattaacaactgctatagattctgttaaagtgaaatttccttctgttggatctatactttctataggctttccttctgcactatctgctactgcttgatgacgtaatccaaatccaactgctacttctcctgctcttacttttttaattggacctgaacctgaactttcaatgtgaggacctgcattggcaactaaatccttagtgatttttgtaccttcttcttctccatattctgaaattatagcttgcactagaagccatgctgtagatgaatcatttatattaggaattgaaactaaatctttaaattctggttttgttaaatcctttatagattctggcatgctaagatttttttcttctattactattggatttacaaataatgaaccggtatttcctaaaataggtgcactatattttgtactctcacttaaaggttttgtatcaaatgttaaatcagtaaacatgttatttttttcttgagcactttcaataaaatatgaactcatcgttacaatatcagcttcaattttatctccttctgcaattagctttccgcctaactctgatgtaccaaatgattgaagaacatatttatcttcatatcccttttcatttaatgtattctgcattatttctatagcctcttcatcagcatttgtgtatattacaaccttatccgatgattttgccccacatcctaacattccaatagataatgttaatgccatagttccagccgttattaattttagtattttccccatttcaaacttctctcccttgtttttctttttattttttaaaactttattacttatctttttattgctagttttatttttatccaatagtttcttattaagataatcacatattaatctcacaaacagattagttaaaaatatcaatattgataaaacaaatatttctttgaacttagcataatgctgtagttctttaattttagttgtcataacagctgtagctgttccaacaaggaaaattattgcacttattgttaccattgaatttataaataaataactgaacatttctattattgtagaaaatgaatttggtattacaactctaactaatgtcttaaaccatgaatctcctaaaagttcacctgttgtctcccatgatggattcattttagaaagagaattcttagccataagatatggtgttgtaaagaaatgaaccatgttacaaattattattattaaaaatgtaccttttaaatcagtcttattaaatagcattaaataagctaaacctaaaaccatacctggtactgtatttgtaatcatagaaaaacaatctaagctttttctgaattttctatgaaggcttgtacgtgtatttattaatgctccaagataagttaccattgtaccgaatatcccacataaaactgctacgaatattgagtttttataaacagtaagtatattatttgaagttacagtatttttaaagtactctaatgtaaagctcatattgtaaggaaaatcaaccatgaatggtgttatgaacattacaataaatattgaaaaaatccatattattattaaactccctatagatcctaacactacatctctaaatttattttttccaagctctatatctgttactttgtcataatgaaaattgaatctttcaagataattgagtaataaaactcctaaaattgctggcataagcattaaaatagctataactgccccaccattaaaattaggaattgctccaagcataacctgatacaaatgagttgaaacaacattatatgtaccacctactgctgctggtataccgaagtctgtaaatgataatatgaaagctgatacaaatgctccacctatactacccataagtgggcgtagtattgtatttataagctgttttgctctattatcacccataagattagatactatgataaatttcttatcaatatatttaaaagaattgtttataagtaaaaatgatgatggaagagtataaataacataacctattaacaaaccattaaacccatatatgttcaaaagttctcttccaaaaatctttgttaataatccctgtttaccaaatgaatatattattgcaaatccataagttattgttggtagaagcattggaagtataactccaagtcttatacacttttttataggagcaaaaattcttgtgcagttcaaaacatatgaaagtataaaacttattattgttgttataactgctgcacataaagatacaattgtactattttttactgcccttaaaagctctggattgcttattgtttctttataattttcaaatccaattccaccatctacctgaattgacttaaagaaaagtattcctaatggcagtactaaaaatcctataaagaaaagtgttattattgtaaatattgtttttacttctatctttgttctattcatgctaagcactctccaaacaaattatatatattgttcttttttatatgtagttgctttaatataaactcttctacaaactcacagcttggactacttataacctcattaggtgttccaaattgagctatcttaccgtcatttattattaataccttgtcagacaaagttaatgcttcttctggatcgtgtgtaacaactatagttgtaagtttaaactgctttactatggatttaattttatcttttattgattcttttataactccatctaaagcacttaaaggttcatctaaaagcaatacctttggtttagttacaagagttcttgcaagagcaactctctgtttttgtcctcctgataattggcttatatttttttctaaatgctgctgtaatcctaaaatagaaattatttcatcaacttcttcctttgttgatattcccttattattctttaatccatagattatattttcataagcatttaaattaggaaataatgcataatcctgaaatactatattaaatccacgttttttcatatgtacattagtgatatcatcaccgttaaaaattaagtttccttcatccatattcgtaagacctaagattatatttaataatgttgtttttccacttccactttgacctaataatgaaactatttctccattttcaatattaagactgatgttatctaaaactgtcttgtcattaaattttttggttatattttttaattctagcacttaagccacctccaaaccttacaagaataaatatatcaactctttgtaaagtttgtattatacaattgttaattgcaggtaaaacatgacaatgtttttgcatactctttaataacttttgacaatgttttttatatatgtgataatatttttattgtattattacattcttttttaaatagtctaaattattcctatttaatagctaaataggatatataatattattatcaacttatgtgaggtgttagatatgtatcctatagaacgtcagcttgaaatctttgaattagcaaaagttaatgatgttttaaaattaaaagatcttacagataaattcaatatttccattgaaacattaagacgtgatttatctgtattagaaaagcaagggaaaatccaaaaaatttatggtggaataaaattagctgaaacttattctggtgagccacttatgcaaaacagaatggaaaataagcttgaaataaaagaaattatcggaaagaaatgcagcgaatttgtaattgaaggtgactgtatatttttagatagcggctcaactacatatcatattgcaaaaaatataaaaaacataaaaaatcttatagttataacaaattcaattcctattgtaaatgaacttataaatagtgacgtagaagttataattataggtggaaagcttagacataatgaaagttcaattgtagcttatgactatctttttaactttaaaactttaaatatttcaaaaagcttcatatgtgcaggaggtattactttagataaaggtatttctgactacaatatggatgaagcaattacacgaaaaaaaattcttgaaatatcaaatgaaatctttgtagccgctgatagctcaaagttaggacgtgatgtacctattaatatatgtggaatcgataaagttaactatgtaattacagattcatctttagattcttctattgaaacatcatttgaagattccccttgtgaacttattattgcagataaatagtaatatgcaaaaagacaactgaaataaaaattcagttgtcttttattaattaatctatttatctacggtgactccccccacaccatccataaaccatttctgagcaatcaagaataatataagtagtggtaatactgtaattgtacttgcagccattatttctggccactttgttccatatgcaccatcttgaataaaaaactgtcttattccagctgaaatcaaaaatttctctggactttttgttattaatgatggatacatatattcattataataagtaacaaaacttattaatccaaaagttataaaggttggcttagttaatggaaacattatcttccacaaaatttttatatgagatgcaccatcaactcttgcagcttctataaaacttttatccacctgcataaacgcctgtctaataagaaatattccaagtacatttacaagattacttattgtaagtcctgtaagcgtatctagtaaattaagttttccaagaataatgtaacatggaacataagttactgctgatggaagcatatatgtacacattactattccaaataatacttttcttcctacaaatttaaattgtgttaaagcataagcaatcattgctgcacttattatttgaaatattacttcaattgttgcaacagaaagactgttaaacatataagttgcaaatggagcttctttaaaaacatcactaaatatatgccaatttggatttgctggtattatattaggaggaaatgtgaatatttcctgtcttgatttcaatgcgcttgtaaccatccatataaaaggaaagaatgtagctatgcttataaatattaataatatgtgtcttgaaaatgtgccaattctttcttttaatgtctttttaggaatataaattttgttatctgtatctaataattctgatatattcaattcctcaatattattgttaatatctatgttcataaacatccttctcctttttatatttaataatgaacccatttctttgatgcaataaattgaattccagcaaggcatcctatgataagtaatataataactgctatagctgttgcttcacctatattaaaattttcaaatgcagtctgataatataaataaagtatagttcttgtacttccagatggccctccctgagtaagaacctgaatctgatcatatgcttgtatagaattaattgttgtaattatagttaagaaaaaagtagtaggtgatattaaaggtaatgttattttcttaaacttctgccatgaacctgcgccatcaactgctgccgcttcatataattcctttggaaccctttctaatgcagtaagataaaatatcattgcccatccaaaacccttccagacagtcactaaaattacagctgtcattgctgtatctgaactttgaagccattgacttttaggcatattaagcaattgtaaaatataatttgcaagtccatattgtggctcaaatatccagctccatactattgaaatgacaactgtaggagtaacccatggagaaaaaattatagctttgtatattgctgatccagttattttctttcttaatataactgctgctaaaagtcccaatgctatagtaggtactagtgttcccaatgtaaatactaaagtatttttaagtgcatcataaaacatgctatctgaaaatatatttctataattttcaaaacctacaatgttatatgctgaactcatgtaatcccagtctgtaaagctcataaatattgcttcacccattggaaacagccagaatactccaagtggaattagtgctggtaatataaacattaaaactctcattaaatttttaatttttcttttattaattgtttttcttatatctataatcaccactactactcctcttttaattaatataaatcagctaacatctatacttaaaatttcaaattaaattccacaggaatttccccactaaacttttaactataatgtttaactgctaattgtattgccaattatttctttactgaatcaagtgccttttgtgctgtcttttgtgcttcatctaaagcttctttagctggaacattttctatttctactttatcagctgcaatcttaagagcatcacttatctttccacctgtaggatcaataaacgcttgtgatgcatgtgctgcctgtaatgttggaactaatgcatatggcttatcacttacatattctttaaatgctggatcattaggactttctttattaactgctatataaccagatgctattgaccactctgcattaacttttggacttgtgaaatattttataaattcataagcaccttgcttttcttcatcacttacattcttaggtattactaaaaatcttgcttctgcaacaggttttgattctttaccttctttaaatgctggttgttcatatgctgataatatattaaaatctaaatctccctgatctcccgctgagcctgtatagcctgctgttttttgttccatagcatcagcaactgtatcattccaatactgccatccttgtccaccagagtgaattctcataattttatcttcatgtatccattttctaaaactatcccaagcttcaacccattcatcactattaatcattacttttgttttatcatcacttaaaacttgcccaccattacttaacgcggcatcaactaagttgtctggtcctttcattggttcccatccataaaatgaaacttcgtcaccatcttttttaacaagctttgaagctgcatcagctagtccactccaagtctttaatgaatcttcacttattcctgcatctttaaatgctttagtattataatataaaagctgagttgtcccgtatattgggaaggcatattgtttaccatcctgctttcctggctctataaaagcacttaagtaattatctccattatattcagaatccttacttgcaatttcatttatatctgttagcaaatcctttgatcccaatgtatattgcttatctggttctaaaagtgcaagggctggtgttttcttagctgatattgcagcttgaagattcttatatgttgtatcataatcatcttgggctataggcttaacttcatatttatcttgtgaactattaaagtcacgtactattttctgcatattctcgtcaagctttcctccaagtccataccaatattcaatttgaatttttccatcagaagtttttgttgcttctgccactttgttttctgtttttgtgccacatgccatcatacttcctgtcattacagatattaaacctgcgacacaaatttttttaataaacttgttcattgttatccccctttaaatatcctataagttaaaacatttattgcaatttactaaatgcaaataatatatactgcactatgaactttagaattataatctagaaatcatatagtgatttcaacattcaaatttgtcaagtgtcaattgcaacataatattttaaatactaattttctaatcctaaaatcaactactttacagttcattttttgaacatctttataataacagcgttcatcgttcaacacaatatgttcaagtaaatttttccaaaaataatatatgtatacacaaaaaaagtccagatatctatataataaatatctggacttccttcattaaaagttgtggtttaaatatatttttaatttgttaataaaagggcttattaaagtatgtgcttattaagcttgaactccagcatctgcatgtgcatttttagctgcaatttcatctgcataagccatagcatcgattttcttgaagaatggtaagtaaatcaatcctccaagtgctattacaacaaattgcattactgcatatttccatccaccaattattaaacctgaaagaactggtggtactgtccatggtggtagttgtccacccattggaggaagaatctcagttgcaattgcaaagtacaacaatagtgcatttactactggtactataataaatggtacacccatgattgggtttaacactattggagtaccaaataatattggttcatttatattgaataaatttggtgtgattgcaagtcttcctaactgcttgtattgagctgatttagctaagaataacattgccattgttaatccaagtgtttgaccactaccagctaagtttatgaaattatcataaaattgttgagtaacaatatgagcaccatgagcaagatcaagagttcctgctgcctgtaaaagtgcattatcagctgtattaggagttaataagcttcctaccataccaccaacagttacaccaccatggattccgaagaaccataaaaatggaacgaaaaatgctataataactgcaccaaatggtgagtctgaagccatttgcaatggttgttgaacaattttataaattacttcaacaagtgaagagttaaatccaaatttaaatactgcataaacaatatctgctactataaagattacagctgctggaattaaagctgagaatccatttacaacaccttctggaacaccttctggcatttttattctcatatctttcttaatcattaatgaataagcccatgcaacgactaaacttactaatatagcggtaatcatacctttaccacccatccagtctcttggaattacagaacctactttaaaagcttctgttgctccttctggtgtaaattctacccagtcattagttataattaagaatgtacttaatgacaatactgctgatgagaaaggctcaaccccttcatttttagcataaacatatgccatacccataacagctactaatgccattatactcattgtaccattttgaaccttgtataatggatcattccaatttggtccaaatgtgcttgcacaaaaatcagtaaatgattttaatggaaatgctgctactagtagaaacatagatccaataatatttaatggtagagtatataacataccatcttttaatgcctgaacaccttttaaattaacgaatttcattactacaggaactactttttcgtttaaggtttgatttagtgacataatatttcccccttataaatttaataatatgaataattacaaataaaaatttgctattattgctctaaatattaatatgcttttcagttatgactttcttaattcccctcaaatgagcttcaatgaacttaattcttggtatgtccaaaacttcattatcaactattaaatccacatcaccaagaccgttttcagtaattaagataatcctacttagatatcttaggactattaaataatcctaagatatctttaaataatcaaaatagtttatttaactaatcctaatgctaaatctaaaaccttagcaccattcatcattccataatcaaccattggtataacttctactggaattccttttggaccgcaaagagcttttgcatttgctaatctgtatccaacttgtggtccaagtaatgcaacatccattgattctaaatgtttatccatttgagattctggaaatgctgcaatttcagcttctacgcctttagcttttgctgcatccttcattttatttactaaaacacttgtagacattcctgatgcacagaataatttgattgtaatcatgataaattcccccttaaattaactttttattttatatttatttaattatattttttgaatataagtatttaactagaatcttactattaactatttaattaaagtatttactacttttcttaattcaataatttgttctattaagttcttttctgaaatagctgtcattaaatgatcctgagcatgtacaaataagattgaaaaatcaactttttctccacctgcttctttttgtaacatttcagtttgtgcatcatgagcttttgctaaagcatcatttgctaactgcatttcttgttcagcttcttcatattctccttcatttactttgtttaacgccatgtaagcgtggtttttacaatcaccagcattgattattatgttcattatctgcatttctaattgttccatttattgttccccaccttctgttttatttcttacaccaatatataaagcaattcgtataccaaacactaaacaaaaaaatataattattagtatttacacttataaacactagcttaaattactatctacctaagttttcatttcttgatttttttttatatttttctattttttatgtgttaaaaacagtgtttgataatatttttttagtgttttaatctttttattcactgttttatatatacatttattatataaacactatttaatcccatatttgaccatagccatatatttatgatatcattttcatgtaaagaacatatcatttacttattaaaagcaagtgatattagtgtttacagcttacttgatataaaaaaacttatttttactttacatactttaaacactaattttttaaatatttcataaatattatgaaattaatccaaaacttgtaccagatatatacccattttctggtcaatataaattaggaggataattaatgactaaaaaagagttaattttacaaaaactaagacagttaaactgttctgaaggaatagatactaaaacattatcttcattagtaaatatgtccagagctaatttaagccatgaattaaatgaattatgtaaagaaggaaaattaaataaatcaactggaagaccagttttattttatctagctgactgcaagaaaaaagaagtaaaatctcagcttgatttattagctgaaaataatatctcattaaaaagttctatcgaacaagctaaagcagcgattttatatcctccaaaaggaatgaactgtttaattttaggaagtaccggtgttggtaaatccatgtttgcttcattaatgcataattacgccttaacaatgaatgtaaaaagtgaagattctccttttatagtttttaactgtgctgattatagtaataatcctcaattactgacttctcaattatttggtgtaaaaaaaggtgcttatacaggagctgaatgtgataaaactggattaatcgaacaagctgatggcggaattttatttctagatgaagtacatagacttcctccagaaggtcaggaagctctttttgtattccttgatacaggtacttttagacgtgtaggtgactctgaatcaagaaaatctgatgttttaataatttcagcaactactgaaaatcctgactctgcacttcttaacacttttagaagaagaatacctattgttataactattccttcattgaaagaaagaactcttgaggaacgactatatcttataaaaagcttctttaaatatgaaagtataagattaagtaaagatatatatgtttctttaaactcactcagagcactcttatcatatgactgtccaaacaatataggacaattaaaaagtgatgttcagatgctttgcgcaaaagcatattctgaattcttaacaaatgtaagaggtgatgttagaatccacagtggaaaccttacaccatacattaaagaaggactttataaagaaaaagaacatagaatattgtggaataatttaatgagcgatgaaatagaatttttcagatttaatggatcaagtgataattctcttgatatatttgaaaacagtgataacagtatttatgatttcttagaaaataaattaaagaaactaaaatcactagaaatctctgatatagatattgaaaatattcttgaaaaagatattgccaagcactttaaacataatttttctaatatatctaaggaatttagcaaaaaaaatctactatcaattatagaaccaagtgttttagaatgttttgataagattataaatcatataacagaaagactccctatacaatttgataataacctttacactgcttttgctcttcatattaatacacttgttgatagaatacacagtaaaaagataataaaaaatcctaatcttagaaaaatacaaaatctatatccaaaagaattttctatagcattagaagtcaaagaaattttatctgagtatctttactcttctattccaatagacgaagctggctacataacattatttttaatacctgacacaacactaaatacacagccaaaagataaagtaaaagtaattcttattgctcatggagaatcaacggcaacttcaatgagtgatgttgcaagtaaattattaggtgaagactatgtacttcctataaatgctccaattgatgttgaaccatcaaaagtgctagatcacttacgacttattataagtgaaaatccaacttctgctggttatttgttattagttgatatgggatctcttctcgcttttgctgatactgtaaaacaagaattagatgtagatcttcaagttatttcccttgtgtctacacttcatgtacttgaagctgcaagaaaagcattattaggattatcattagatgaaatatataatgatgttataatgataaattcttatttacaagttcataaaaacttaaataataagacaattgatactaacaaaactttaataataactgcatgcttgactggagaaggtggttctgctgcaataaaggatttcttatctgttaatttaaagtttgatccagatttatttgaaatagtatgtctaagctattgcaataaagagagttacaaggaaatgattttaaatcttgaaaccaaaaatcaagttttatttgttgtatcttcatttcatattgattctctaaatacaaatcaattttctatgtatgaagcccttagtggttcagtactaatgcagatgcaaagattgatagatgaaaaaacaacattactaaatattcctaaaattttaaatgaaaatattcctaatatatcaggagcagagcttactaatgatatacaaaatgtattaactgaacttgaaaagagaataaataaacaatttactcctgatagtttggttggacttactctacatctatcctttttaattggaagattaaaaaataatgaaaatactgtcttgtatcctaataaagatatatttataaaagataatttttctatgtataatataattaaggaaacccttaatcccttaaaaataaaatataatcttactaatttgtctgatgatgaaatatgttacctagttaaacatttatctacaaataaagacatacaataatctagatgatataatagtagatagaattctcattattaaggcattatcaaaaaataacaagtcaattccagcatatttgaacttgtaattttctctcatatgcctaaatttattttgaaagaggttttttatgtttaacagtgaaattattaaaggcttaaatgatttagagcttatgctttatagatatataatgaaaaatactgaaaaagtaatatatatgagaataagagaacttgcagatgaagctcatgtatcaacaactactattttaagattctgtaaaaagtttgactgtaatggctattctgaatttaaagttaaactaaaaatataccttgaaggttcaaacatgaataatgtacgaaacgatcaaagcataattattgatttctttaaaaaactcaatacagaagaacttgatgagaaaattgaagcagtctgcgacttgataacagattcagctaatcttgtatttttaggttcaggtacatcaggaatattatgcaaatatgcagcaagatatttttcttcacttggaaaatttgcaacatatattgacgacccatattttcctacaaactataaaacatatgagaactgtgtaattataattttatctgtttctggtgaaactcctactgttattaatattattaacaatttcaagagagaaaattgtcctattgtaagcattactaacagtgaaaattgtactatatcaaaaatatctgatttaaatatttcatattatataaaccaggagaagattggtatatctgatataacgactcaagttcctgttttatatataattgaaacaatagctaggtcactccataataaagttgatgaaaattctgatgaatttaataaataaaaagtgcagcaagaataatgtcttgctgcactttttcgtttttaaatatctctatttaatttattacaatttaaacttctgtataacttcacttaaagaatctgaaacattcttctcattaacaactaattttgatatattgttaagtatgtatgaaactttatcaatattatctataatctctccactattctcagatgtattttgtgatgattctgcaatacttactactgtttttcctacttcttgtaatatattttttatattagcagacatttcagcaagtttgttagacaattcttctatattatcagcatcattaccatattgctttgatgcattaacaaaggtctgataatctggagtaacattttcatttataaataataacatctcttttgaatcattagttaacttactgaatgcaccctcaaccttctgtgttgtctctataatttgttttactgtatcacttgtttcatttgctaaacttcctatttctgaagcaactacagcaaatcctctcccttgttctcctgcccttgctgcttctattgatgcatttaatgaaagaaggtttacctgttctgctattgatgagatagcttctgccatagttccaatcattgcaactaccttagcattttctatgcttttgtttaaattatcctcatgaactttagataaattcacagctttgttataagattctagtgtattagtttctattttttttactctatattttatatcacttgatattttataactattatctgcttcatcaaccaatacatcaagagctgcatttacttcttctactgatgcatttaactcttctatagctgcactggtagtcataacctcttcatttattgttttgattgcatcctctactttattatagttttcagataactctatagttgtagtatgtaaactttcactttctgatgatatttctctagaactatctgcaacactttggataatctgcttattttctctaagcattttatttaaattatcacccatttgtccaagttcatcttctgttttaatatctatttcttccgtagtaaaatcaccttctgcaaggcttaaggcaaatgagtttacttttttaatattcttagtcacataacttatagtttttataattgcaattattgataatattattgctactacacatataaatcctaacttaaacaataaatttctcactggcctattaatttctgactctggaacctttaataacaatttccatcctaattcatctattgttttataataaacattaaaattttctccattcaattttactttctcatgaccttgaccttctcccttgaacatattttttccaagttcagccatattagtatcactatcatctttaatgcttgtcttcataattttatcagaatcattatgagtaatatattttccatttggatctattaattgtgctgcgccactttcccctaccttaatctcatttactaaattttgaattgatgaaatacctatatcaacagatattacacctataaacttaccattgtcatacattggtactgcacatgtagacattatttgatttgatacttcatcatgatacaattctgtaaaatgcgcactggtttctttattattctttacttccttataccaatcataattaaaataattatattctgcattactatattcatatgttaaaactggtgctccattatccttataaatatatggtcccataaattcttcatttccactataaacataaggttcaaaccatattccacttccaataactaaatcactttgaaaaataacttttcctatgtattgttcatattgatctatattcgtagttttgtatgtagattcaacattccttgccaattgctctgccattttttccacttggtccatttgaccttttattaggttagtatcaactacaagttctgaatccatattcttctgtatttgactttctaaaattcctctgcttgtttcataacttatagaaagtattaatgtcataattaatatattaatagttactaacacgcataacatttttgtacttatttttctaatcttcataaaatccctcctattcatacacaatacttaacttttatatatattttatcatattcttccaaaatatatcattaacaactcaaaaaagtgcaacaagataatatcttgctgcactttaaaattaatcccttaatataaatttatttacattgttattcatgtttaatgctatatctgaaagtacttgtgcactcatagataaatcttctgctgatacagtcatctgttgagaagaagctaaaatttcttctgaagatgctgaattttcttctgatactgctgaagctgtttcaatctttccaatgataacatctttatctttacttatattttcaatactattattaacattatttatcattggtaatatatcaccaatatctactattatagttttaaaggctttaattgagttatcaattatacttacctgtgatgacaattcatcattaacatttgatgttgtacttataacgttatttgtttctgatgaaataattgatattaacttatttatttcttctgaagattctttactttgttctgctaactttcttatttcttcagcaactacggcaaatccttttcccatctctccagctctggctgcttcaattgcagcattcaatgcaagaaggttagtttgctcagctatgccatttattattgttgttatttcattaatttgatttattttacttcctaaattagtaatcttattgcttatatcatcaaatgaattgcttatattattaacagattgaacaacttctcctaattgttcattatttccttctgcttttacactaatttcatttgtatttttatttacgtcattagttattgatactatattttggatagtttctccaaaacttgttactatacttacaatatcaattaactcttctgcttgagatgttgatccttctgcaacaccatttattgctgtggaaacttctttagttgatgctgtaacttcttctgatactgctagtaatgaaattgattgttcgttcatgttatcagcattattcttaacagtttttaatatatctgatattgaatcaactgttttagatattgctttattaattatagaaaattcattttctccttcagtatccatttttacagagaagtctccttctgctatttgttttagatctctagtaagattagttattgatgatttcactaatcttactataactatcattattaaaattgttattactaatatgctggcaattataaaaataaatgctgttcttgtattattgtattctttcttatttaaatcattaagatcacttgctgctttttcattatatataactgtttcatcagcatatttactcatattagttcctattatattaaattcatttacatcatctgctgaaacttctagattttcttttcttaatttctttacttcatctaccttagataaatacttattatattctgacttaaaattttctaaatatgactttaattcatcatttaaattttctttctcataatctgttataatatcatttatattcttaatattcgaatcaattacagaaattacgctttcatcatatttcctatcaataagcttacttacaccttgtcttagtaatcctaaatctgcattgagcttacccattttagcaacatttaatagttgtttttcatacataatattggtagattcattcatttttgatatagaattcaatcctttaattccaataatcattgcaccaactatagatatcaaacctaaagttattattaaatgtactattcttatattttttagtttgttcaattttttctcctcccagtattcagtaaatatttttaatgctgtgaatcactaattcaagtaattatgaattataaaaatacccccaaatttggtcaattaagtactaaattcatttaaaataattattgttaaatacaaaccttaatatatccctataaatttagttagtctcttttttttaattttatagcatttaatcccttatatcatatttcatgtagttgctcagctttattataaaaatcactcccttaattttttacagtgtcgccgcttgtacaaatttaatttgccccctgattcacattaacatttataatactataatcgtacatatttatataaaatttaagaaaattttacataatattatacttttatttatttttctccaatttaaaccataattaatttatataatcatagctctaatagcaaccaaaactgtactagtacagttagcttttcatattattgattgatactcttaataacgttaacatatagacaagaggttaggaggtattgcatatggataaaaaaattaaaattgtaacaattggtggaggttcaagttatactccagaattaattgaaggatttataaaaagatatcatgaacttcctgtaggagaaatatggcttgtagatattgaaagtggaaaagaaaaattagaaattgtaggtaatttagcaaaaagaatggttaaaaaagctggtgttcctattgatatacatttaacgttagaccgaagagaagcattgaaagatgcagactttgtaactactcaaattagagttggtcagttagatgcaagaaataaagacgaaagaattcctttaagtcatggggttattggtcaagaaacaaatggtgcaggcggtatgtttaaagcatttagaactattcctgtaattttagatatagataaagatatgtcacaattatgccctaatgcatggcttataaacttctccaatccagcaggtatggttacagaagctcttcttaaatatggaataaataaaaaagtcataggtctttgtaatgttcctataggaatggaaaaagcagttgcaggaatgttagatgttgattttaatcgcattacaatgacttttgctggattaaatcatatggtttttggtaaagaaatttatcttgatggtgaaaatgtaactgataaagtaattaattctattgctgaaggcaaaatgggctcaatcgttaaaaatataaaagattttgaatggagtccacattttataaaagcactaaatatgatgccatgtccatatcataaatactactatcagacttctgaaatgcttgaagatgaattaaaagaattctccaaaggtgaaacaagagctgaaattgttcaaaaacttgaaaaagacttatttgaattatataaagatgaaaatctagacataaaaccacctcaattagaaaaacgtggtggagcatattattctgatgctgcatgcagacttattaattctatttataatgataaaaaagacattcaacctgttgatgttagaaataacggtgcaatagaaggaattgatgataactctgctgttgaggtttcatgtattataacaaaagatggtcctaaaccactttcaattggaaaattgccagttgccgtaaatggtttggttcaaacaataaaatctttcgaaaaacttgtagttgatgctgctgttgaaggtgattataataaagcactgcttgcattaacaataaatccattaattccttcagagaaaatggcaaaagttcttttagatgagttattagaagctcataaagagtatcttcctcaatttaattaaaaattattagctaatgtggtcctaattactaacatatatcaatataccaacatttattttaaattaagttcatccttcgtattaaacacaaaataagatgatgcattaataatttactgcatcatctattttttataatatgaacatgtatatctacataagtgttagaatttcttcatatataatttccaacacaacctttacttcatttttgttaagtcttgcaagactaattcttatactattatcataattttctttattataataagctcttttattagatgatgcatatatattacttttctttaatctatcaattaactctttactgcttatcttactatttaatatcatagttgaataataccctgactttccccctataaccttaactatattagaatcccattttgctgttaccgatctaaatatagacaatagttcttttaaatgtttatcaataatctttatatgcttttcataaatattgctttttatatatgattcaaaagtagcctgtgaaactaaagacggcatataatacgaagaatagtatgagtatttaatccattcttcatatctatctattaaatcatcaggaatcactgctgctccaatccttatatagggtattgtcttagaatagctttttaaatatatacagtttttaaagtctgaataataatatataggtgaataatttggaagactgtatacatctgaaaaataatcatcctcaacaacataaacattatatttgtgtgcaagttctatgatagactttctttgccttattgagtaatatgtccctaaaggattatgatttctaggaattgtgtagaaaaattttattttttcatttttaaatatttcttcaagttccttaatattaattccattctcatctctttttattgttttaacctctaaattttcatgtcttaaaaaatctatataataaacatacgatggttcttcaattaatatagtatcattcccattaggaaatggcatttttgacagtaatgttaaaacttgaagtaccccttgagataaatatatatttttatttttacaataaatatcacttttattaagaatttccggaagtatttttaaaacactaggtattccttttgaagtcattgcaagagaaatatcactataaagctctactgctgaatttaaacaatgttgaatatcttttacaggaatactgcttactacaggatttccagtggataaatcataacttccagaattatcattattatacctaacaagattatcagcaacaaaaaaccccttttgtggtgtagcataaattatatgttcactacataaagaatcatatgctttaattacggttcccttgctacagttgtatttttcacacatataattaattgatggaagcttaaatccttgtggaaccttttcatcaattatatatttttttatatcttctaaaatcctttcatatatcttcatggaaatcttcctcctgtaaattataaagtcctctttaaataatttgatattaaaaatatgttaatatatttccctctagcattaatattttattagaattatctcaaactacttttattataaatttatctgtgtataatatccattgatatatcttttaattaataatcttcatttactaagtaaataaagtttacccacataccttatataaatgttgaaagttcattaaaagatatacacatatttttaaaggaaggttaataagaattacacctatgccgatgctggttctttatactttcttataacataaattataacaccaaaatttaactataataaaaaacaaaaatgccatactaaaaattagcacagcattcctgtatatattaaacataattttacttaatcaaaatatttaaattatttttgttaatacaatttaagtttataattcttctccattagtagcaataacgtttttgtaccaatcaaaagatttcttcttacttctatttaatgtaccattaccatcattatctttatcaacatagataaatccataacgtttcttcatttcaccagttccaaatgatactaaatcgatgcatccccatggagtgtatcccattaaatcaacaccgtcaagttcaacggcctttttcatttgtactatatgtttagcaagataatctattctataatcatcattgcatgttccatcttcttctttgacatcaacagccccaaatccattttcaactataaataatggcttttgatatctttcatataaagaattcaatgcatatctaagaccaacaggatcaatctgccatccccagtcacttgcttcaacataaggatttttcacagctctagaatatccagacataccgtcaccttcatcagttcctatatcacttttaactgatgctgacatataataactaaatcctatataatcaacgcatccttcctttaaaatttcagcatctccatcttccatctttatattaattccatctcttttccatttattaagagcatagcttggataatatcctctacagtgaacatcaccatatagataacgttcatgcatagcttctactgaaagcatcatatcttctggattacatgagtatggatatactggaacataagcaagcatacatcctattttaaaatgtggattaatttcatgtccctttttaacaactagtgcacttgcaactagttcatgatgaactgcctgataagttacttctactctattttcaccatcttcaaatctaactcctgagcaagtccacgcaaataagtcgtattcagtttctgcttgattatttatttcattaaatgtcatccagtacttaactttatctttgtatcgttccataaccgttgttgcaaaccttacaaacatgtcaattactttacgatttctccatccaccatattttttacatattccatatggtatttcaaaatgtgataatgtaattactggttcaatattatacttcaataattcatcaaacatatcatcataaaactttagtccttcttcatttggttcaagttcatctccgtttggaaatattcttgaccatgcaattgaagttctaaagcacttaaatcccatctcagcaaataatgctatatcttccttatatctgtgataaaaatctattgcttcatgattcgggtaattaagtccttcaataacaccatctgttatttctcttggaactccatgtgctcctgctgtcataacatctgctgtacttgggccttttcccccttcattccatccaccttctaattgatgtgcagcaactgctccaccccataaaaatttttcgttaaatgccatattttaaattctattactaactaattttcagtaacttttcctttcatagtataaatctataagtcaattatttatttactaaatttaatgctaactgtaatactttatcaccattcatcattccatagtcaaccattggtattacttctaacggaattccttttggctcacatagttttttagcttttgataatgtatatgcaacttgtggtccaagtaaggcaacatccatactatctagatgtttatccatttgaccttctggaaaagcagcaatttccacatcaatatttttagatttagctgcatccttcattttatttactaatacacttgttgacattccagctgcacaaaataattttattctaatcataattattcctcctaaaaatatatagattttaataaaaatttataattaattagattatgagtattctaatatattgtctattctataaaattcatacaaaaactatttaattaatgtatttacaacttttcttaattctataatttgttcaattaaattcttttctgaaattgcagtcattaaatgatcctgtgcatgtacaaataaaatagaaaaatctactttttctcctgctgcttctttttgtaacatttcagtttgtgaatcatgagctttagctaatgcgtcatttgcaagaaccatttctttatctgcctcttcatattgaccttcattaactttatttagtgccatatatgcatgattcttacaatctcctgcgttgattattatattcattatttgcatttctaattgttccatttaatttaaatcctccattttatttgcttaatacttattttttaggaattagattctatattacaatttcttatctatattattaagaaatattattaagaactattattaagaaattacttattatataaaatctaattcccgtttttaattaatttttataattatatttttaaatctacatttaatttgatgatgcttctgcagcttgttctgcttcataactcatgttatcgcacttcttaaagaatggtagataaacaaagaatgataaaactaatattgctgtttgtaatagagctgttctaacaccacctactaataatcctgaaattattggtggagttgtccaaggtactaatactcctccaaatggtggaacaataccaaagtaaattgagaaatataatattaatcctgatataactggcattgctataaatggaactgccattaatggattcattactattggagtaccgaataatactggttcatttatattgaatactgctggtactatagctagttttcctagttgcttaaattgagctgattttcctaagaataacatacataatactaaaccaattgtcatacctgaacctgttacagtcataaactgatctaggaactgttgtgttactatatgtgctccgtttgcaagtgtaagttctttccctgctgtaacgattgcaccattttcaagtgtatttgatgttaatataggacccattattcctccaataattgttgccccatgaacaccaaagaaccataagaaaggaattattaatcccattactacaactccacctaatgaatcagtcataccttgtaatggagtttgaagaactttataaataaattcaatgaatgttgtatcaaatattttaaatacagaatataagattgtaccacctgtaataagaactgctgctggtattaatgctgagaatgaattagcaacaccttcaggaacacctgctggcatcttaattcttatgtctctcttcataaaccaagaataaactgcacctacgacaagtccgataataatagcagtaaccataccttttccgccagtccaatccataggaattacgcttcctacttttgtaccgtcttctgttatgacgtacgaattagtagttaaacaaaatattgaaaatgcaacaactccagctgataaaggttcataaccttcattcttggcatatgtatatgctataccaacacatgcaatcatcgccataattcccattgttgccccatttgcttggaataatggagcatcccatccttttgatgaaataaaatcagctaatggcttatatggaatttgagctaatagtaagaaaactgatcctattaatgttagtggtaaagtaaaaatgataccgtcttttaatgctataaccgcctttaaatttacaaacttcattatggcaggtactactttttcatttaaaaatgatgacatataagttccccctttagttttattaaaattccttataaaacaaatacgtatttagtttatgaccagattatacagcatcaatttatttaagtaaacattttcatcagctaaaataacaggtttcagagcattgttcctttttacaaaaaagtaacaatatgtttttcacatctaatcttgcaatcatcccgcttttaaaatttaaatctaaaaaatatatataatttcttaatttataactataaaagaattcttttgttttttcttaattatttaatatataaattcttatgagttttaattcaaaaaaacatcatactattttagatagaaataaaaatgcagcatttgtaatctttatcatacaaatactgcaactttacatttattttttacttcttattttttcattatacaattttctacctactgtttccaaaatatacattggtggtaaatgacttgtaatatcaatatcacctattctttcttctggtatataatatgatatattaaaattcgaaattttagctattgttgtattttcactattagttatacttgctattgtacatttttcttttttaaatttattgattgcattaataatctcaactgtttcaccagattcagataacactataactagtccatttttataactttcacaatttattggataaaataaatcatctatatatatactaaacttgcctattgatgtgatatatcttgaggcatattttccaactataccagataaacctcctcctaaaaacactatattatcatgctcccttataagcttgcataattcatttatttttcccttaaactcctcactagcaagccttttaaaattgtctattataaaagatgtgtcctcatttatttttctatcctctttactatccatatacatcttgaatttcaatttaaattctgaaaatccatcacagtttaattttctacaaaaccttaatactgtagttgttgacatatgtgcttcatttgctaaatctcgtatcttcatgtacattactttttcactatttttcattatatattcatataatgataactctagttcattaagaccctttatgacttcacattcaaacatcttgtacctccatatataatactcccctgtatacagttacattatatcagctttatttatatttttacatgataaataccaagtaaagctctaagtataatattgccaaataactaaaacatcaatatgctctttagtatccatttttaataaaatatcatttataacatatttaaggattatattttattagcgttataatctttcattaatcaatttattttataaaattatacataaattgattttaatataaatttttttaaaaattagtcgatattaaaatatatagaattttctatataaaaaaaatcaaggagtaagattatgaaaatagaattaattaaatcaaataatttttctaaatatacatcaataaaaaaaaataataatttaaataacaacactataaaatctaaaaatgaaaatactgcttatatatcctctcttataaacgaaaaatacgaaaaagaaaagcagttagaacaactaaaacagtatagaaaagaacacatagcagaattagaggatattatttctgatataaaaaatagtattgatgaaataaataaattatctgaaaaaaatataaatgaaaatgataattggacagataaattatcacaaaaagatttagatgaaaatgacaacctgacagatgaattatcaccaaaagatttagatgaaaataataacctgacagatgaattattacaaaaggatttagatgaaaatgataacctgacagatgaattatcaccaaaagataacaatctagtcttaactccaaattctaattatatagatttaattaagttgttatataaatataaagtagaacttaaaatgtataaagagacaagtgcagaggaaataaaaaatatacaaaaagaaattgagagaataaataataaaatttcaaatgcaaaacaacaaaaaaatagtgataattttatagatgcatttatttagagagtagataattttgtgtaaaagcaaaaccatctactctcccttaatacttatttaagaatactattttcccattaccttaacatcccataaagaatatccatatggcaatgctctctctatacctttaaacttaacatatctagcattaatattattaatcttaatattttcttctccaccattcccattctcctgattgaaagcagtagtataatttataccgtcttcagacaacattatttcatacttttttccatatgattgttcccaatttaaatctattgcatttatattgtatacttcccctaaatctatatcaaaccatgcattatcatcaaaatttgaagaccatcttgttgctaaattattatcattaatatttttaatagataattcatcattttcatttccagagcaagttatattttttcctagtgctacatctttgtattcttcttgaacatctccattatccccatcttctttatatactcgaacataatctacctgcatagctgctggaatatctccttcatttggtgtaagccctccatcaaaccaaccacctactgcaagattcataataatatagaaatcctgatcaaatggtgctttatcattatttttatcagctaaagaataccactgatcctttgtagctttaaagaaacagtttccatctacataccatttaatattatcatcttcccacactacactgtatacatgataaccagtatctattgcctgtccatctttgaaagaatagtcacttccaaggtaagtattagatggccatgttccaccaaaatgtatagttccactagttgattgtggtaaacgtcctcttgcttccattacatctatttcccctgatgctgcccatagtccatatacatcattatttggtagcatccaaagagctggccaaatccctgtacctttaggaagtttagctctaaaatccactcttccatatttaaatgcaaatttatcttttgttgtaatttttcctgaagaatatggtgcaactctattaggatcaatttcagagaatattttaggttcataataagccttaagatttaatttaccatcttccaaatatatatttttttcactatctgtataatattctagttcattatttccccatccccacattgatggatcattattaatataatatccagtattataattccacttatttaaatctaaagaattacttgcaaattcttcattccaaataagtttccatccatctatctgtgaatctccttctgttccaagctgtatattaccaaggtctgaaacatcaggtcttggagcattagggttacccacaaagttatagtaaacataattttctccaatatcatgacctttgacaccatcaacaggatatcctatacgaagctccatatcctcctgtattggttggaaccaaagtccatatattccatctacccaatatccccattgatttttgtcagataacttattatatccattaccttgataactaaagccacttgcagcaccatttccaagttcttcccacttatcatttatttttatttcatatacaaatccatctaactcatttcctcttggatatcctccatcaatatttggtaatggaatcccaattgcaccagtatctcctgctttataggtagttgtatcagccgaaagattataattatttctttctgaattgtcgtattcaattacatagtctatatacacatctggtgaagatatggatgcaaccctaactttagttgttttatctacattaaaccagtatccaccgccaccatctgtaaactatccaaagtttttatcataaatccatccacttgctgcattgttaaaaagattaatccacttatcttcttcatctgaccatacgtatactataagatcatcagaaacttgatcatatattacagatgaatctccattaaaactaggatatgtgaatcctgctccccctgtaacaccagcttttatattaggcccttgagttggtttcattgatgtaataactgatttagacaaattattaaatactaatttataatctaaagttacattgctgttagatttagataccaattgaatttctgtagtttcagataatttaaaccaatatccactaaaaccaccatcattccaatttccccaattagagttatacttaaatttatcaaatttatcgatatcaacccattttccatcaacttttacatttaccactaaatcagaagctacatctgcgtaagattgtaatccaccattaaatactggcattacaaatccataacttgcttctccaactccactttttgttataacaggtccatcatttgcagaaaagtagtccattgaatggattttattatcttcaccttttgtgatatcgttttctttttctgcaatattttgtactttttcttcttcattaacttcagtactaactacatctttttcatcaacttgtgcctcattcattgtaacatcatttatatttttctcatgaatttctgctgaagtcgtttcagccgcctgaactttttgtacatttaataaacttgtacttcccgccagtattgaacacgccatcgttgcactaaccaccttcatcattctctttttactctttttactctttttggatttctttctcataactctcctcctaattacacaatatatttatcttaataatcatcatctaaactattgtttaaatggtgattattaattttttatataaaattgcttaaagaagcaaactaaatataaactatcacctaaaatgtttaaatttattaatcatcatctctaatttagaagattgtgatttcaattcttcactagaaattgcactattttcagctacttcaactgttctattaatagtttctgttattttctttattctttcattaacaatagctatggactcatactgttctttcgatgaatctgttatatattctgaaagttctcgtgttttttttatattttttaatgattcatttagtgtattagccgtattataaactaataatttaccattattcactgcttttatagattcatttacaatattatttgtttctctagctgcatcagcactctgactcgccaaactcttaacctcatcagctacaactgcaaatccactccctaaatctcctgctcttgcagcctctattgctgcatttaaagccaatagatttgttctttcagcaatatcatttattgtattcataatacttgtaatgctattagaacaatcttctatatcctccattgctttaataaccttatccatcataatattactattgtctatattctctgccaaagcattagtaatagtgctagtatcaattgcattatctgcattcttatttacttgtttatttatttggtcaatagaaacacataattctcttactgcatccttctcatttttacttccatcagaaagtaattcagccatttcagcagctttttcagaatttgcttttacatcaatagttgcttgtccgatattttcaaaaatatcattaagtgatcttattatgttttcaagtgattttcttatttctataaaattacctttgtattcttcttcaattgaacaattaaggtttccatttgaaatatcacctaaaatactagatatttcacttatataacttttaatagctattaccattttagaaaatgattgtgctaattcacctatttcatcatttgattcacactgtatttcaacatctaaatcaccatcacagatacgtttagctattttactcatttttattattggatttccaataacgtctgaaagatatttagatgatttcattgcaaaaataactgataaagctatagttgccaaaataatcataacaaatataattctcaatctatttaatctatttattagtaaattacactgttctatttttatggataataattctgatatgtcaacagtcaaaagatccattgccggattaccctgacctcgtaataattgagatgcctgtgctgttttgttgttcattccaagttcaataattctatcttttacctgctcataagattctatatctgactttatattattaataagttcctgttctttatcattttgtacattctctttatcaatattttgtaataataaatttatatcttcattacacttttctatatcttcttttattgtttttattctgtctacatctgaagtgtttcctacaacaataatttcttttaccatagaataagaatgctcaactttaattcctaaaagacctacttgtccttgagaaaatccataattactcattgcatctttatatctatcattgattatttgtaaacatatcaagctaataaatgatgttaatatgctaataaccactattaccataaaagaattcatcaatttcttctttataggaagattcttaatatccactttcatgaatttttcctccctgctaattattcttatagttctgccaaattattaaagcaatctgacagaactataaaaccttattctaaaattatttttatattatgaactttctctttttctaaagattctatgttgcttctcttaatcataggtaatttttcaaattcataatttctatcatcaatgattatttcactaattttatattcattgcattcttttaaatcgttattaatgtactcaatatcgaatcttctatctgcaaaagtcattttaattacagctttattttcatcatcaaactgatttaacattaatttaggttcaaataataaatctcccatattaccttttactccaaacatttctgttaatacagtaagtattagccagcttgcagcacctgtaagataatgatacatacctcttccttttgaattgatatactcaggtattcctggatatattctactcatttcaaaatcactacagtgtttataaagagtatctataactttaaatccttcttttacaaatcctctcttataaagggcattggcatacattattgccatatggctgaatactgctccattttctttatgaccataagcaaatccaaacattcttccaagatccgtttttaattcattaaaatctgtatttaacttatatccaccaacagttttatcataaagatatttatcagcagattttactatttcttcaacctgactgttagatgctgtgttgctcattatagtaaatacctgtcctgtaagcatcattctgatattgttgttaaattcaccttcaactctgcttccatgattatcgtaatatccattaaaccaactgttaccgtcattatcagaaatccactcattatttctaatatgatttttaatccactgagctttttcttcaatattttttatcaacagatcacaacttatatgaacagtttttccacttatcttgtgcttagattgttcacaatacatttttaaaacttcacgttttttatctatattgttataaagagattcatcacaacctaaaagcacttgaatttcttctgaaaactctattgttttaatattcttttcatctcttaaaacttttattaattcagctatatcatttaaatttccaccatataaagctgtaaaagcaacactttcgcctctatcagatgccatatcaagagcatcattccaatctgcaccatgaagtcttatattgttgtgttctccaacatcatagaaagatgttaaatgctgaactagaatgtgttctaatatatttcctttatactctgaatcatcatctgaaagctgtttatttccttgtttgctcttccataaagtgtccttatcttgccctctcattatttgtaaatccttaaaataagtctgtttttctaataagaattctatatcaccactctgctcaatataaagctttgtagtcaagaatggccatgcgccgtgatccatccatacacgtgtaatattatttctatctgctatgaattcaccttgtttagttccaataatagtagcattagttccatcaaagcgaactccgccaaaattatctataagcatttgtcttacatctttaggatccattgcaataagtgctaaacaatcctgccataaatctctccagcctcttccccttttccataatcatggtgaggcaggaatgaacatccatatattcttctaagcattggctggaagttaacccagtacatccaattgtcaaattctgaatcctttgtttcatatgaaatattgatcttatcgttccaatatgattctgtttcagaaagcaatttatcgaaactggtttcgtttaaaacattaacacatatatcatctaaatcctttttagtatctccaaaccccaatgctactatatatgttttagatgcatttgcatcaagtacaatttcattaaatcttatggctccaattgcttcaaatccttcaaatttttcatttgatttaacagtaaaatctttatttaatattattgtttctggagcctcaaatgatccaccttcaccaataaattcttcaactaatggacaataaccttgtggtctttctccattttcttctactgccattattccataaacaacctcatttttcttatgacctctttcatcaaaagttagtgtaggattaactaatactccaaaatcagttgtctctatcctgtgaagcagtgatgttacatgtctatgatctcttagattatcagctgaacgtgcataaaacggtattgctactgttggagttatcctttttgattcaccacttatatttgtgatagttactttcatcaattctaccttttcattattacttggtacaaaagatgttatttcacttttcactccagcatcttttgatatccttgtaaccttgtgccacattattcctgcttctaattctgtttcttccttgttttcaccaaatacttcatatttctgttttcctgaagttcctgtagctgaccatgctccatatccttcaatatataaccaaaaatttcttgatgatttattgttatgaagttcttctgcacttacaggagccagcaaaaatgtattctggctcattttgcagtcaccatttaaagttggtgttaagctagacattacaccggcttcattggctattggaaaatacgcataactatttttttctggattaattaatgaaaatcgtccttgtttatctaaaaatttatatttactcaaaaaatcaccttccaaatattaattatatttttctgcatgattctctttctattagttctactggaattaccttgttaattttcagcttagccttagcatttatctgctctacaagtaaatcaacggctgcttttccaacagatgtacagtcttgtcttatagtagtaagctttggcgttacatacttagctaattctatatcatcaaaacctattattgatatgtcttcaggtacacttaatcctgcttcttttattgcatcaattgcacctatggcaagtttatcacatgatgcaaatactgctgtaggcatttcttcaagctctaacagctttttcattgcctcatatccgccactcacatcaaaattcactccatcaacaatatactcatctggaacatcaagatttaaatctttcattgcccttatatagtattcttttcttatgctgctaggccagttatcctctttagaaatcccttctatatgtgcaatctttctatgtcctagattatataaataatttattgcaagtctgcatccttgtgcactatcagatgttactgttgaagtattgctgctaaacatatcaatcacaacaataggaaaatcactgtctattaactgtaaggtttccttatcactagggtcagtacatattatagctattccatcaacatttatatatttgaaatactctaaaaaagtatcattcccaagcctgttatttttagaaccaaataaaagagaatatccatgactatctgcctgattcttaaatgcttcaattacacctgaaaagaaaggatgactaagtccaactccaaggttttcaaaatatacaattcccaatgtccatgtttttttagtagataagttttgagcttgtgaatttggataaaaattctcctcttcaagaatcttttttatctttgctcttgttttatcacttacatcaggataatcatttaatacctttgatactgtagttggcgaaacccctgctatttttgcaatttcatatatagtgctcactctttctcttcctttcctcttaactatatatagttaataaatatttattttaaatatgatttttaaaactcaacactaaaattgttcttgatataaaaatcctaaacttcatgctatattacacattattttttaagcatatagtctatcaaatacacattcttagtattagacatttacaatacattaattttaattatattctatctcaataaaaatatcatccttaatgtatttcatcattcaaatatttatttaacttcttttattgtatatatagaatgaggttttaactgtaatgaaactttatcaccatcgatctctaaatctactattttaatatcatcactttcattcattatcacactacatattgtattatcttcatttatacaacttaagcaatatactttttcaccttcaactgtactttcaactcttattgcattttcttttataaatttactaaaatgagctatataataaaatgaactattataaattacgttcttttcttttgtatctattattactggtgaatcacataaatttccaacatgatttggacctccagtttcatcaagtgctatattccagtccatccatgcttccatataattattgaaatctccaattatatttctaccatatctttctcctgtatcccatgaacctaaatgaactccgccttcttgacatccttctgtaaatataagatgcttgtctggaaattcattatgaattttagatacattaacgaattcttctgatacataccagtgaagccctgttccataaacatattttgcagcttcttcatcttctaatacaacttttgctctttcatatgcaatatctctgttatgatcccaaattataatcttcttatcttgtaaattattattatggaaagttggccctaaataatattttacaaaatccctttcttcttgggctgtatattcacaagaatcccatgtttggattgctgctggctcattttgaaccgtaactgcccatatatctatatctttttccttcattttttctatatacttaacataataatcagcccataactgtttacattcttcttttagctttccaccatgattcatttcaccatttgttttcatatatgaaggcggactccaaggacttgctaagatagttaaatctccttcagatatttctttaacttctcttattaatggaagaacgtatttttcatctctttctaatgtaaatgtatctaatgttaaatcattttcttctacataagtgtaattttcaagagaaaaatcacagctgtttatatgaattcttccaaatttatatccaattccttcttccttatcataataagatttaagaacctttttcctaacatcatcatctaatttagaaagagcatacgaactagattcagttaatgcgcctccaaaccccagtatcttttgaaacttatttcctgtgttaactttaatacatgcattatgattagattcactttttaatgctatatcatcaagtttttttaattctagtttttcttttccatccttatatgtttcatagacattatattttttcatattatacctccaaaatcttataaaataactgcttcaatttcttttatctgattatctctaatctttgcagcaatctcaccgcatatcttgtttccataaaattcatatttatttccatcaaaatcaactatttttaatttatttactattcctctatcttctccaaatgtatttttattttcagcattaatataagtaagttttatacttccaagtaatgttgtcttaataattccatctttaaagaaatcctttgataaaatcggatttaactcaaatgttaatacctcatctttataagtgaacagcttatttcctaccatcattaatttccatatgttaagcatttctactgttgttccacttaatcttgcaacaaatcctcttccatgattgtgttcatctggattactgctgcttgctataaatgatgaattttctaatatgcttcttccatatacttctggatccataaatggaggcattgcacttttaatagattcaaaaaattcatcatataatccgctctttattaattctaaaatatatttaaattccatatgcatgaaaactgattctctttcaagccatcctggtgtaaatgtccttgctcttcctatttcaaatgaaactgcttctaaagactctgatgttttatacatttttaatttcttatcataaacatcactatttattgttgtgtcataaatttcatgtttttcttcaatgttgtttactatttttaagtatcttgctgcaccttctaagaacataggtaaaaagttaactttaaattcaagaggttttacttgatttttttcatttagttcatatttaacaacatcgtaatacatgaatgtaggaatttttccatcatttaatttcttgatatctttaattccaatattaattttttcaatcattttatttaataaatcttctagttcacaaacataaatctctttattttctccacttacttcataatttgttgaagctctataaacttcctttatattcgaaaccttattccaataatcaaactgagtaactttattgtccaatgcatctgaaagcacaccatttaattctgtcatagcagtgtaaaactctaaaggtacttgtaaacttccttcaactacatttaagttttgtcttataaacaataataatctttgtaattctgctgtttcagcaaaactagaacccaatagacctggaagtccattcattgcatcattccagccaggcttcccaccttccatctcaataccaaatcccatgttatctaaagacatgaatttagttccagcaagcattacaagcttcgtaagaagattaactttatatacatttccatttctatcgctaacccatggctgaacattaccctttttacctaaacatacatactgtctaactttttcgttatctaattcatatctttcttctcttggtaatacatactctggagaattgaagaacttatatcctttatcttcaattaataattccttaagcttatctggataaatatttaaatactcttcaattaaatctaagttatatgtccagtggtctatccagaaaccttctccaaaatctgcttcattgtcctcttctgttaacgcaacaatattatttagtaatttttctatatcctcatcattgtaatcatcaaactttataagttcagcgtaaatatcaccaactgtaaactttttatttaaaaattcttctaagctgcttgaatctttatcaattaaattcaatacctcttttttattttcatctttaacataaagcttctttcctgatatcttcaatggattatatccatctaactgaattaattcattgaatagttttatattttctgttcctacaaatggatgaatataattatccattcttctattttgatttacatctctaaagttaccgtttccttgagaatagaaattaggttctatactaaagaaattataatccctttcaagatctccatgttttctagaatatacataatagatctttccacctatttttaatggatatccacctcttaatacattatccatataacattgctttatatattcatcaaataatggataagcactttcagtttcaacacattttaatgtattatctataatttcatttccttcttcacacttctcttcaaaatattctttatttattattttttcctgtgctgtacttattttttctatggaattcatatatccaatatagctataaataactatacttgtttgtggttcaagctcttcagtatttcctgcaaatgcacatggaactttgttataacacttatcctccttcgaaagtgatgatatactattttcataaaattctactggctcttttaaagatgtatcaaatccaaatattttctcaggatctactataggcttaatactcttttcactatgattaaatgcacaataaaaatatccatttttaacttcatccatcttagttgagtcaccagttgatgatcttactttatagattgctgtattgccatctataatatatccttccatccagcttcttaatgtatttccaatttccttatattcaatattctttgatccatatggtaatacagacgttaatccatctaaaatttcaactttaatattttcatcatttaaatttgtcacttcaacttttctgctcaaagctgcaaaatcttcatttggaatcgtaaaataagttacctctgtttttaaatttttctcattatttatctctattaattttaattcattgttttttatttttattgttctttctactaaatcacttgtagttactccaaaaggctctataacctcttctttattttcataaattacttttataaaagttctaaatccatttgtatataccattttataagcttcattagctggaaaaaactccattatacaattatctttatctcttattcctatactgctaatcgcttgtcctctattaacataaaatgaccacataggaattccatgtattcctgctacccctgccatgaaacttgcaaaaggaagctttttgtcataattttcaatcgtgtaatattttgattcatctatataatctacttttactattttatccgctttcataacacacctcttaatattgttactatctctcctgtaaccttaatcataaaatatccatataaaaataattcttaaacgtcatatttgaaatcccatttaagtatattgctagtttaattgctgattttcattaatcacacctagcattattaataaaattacttgttaactattctttaactccaccagctgaaatactgcttataatatattttgaaaagaaacagaatgctatcataataggtactactgacacagcaactgatacatatgttgcacccatattagcagttatatcctttgatgcacttaaagatcccatcattactggtaaagtaaacttctttggacttacaagtaatactaatggcataaggtaattattccatgatgctataaatgttcctatagacattgttgcaatacctggcatcattattggaagccctattctatgaaatgttgataattcacttgcgccatccattcttgctgcttcaataatcgatgaaggaagtactgaaactatatactgtcttaaaaagaatacagtaaatggactcgctattgctggtattattaatggtatatagctatccattagacctaatccattaattaaatcataaaatcctaaaagacctaattgtgcaggaaccatcattaatacaagtattgttgtaaatacaacatttcttcctttaaatttataaattgcaagaccatatgcagttaatgctgaaaaatatccacttaaaacagtaacgcatactgatatgaataagctgtttttaagtccactgaatatgttgaagtaatcgctcattatcttccagttgctttgaagagagtttcctggaatcaatgaaaatgagtttattatttcctgactactacgagttgaattaaccatcattatcaaaaatggacctaaacatataacacttaaaagaattaaacctatataaataatactttttttaatttttgtaaacattatttaccctccttagcttttttactatctccatacattgatttaaatgtaaatgctgagaatatagctattataaagaataatgcatatgcaatagctgctgcataacctatgttgttatatttaaatgcagtattgtataaatacataaccactgtatttaacgctccattcggtgctccaagtccatctgtaattagaaatggaatatcaaaaatctgaagtcctccaataagtgaagtaattgcaacatataataatattggttttaaaagtggaagtgttatttttgtaaatgttgtccatcttcctgctccatcaatagttgctgcttcaaaataatcctttgatataccctgaactccagccataagaactataaatgcattaccaaaccacatccatgcacctataacagcaacaacaatagtggctgttcctggctgacctagccagtttattttagtagttataagtccaagtttaactaataattgatttaatgaaccaaactgccagtcaagcaatgccttaaataaaaatgctacagatgtagctgctattaaattaggaagataaaacaatgctctgaatattggcagccccttcattttatactttatatcactaaatattattgttaataaaaatgctaatccgaattgtaatataacatttacactccatatctttaaggtatttttaaacgctccccaaaataatccgtcttttaaaacacgagtataattttgtatccccacaaattccgcttgtccgaaaccggtaaagttcgtaaaacttaaatataaagttttaaatatcggatatatactaaatacaataaaaacaaccaaaaacggaaaaataaatgcatatccccacttgtttatatctcccaaacttttctttctactaaatatgttactttttgtttctggtacagtgttcatttctagcttcaaattcctcacctctaataattttttttgtatacacaaattctaataataactatttaaaaagtttttctttataaaatagctacttttttataggtgtgtattttatttaaaggtgaggaataaatcctcaccttattttagtactgttagtttggtacttcaatttcaggatatacagtctttacatttttataaaagtcctttaatgcatcttcttttgacatttgacctttttgaacagattcaattgcttgcccgaagaatttaccaatttgatcatcatattttgtaactaaagaataatcaattttctttgattcagctaaccagaaatcataagtcttttgaccgccaaatgcttcattttccatatctttatgagattctaatgaaggaatatatgaaactacatcacctttagacttttcaatccaccagtctgatgtgctttcagtaactgtacaatacttaaggaaatcccatgcagcttctttgtttttactgtagctacttattcccataaatgttccacctgagaaatatgagttaggtcctgttgtaacaccaaatttaccaatgttatctttagcattatctcttattattaaagttccccatgttggaagtgcatatgagaatacttctgttttttcagaatttggatctacttgatctagttcctttccatctgtgtctactggaattggtgcactcattgattgataccatgcagctgaccattctggtgcaaatgcaacaagcttgtcttgatataatttaacagcagcatctacatatgctaatctatcatcagtcatcattagtttattgtctttaacccaaggttgtggatcattaccataaacgaaccatcttaaattacctgtatctgcaaatattctatagcctttatcttttaattcttttgcagtttgtgttattgtagtaacatctttaaatttttctccaataaatgctggatcatcatttccccatacagctttagctatatctctacgataagtaattcctcctggagtcatttgataacttaaggctcttactttaccggtttcgtcttttccagcttgatatacataatcaacaattttatctttatattgttcagcattatatggctcttggcttaagtcttcaaaaaaacctgcttccataaagttaggaatcatttgtggctcaccaactataatatctggagtctcagcttttcctcttaatgctgttgtaacttttgttggataatcagctggagctataaccgtaacttctacttcttttcctggattttcctcttgataatgctctgcaaattgctttaagtcatctgataatgtccatactactattttgttactacctccacttgctgtttgactattgcttgatgatgagccacaagcaataaacgaagttgctaacaatcctgttactactaatgataatactttttttagtctcataatttttccccctattatttttattctaaattcaaatcataaaatttattttcgaaactggtttcgaaaaggctgtaaaaaaatcagtttcttatgtttactacttcgaaaccggtttatatatttgataaaataaaatggctgagttctaataatattaagccacttttatgattttcttttagaaattgtttacatttttattatatatctgatttttatctttgtaaatgtttttttttaatatttcaatttttttctatttaatcataataaaattatatgaatacattgatttaaattctaacaattaaaacaaaaaaatcaaggattccatactaaaattagtacggcatccttgattatattaaaccatatcccactgaattaaaccatatgccctaaactctacccttttatttggatgctacttcatgaaagctaaatttataataatttctataaactataattcttctccattagtagcaataacattcttataccaatcaaaagatttcttcttacttctatttaatgtaccattaccatcattatctttatcaacatagataaatccataacgtttcttcatttcacctgttgtaaatgaaactaaatcaatacatccccaaggagtatatcccattaaatctacaccatcaacttctatagctttttccatttgctgaatatgagcttttaaatattcaattctataatcatcattacagcttccatcttcttctttaacatcaattgctccaaatccattttcaacaataaatagtggtaattcatatctttcatataatgtatttaatgaatatctaagacctacaggatctatctgccagccccagtcacttgctttaacataaggattttttacacttgcagagtgtcctgaaagtaaatcttctgtattttgagcttctgactttactgcatttgacatatagtaactgaatcctatgtaatcaactgttccttcttttaagatttgtgcatcttctggatccatctttatgttataaccttttctttcccattccttgatagcatatgcaccataatgtcctcttgcatgaacatcactaaagaaatatctgtcatgcattgcttcaacttgaagcatcatatcatctggattacaagaataaggatatatgggaacaaatgaaaccatacaccctattttaaaatcaggattaatttcatgcccctttttaacaactaatgcacttgcaactaattcatgatgtgctgcttgatacattatctcctctctgttatctccttcttcataaataattcctgaacaagtccaagggaatatatcaacaccagtttgcttctgattatttatttcattaaatgtcatccaatacttaactttgtctttgtaacgttccattacagctgttgcatatcttacaaacatatcaattaccttacggtttctccatccaccatagtttttaactattccgtatggtatttcaaagtgtgataatgttattactggttcaatattatatttaagaagttcatcaaacatatcatcataaaactttaaaccttcttcatttggttcaagctcatctccatttggaaatattcttgaccatgcaattgaagttctaaagcacttaaagcccatttcatcaaataatgctatatcttctttatatctgtgataaaaatctatcgcttcatgatttggataattaagtccttcaataacgccatctgtaatttctcttggaactccgtgtgctccagcagtcataacatctgctgtacttggtccttttcccccttcattccatccaccttctaattgatgtgcagccactgctccaccccataaaaaatctttattaaatgccataattatttctcctattctactacgtataattacaatataatttaatcttatatattaattttaatttgttaatttctctttcacatgttaataagaaatccaccaataaatccaccgattatagctgagagcattatccatttagattttcttaagctgcctccttgcataatagatgatataagtacccctattccaacggcccaagccatatctatccatatacttccactctgctttataagatgattttctgctccatgatttaatatccacatggttcctggaatcagcattgcagctataaaaccaccaaaagctcctagcaatgaaacaaacttatcccaatacattattactccaaatgaaaagatagctgatccaaaaattgttgtaagtgctccaaaactattcatattattcccctgcttttgatgcctttttataattcctgcaacaactccagctatagttcctccaattattacacatataaatgttggggcggaagtaactataccttcaagaccattttttaaaaagtctctgctaaatgaacatatggcaactgcaaatcccatgtcaataaatgcagattcttttttattttcaacgattcctaagtaatgattaacataccacaaagtacctgttaatataaatccacatatccatccacctttaagtccaatcctgcttgtaattactccccaaagagtatttaatattattgctgcaattccaaaacctaatgtgctttttaaaaacgatttcattgaagcttcatcaccccatccccttatgaaattcataccaacgaatttcttgagttaagtatatcatcaataaatttatatttctttactttttataacttagtgaaatttattactattttgttatttgtttttttataaaacaggttgttttttaaattattaatcttaaattgaattattataaagaaactatttcaatctataatttaataaaaattaatttaacattaaatattgatcgtaaatttcataaaaaacggtataaaaccaaagttactgagtatgactttacacttgcactcacgaatttagttttttattttacaataaattttcattttttccttgacttgaagttaactccaagtattatacttcagatataaactaagaattttaatagaaaagactaatattctaaccaatgcaaaaactaaattaaaagactataaataagataattttaggaggacaataaaaatatgtatttagaaaaaatcaattcaccagaagatgtaaagaatttatccataaatgaaatgaacgaattaagttcggaaattcgtcaagtacttcttaagaagttaagtgaacacggaggacacattggtcctaatcttggaattgtggaactaactgttgcattacatcatgtatttaactcaccacaagataaaattgtttatgatgtttctcatcaaagttatattcacaaaatgcttactggaagaagagatgcatttattaactctgaaaaatatgatgatgtatctggttatacaaatccacacgaaagcgaacacgacttttttaatataggtcatacatctacatcagtaagtcttgcttgtgggctagctaaagcaagagatttaaaagatgaaaaagataatataattgctattataggtgatggttcattaagtggcggagaagcatatgaaggtttaaacaatgctgctgaagctggaacaaacatgattattattgtaaatgataatgatatgtctattgcagaaaatcatggtggtctatacaagaatcttaaagaacttagagatacaaatggtaagtgtgaatgtaacttcttcaagtcaatgggattagattattattatgtaaatgacggacacgattttgatcaacttataagcgtatttaacaaagttaaagatacagaacatccagtagttattcacattcatacaattaaaggaaaaggatttgaacttgctgaaactaataaagaacaatggcactggggaatgccttttgtactagaaactggtgattctaaattccctatgggtgatgctgaagattacggtgatcttacagctaaatatttattaaatgaaatgaaacaagacccaactgtagctgttattacttcaggaactccaggagtacttggtttctctcctgaaagaagagctgaagctggcagacaatttatagatgttggtattgcagaagaacatgctgtagctttagcttcaggaatggctgcaaatggtggaaaaccagtttatggagtatatagtacattccttcaaagaacatacgatcaaatttcacaagatttatgtataaataacaatccagcagttatactagtaactctagcatctgtttatggaatgaacgatgttacgcatcttggattatatgatattggtatgatgagcaatattcctaacctagtatatcttgcaccaacatgtaaagaagaatattttgcaatgcttaaatggagtatgaatcaacaagatcatccagtggctatccgtattccagcaatgggtgtaataaatagtggaaatgaagataatacagattattctgagttgaataaataccaagtaacaaaacaaggaaaagatgtttctgtaattgcacttggagatttctatcaacttggtcaatcacttgttgaaaaactttcaagtgaaaatggtattgaagctactcttatcaatccaaaatatataactggtcttgatgaagaattacttgaaactttgaaaaaagaacataaacttgtaattactcttgaagatggtattttagaaggtggatttggagaaagaatcgctagatactacggttcttctgatgtaaaagtattaaattatggtatcaaaaaagaattcttagatcgttatgttccagatgaacttatgaaaaagaacagaattacacctgaacaaatgtcagaagatataatgaatattttaaaataatcaatgtaaatagcatataaaaaattaaaaacaatccaaaagtatttatacacaacttttggattgttttaattctagttttcttttactttcgaaatctttcccaagataatatttaaatattaatctaaaaattcattattattcttcttagattatttctttcccaagataatatttaaacgttaatttatatatccttctgatactaaaaactcattagcaacaactttaggatctctgccattaacatcaacttcataatttaattttctcattgttttatctgtgattttattagctaataaattcaatacttcttcaagttccggatgttcttttaaagtatccattcttattaatggtgcagcataataaggtgggaagaagtttttatcatcttctaaaacttgtaagccgaacttatctaataatccatctgtcgtaaatgcatctattacatcagattcattattcattaaagctgtatatcttaatcctccatctactggtttaacttccctgaaggtaaggttataagctttatttaaacctaataaaccatcttctctattagcaaactctatagttggacccattaaaaattcttgtgaaataccacttagatctgaaatactttttaaattatatttttctgcagtatcttttctaacagctaatgcataagtattattaaatccaagaggttttaaaaattgtactttttcattctcttttaataattcattagctttactatatacttcatctggattagtatttccatcttttatatctaataaattaacataagcagttccagtatactctacatataaatctacacttccagactttaatgctgaataagcaacttgagttccacctagattaagcttagtttccacatctatatcagttttagcttctattaattgttccaacatattacctaaaataatttgttctgtaaagtttttagatgctataactattttattacttgatttctggaaaggattatttgagaagaataaaattacaatcagaattaaacttgtaactaatgctataattttatttcttttacctgttcctttattacctcttttaaccttcatagtaccatctgatttttttataccgttaggcattacagcatattcaattttagctgttacccaatcaattactaaagcaagtattgctgctggtattgctccaaataatattaagttattatctacagtctgaattcctgagaatacaagatatccaagcccaccagctccaacaaaggctgcaatggtcataagacctacagcagtaactcctgaaattcttattccagccattatcattggcatagctaaaggaatttttactatctttaatatttgagtctttgtcataccgacacccttagcagcttctatcatatctggatttatattactgattccggtataagtattttttataataggcaacattgagtatagtacaaccataattatagctggtacagaacctattccaaccactggtatcaaaaatcctaatatagctaaactcggtatcgcttgtactagattagcaaatccaattacaattttagatagctttttatagttagttataaatattcctaaaggtacaccaataaatacagcaattaaaactgctaataatgtgagttctatatgttctaataaaagtgagagaacttcacttttctttaaatataaatttacaaaaaaatcattcattaattatcccctccaatatctatatattgactactcaatactgaaatcagagtacttcttgttacaagccccataagttttccatctttattacatactggcaaatatccacgttttaatcctgtaaacttctctagtaaatctaataagttagtatcttctgtcacatattcaggtgaacgtctcattatgtcaccaactaatattgatttattatcacttttttgtatatctgataatgttacatatcctaataatattccttctttatctactataagtaaactatctacagtcttgtctctcattatttcccttgcttgaagaagatttctctttattgaaactatagctggattatttatcattacatcttctgcttttataaattctggcttagcccaaatcttatttcttcctacaaactcctcaacataatcattttctggattttttaatatattttctggagtatcatactgaattatttttccatctttaagtatgcaaatcatatctgcaatattaattgcttcatccatatcatgagttacaaaaacaattgttttattatattctttttgtatattgaaaagttgttcttgaagttcagttctagtaataggatccaaagcactaaatggctcatccattaaaattatttctgcatctgctgcaaaggctcttgcaacaccaactctttgttgttgtccaccacttaactctgctggatatctataaagatattctttaggattaagtcctaccatatttagtaactcaatagttttttgttctatttcgctttctgactttttcataagctttggtataatttcaatattttcctttactgtcatatgaggaaataatccagtctgttgaataacatatccaattcctcttcttaattcaataggatccatattatttatatttttcccatttatcaatatttctccctctgttatggaaataagtctatttatcattttcaataatgttgtttttccgcatccacttgctccaatcaacactactaatttcccattatctatatttagattgaaattttctaaaatagttttagatttatagctttttttaatatttttaaactctatcaccaataccatctccttccaacaactttataatatcaccaagttgtttcttctgtcaagttgtcagattttttaaattgacattctgttattgtattgtatatatttagtatagaaatattttatattataaatgaggtaagaaaatgaacaattcatcaattccaacatataaaaaaatagcattagatattgctaataaaatacaactaaacaatatacttgaaggtgatatactacatggtcgctcaactctttcaagcaagtataatgtttctccagaaacaataagaagatctatgattctcttagaagatgttgaagtagttaagactataaaaggtaaaggaatattggtgctatcaagagaaaaggcaatttcatttttaaatagaaataaatcaattgatagtataagaagttataaaactgaaatagataagcttttaaataatagaaaagaaattgaaaatcagttattaaaatcaatacaaggtataatagattattcaagcagatttaatgaagtaaacaacataattcctttagaatttgttgtccctgaaaactgtctttatataggtaaaacagtaggtgaaataatgttttggcagaataccggagctacattaatagcagtaaaaagaaatgatgaactattattatctcctggaccatatatatcacttaatccaaatgatgttttaatagttgttggtaatgataatatacgtaattctgtacctcaatttttatatccaaaaaataatttataattaaataatatatttttaactaatacattatttttaattatacatatatattataaataaaaataagtgcagatgtttaaatcatatttccatgatcctcatctacacttatatagttctagatgagcttcgcactatttatagtgcgatagcccaaataaactttatgtatttttaattaacctattatgaaacataattatttaaaacaaatgaatgtgttttaaatgattcttctataacttttttattaataattttacctttatgcatatagtcataagcatcataaacacaaagaagagctacattcatatttttgataaatttattcaaatcttcttccatctctaaaaagtcattctctgatgtacctttaattgcaaagcttggttgtccaatccatcttaaaccattatatttttcaatattactactccctagaatccccattgcagtttctactaaaccattaaatccacctttcttatgtcctaaaattaattcttttacatttttaaatttaatattttcagtagaaacattattactaataagaaaatctaataatttattatatagttcttcttccatggaaatatatattaattcattattttttattccttcatttatgtaaaaatataagtttactaataagtgttgttctccataataatagaatgttgtatgtgttccaaatacctctcttagatttagcttagataaatagtttatatttttattacaagaaacacatttataaacaaagttatctaaaaactggcttgaaagaactacttcatcatctaataaatctccatttctattttcaatactagaatttaatttttccttatattcttcaatacgattattaattttacaattatcgcatatttctttcataataatccacctccattatagttattgtcaataaaaaattatatcattatttattaacaatatatgtagatatttgtaaataaaagaaattttataccgatattattatacatttttctccatataaacttcttcttttttacatataaattataaatattaaagacacctacctactgtaagtgtctctttgcttattatataatattacaacttttctgtttgcatatttagtacttataatgcatccttacctctttcaccagtacgtattcttacgatatcatcagcatcataaataaatatctttccatctccataatttcctgtacttatttctttaaggaccttgtctattattttttcagctacatcagctggtactactgtttcaacttttaccttaggtaacaaattaacactatattctgtaccacgatatattgttttatatcctttctgatttccatatcccataacattagaaatcattacaccattagcattacaatcactcaagattttctttaaatcttctaatttttcactatttataactatctccagctttttcatttatactcctccattctcatctctatattaataaaatctaataattaaactttttctttgaatgtctttatttgttttatttcaatattatcagcagaataataatcaagttcaggtgattttattaactgaatatctggataagctgaaactcccatttcaggtatgtctaatcctgctaattcttcttctggtttaactcttaatccccaaactttatcaagtacctttaagaatatatatgaaactccaaatccccatataactaaaactgcaactgctattaattgagcaactaattgtgatggatctccataaaataatcctcttactcctccagctacaccattaattccatctccatatgctccatctgcaaacaagcctaatgcaattattccccatactccatttacgcaatggactgagatagcaccaacaggatcatctaattttaatttattttcaacaaaggctacagaaatacaaacaagatatccagcaacaccgcctatgaagaatgcacatggtccatttacaaaggcacatggagcagttattgcaacaagacctgctaaggcaccattagctgtcattgaaggatctggttttccatatttaatccacatataaaacatagcaacaagtccaccaactgcacctgcaatcattgtattagtagctacaactgctaatctaaaatctgaagaatttaaagttgatcctgcattgaatgaaaaccagcagaaaaataatattattgttcctattatagccataggaatatcatgtcctggaaatggtcttgctgttccatcttttttaaactttcctattctaggtcctataactattgcacttgataaagcaatcatacctcccattgaatgaactactgctgaacctgcgaagtcaacaacgccatgtccaagtccaaagttttgaccaagagtagctaaaaagcctcctccccaaacccagtttccaaatagaggatataaaaacattgatatgaaaaatgaaagtattataactgctgaatactttactctttcagctaatgcaccagttggaattgtaacagttgtatccataaacaccatttggaagaagaataatgcaaagatacctggatcatatattccattaccagataacataaatcctttatatcctaaaatacctccaagtccaggtattgataacattgcattcaaggctgatccaccagttccaagccctgcagcaccacctgaacctccaaattgaattgcaaaaccagtcaagaaatatccaatagctccaactaagaaaaccataaaattcattgtcattgtatgagctgcatttttgcctctacagaatccagtttcaaccattgcaaaaccacactgaaagaaaaacaccataaaacctgtaatcataacccacacataattagcaccatagtaagccttattagcagtagtagcaacatcagttatcgtttcatttcccgtcgtagcaatgtacgctgctccagttggatcagatccactagttggcgatatagctaaagcaaatgttaatgctaatgctcccaaaaacaaaataattcctaataatttcaatgattttttcataaatactacctccatactattgattaaatttttttattattaaagctctaatgttaatacttaaaatttacctttgataaatgaacttatttttctacctttttgaaagttaaaattactccaagaaaacttatacttattttttaaaagtttttcttttaaattacacactgataaataatatttaatccctaaataaaaaactaaaactccaaatacaataacactaatatttacccttaaaactttaattgatatatgattaatagcactgaaaatactaaaaaacattccaagaaaaactatcattaacgatacacactgtaaaaaatatactgctatttttttagataagattgaatcatcatttgaattaataaatttcattttattacctccaatcaaaaaaataagacaaagaagttcaggatccttttgacttctttgtcttattaattaattttctatttaatttttaaactaagtttaaggtttgataaaagttaagtcaaaccattttatacaatatcttactatttatttagtgattatgtttcccattatactttttagtatttcaagtaagcttttttattaatgcccatatttactactcttcaacttatttatcatactaaatttcgcatattaataatatatttctttcttgtaattatattcatttttcgtcgaaatgtgttttatttttaaaaaaactgtataaaagttttttaacttttatacagtctttaataaattcaatatgaaattttatagttcttcaccattagtcttaattacattttgataccagaagaaactcttctttctgattcttcttaaatccttaagatcaaattcatctctgttaacatagataaatccatatctctttttaaatccttcatgagtactgattaagtcaatagctgaccatggacagtatccaattaaatctactccatcagagattgctaattgagcttgttcaatatgctttcttaagtaattaattctataatcatcatttatagtatcattttcttcaagtttatcatatgctccaagaccattttcagttatgattaatggaagtgcatatctttcataaacttctcttagcgtatttctgaatccaacaggatcaatttcccatccaaattcagtcttttgtaagtttggattagaaacacccttgaacataccttgttcaccatgtccactttgttgatctccactagatctttcatttgtgatttcacctgggaatgcttcaactgtagctgtattatagtaattgaatgctataaagtctggatgtccacttcttaaagcttccatatcaccatcttctatagttggttcaattcccttttcaaccatgtagttccatgctgttggattatatcttccatgtacagccatatcaagatatagccagtttcttattgctgaacagttgcttgctgctaatatatcttctggttttgaacttgctggatatactgcacttatattaggagctggtccaattttgccatttggacacatatcatgacataatttcatagctttagcttgagctattaacatgtgatgattttgtttatataattctttttgaacattatcagtttcaattccgtctaaagtaccgataacatctccaacaagagtcatcatattttgttcatttatagttaaccaatacttaactctgtcaccgtagttttcaaacataacttttgcaaagtttacaaatgcatctatagtttctctgtttgaccatccaccctttgtttgaagtgctgctggtaaatcaaagtgatacattgtaactattggctctataccatattttaaacattcatctattaaatttccgtaaaactctattccttgaggattaatttctcctacaccatttggtataagtcttgcccatgaaattgaaaatctatatgccttaaatcccatttctgcaaataatgcaacatcttctttatagtgatgataatggtcactagatactttaaaatccggagttccttctggaattttcttgatatcttgtaccgatggaccttttccgtattctaaagatgcaccctcaacttgatatgctgatgtggaagctccccataaaaagtccttaggaaagttttttaattttttatgaaacataaatatcactccattcattttaaatcgatttcattaattatctgaacagacatatttttaactatattattaaagtaaaaggggtaacttattacttttattattaatggtcagaatttattcaagtctgctcagatattatatattattaaagattataagcttttttatttgtttttctctatgaacaaagtatatcacaaacatgattcaaatatagtatttttaagggtttagtgacattttccaatattaagtcatttgtttttttataaaacattgtgttttatcataatcccccttttaattaatggttaattatcatttaagttcgcttagtttctatattaaatactttactgtaaattttaacctttttatattgtatatggaaaatataggatgtataatacttctatagatttttacaaggaggtttataatgttaagactaagcagaaaactttcaaagctgatacttattgctatgagtatcaacataataaatactacaaatgtatttgccgcagaaaataattcaaatataactatttctaatggaattgcaactatttcatctaatgttactgaaatcgatagttctactttttctgaaaataataatattacaaaagtaatcattccatcaaatgtaaaaaagataggagaaggatgcttttcaaactttaaaaacttaaaagaagtaattatagacgatggtgttaaagaaataggttctgatgccttcataggatgtgaaaatttagaaaaaattaacattccttcaagtattacagtagtaggtgattttgcttttataggatgtagcaaattaaaagacgttgatttccaatcaaaaacaacgaatattggcggaagtacttttctttatacagcatggcttgataaaatgagagatgataatggattagtaataatcaataactcagtaataagtggtaagaatacttctgcttcacttaccattccagatggcgtaaaaataataaatagtcatgcttttgaaggctgtaacactctaaaagaaattaatattcctgacagcgtagttgaaatcagagattctgcttttgaagcctgctcaaacctttcaaaagtaaaattatcaaataaattagaaactattggagagaatgcctttagcgactgtaaattacaatctgttaatattccatcaaccttaaaaagtgtacaactttactcttttaatagtgatataacagttactggtgcagtagatttatacaatagtcttattaaacctcttaaaactgcaaaagaagataatctcaacatcttgttaagaaataaaccatatggatggggaaaggcaactgaatctggagataaaatattttataaaaactctaagggggaactacaaactggctggatggacttagatggaaaaaaatattatttctatagcaacgggcagcttgcaactggatttatagatttaaatggaacaaaatattactttgatccttcatccggaaataaccttggaaacttagtggtgggatggaaaaatatcaataataactggtattattttaaccaatccggagatggtgataaagttgctggattcatgagaacatcgtggctttatgatgacggaaattggtactatatgtatagcgacggaacaatggctactggatttataaatttaaacggagcatattattacttaaacaattctggatcaatggttacaggctggcagtacttgcaaaattcatggtattacttcaataaatctgatgatggtggacttgaaggcttaatgaaaaagggttggaacagaattaatggaaactggtactatttcaactacagcgatggtaaaatggcacatgatacatggattgatgggtattatgtaaattcaagtggtacatgtgtttaactataaaataaaagggggcagaaaactgctcccttttacctttataattctaacttaaaaatatttcatttaaatttaagaaaatttaatagactattttaatttaaatttactaatcatactttctaaagtttctgcctgtgcagataattcttcactagcggctgcactttcttctgctattgctaaatttgattgaactacatctgctatttgatctattccaccatttacctgttgtattgctacagattgttcttctgacgctcttgttatattatccacaagttcaatagcattctttgtattttccacaacttcttttaatgattgtgctgttgtatctgctatatactttccgccttcaactgattttattgatgcttcaattaattctgctgtattcttaactgcattagaactttcctctgcaagttttcttacttcttctgcaactacagcaaatccttttcctgcttctcctgctctagcggcttcaatagctgcattaagagctaaaagatttgtttgttctgctatgttatctatagtaattattacttcttttatattcttagatgcaacttccatttcatccattgccataagcattgattccatcttatcattgctttcttttatttgaagtcctaagttttctactattacatttgtctcttttgcatgtcctgtagatttttgcaccttttcatttatttcattaatagaagctgttaattcttcaattccacttgcttgatctgcagcaccttgtgatatagtttgagaagttgaagctatttgctctgaaccaccctttacttgagaagttgcttcgcctatttctctaaatacttcattcatagatgatattatatttactaaagagttcttaattcctataaaatcacctttatattcattttctaatgaaacatccagatttccttctgctatactatttaatgtattatctatttctaatatgtaatttcttaaattttcaactgtaatattaaatgcttttgctacttttcctatttcatcatctgtattaatttcaatagtatcacttaagtttccttgtgcaaccttatctgcaaataaacttatatcatctaatggcataagaaccttagttacatttttgtatatagccatagatattgctactattaacgctacagaaataagtgaaattaataatattattatatttaaaactttgaaaagttctctttcataaactacgtttacaactgtccatccagttgattcaactttttcataaaatgcaatctttttatttaatccatgtcctaattttactgttcccttatcttgtgagctcatagcattagataagttaatcatttctttatcattaaggtcatttatctttgttttaagaatataatcagcattaggatgcactataaaagttccatcatttccaataagcatgctgtaacccttattaccatactttaaatcacttacttttttctcaacagtttctatcttgatacttgctgctactccaagattaatattattcatataatcttttacccatgaaaacatcattactacattacttttatatgcttctgaatatgtaggtctgaatattgtatcataaggctcacctgtagctgagtatttttcaaatgcctctgcaacaatcccacttgcccatggtgatgtagcatttttaccagcgctgacattatagtatcgtgctaataatttatctgcattacttgaatctttccattgatttttatcaattgctgacaatacatgtattgctgcatattcattaggatactttgaatttacaaaattccatcttgctgtatttatttcatctatcttattagttatttcttcattatgtaaatctacatcttcataatcacttgccatttttcttaattctgtattgtatgaagattcctgaacctctgcaagtcttgtctgaatccatgaatcaatattatttactgcttcatcttgtttttcagccattaatccaataagatcatttttcacatacacgtttacgccaataaaagtacacattgtaagtattaataaacctactattactattggtaaaagtgtagttaataatcttcttttaattgatgttttgtcttttaaattgaatttaaagtttaaaatctttttcatgtaactaaatttccccctattttatattttcccttattctgtagtttttttatattctcccctttcgttaatactccataatttatgcttagagtatttattctatttacacacatttgttacttttaatttaaaatccaaacgaattcacctttaaaagtcactaatatcatctataaaaaattaatatatagagtgcaatttttgatttataaaagtttttcttggattttttataagtatcattgacataaatcaccaaaaatctgttgcgtagactaaatacttctaggttttcataaaattatggacaacctaaactactgcatcattactatgtaaatagtaaaacaataaaaaacgctatccataaaaaatagacagcgttgctaaacttaattagttaagttttgatacaataatctgattaattgttagcaactggctagcatagttttttaactttagctcctatagctttgcgtcattagatttctctaattttgccattaatacttattaaattattatgattgtaattaaatttatatcccttataaattacaatacatttcacatattaccattataatgcctatttttcaataatttcagtaattttcacaattttcgcataatttcttttgtataattttgaatttatagatattacaagattataattattctatttctccattaagtacacgattaattgcctttccaacacctgcatcatcatttgattcagtaacatatttagcaatttcttttatttcaggtattgcattttccatagcaatacaatttggaaattccttaaacatagaatagtcatttaatccgtcccctaaaacaagaacttgttctctattaagtccaaacttttctataaccttagcaagtatagctcccttagttgctttactatcattaacttcaatattagttataaagcttgatgaaatagctaatccactaagcttttctaatttttttctaagttctataactttcttttcactttcaccaaatgtaacgaactttgctattttgacatcactttttaaaaactcatctatatcagtaatataattcatattaataaaatgaggatttgcctttgcaaactttatatattcgctgtcactatttaaatccttatgaaatgtttttgctcttcttatcattcctcttagagtttcttcttcagtatttgtagtatagtaacctttatcagtgtatatttctactgaaaactctccagtcatcataacattaagaatttctcttactttattcttatctatataaattccttctataacattaccagctttatcataatattctccaccatttagagcaacacattcgcaatctaaattatattcatcaatcaaaggacgtacatcatcataagctcgtccagtaactatagcaaactttatacctctgctttcagcttccttaattgcttctaaattttcttgtgatatagtgtgatcactatttattaatgttccatccatatcagatgctatcaattttatcatcgtatttcccctaatgaattatattgtatatttaatcacttattttaccataacataaaaaaataaaataaggaattctaaaactagaattccttatttaaaatcactttcatatatcctttaaatttaataatttaatcctttcaattttcacactataatttgtgtaaaaaattcaattttactgaattctttttatattttaaatttaatttgaccaaagttcctcaccattagttcttataacatttttataccaatagaagctcttcttcttgtatctatctagatttcctgtaccatcgttattcttatcaacataaataaatccataacgtttcttcatctcaccagtaccagcacttacaaggtctatacatccccatgtagtgtatccaataagatctacaccatcctctattgattctctcatttgttctatatggtctcttaggtaatcaattctatagtcatcattaattgatccatcagattctatttgatctactgctccaaatccattttcaacaaccataagtggaatattatatcttgcataaattttattaagaactgttctaagtcctactggatctacttgccatccccagtcacttgcctttaaatatgggttctttaatccaagagtcatatttcctccaatgttttcaacctcttctggatgagcactttcacatcctgacatatagtaactgaaagtataataatctactgttccttcttttaatatttctaaatctccatcttcaattttaatattgatgttatgttctttaaagtatcttgctgcaaaatgtggatattctcctcttacctgaacatcactacagaaataattacttatttcttctttagtctgagctaatattacatcctctgggtgacaagtatatggatatattgcttcatatgcaatcatacatccaatcttaaaatcagaattaatttcatgtcccatctttactgcttttgcactagctataaattgatgatgaagagcttggaatctcatttcctcattatctttaatttcatttattgggcctcctttttggtcaagaagcataccacctccaaaaaatgatccaaaaggtcttgctaatatatttatctcattaaatgttagccaatactttactaaatccttgtatcttgtgaagattgctttgcaatatcttagatagcaatcaatgacttctctttctgcccatcctctgccatcatactttttagtcaatccatatggaaactcataatgtgatattgtaactaacggttctatattatatttctttaattctttaaatacatcttcatagaattttaatccttcttcatttggttcaagttcatcaccatttgggaatattcttgtccagttaatagacattctaaaagttttaaatcccatttcagcaaatagtgctatatcttctttatatctgtgataaaaatcaatagcaacatgacttggataatatgttccttcttctaattccggtgtaattcttcttggtatagtgtgagtaccacctgttaatacatctgatgtgcttaagcccttgccgccttctctataaccaccttcaaattggtttgcagctgtagctcctccccataaaaattcctttggaaacttattagtatattcttttagcatatgacactcccccattttctatttataatttagatatatatgttgcaataattattctgcatataatttcaaaaattatttaagaattttcacattaattgtcaattctcaactgtcaattgcaatatatattttttatttaattgtttacataacttatatctatacagtatcataactgtacataaaataaatacaaaacagtaatttagttacatatttcatactatagttatttgtttttttgtaaaacagtatgtttttaaccttaattttaaacataaaaatacagataacacccaaaactgcagtacaatttgagtattatctgtatttaaatcttttttcatagtttagataggttctatagatgccatacaaacatatttttcaatacatttatctataatacatctataaatatatcattatatttttatcttagtaaattgtgagtttacacaaatttatctttctatttcttttattctatcagcaaattgtggaagatgtttttcatgtgcaacaagcatttcatccaataatgattttgccatttcaccacttggaactaatggattgcttgtaaatgcttgaagcgctctattataatttccagttaccgctgctgaaattgtaagttcttccatagacttcataacttgaaccatacctcttggtgcagacttaaatgctccccatgttataggctgtggaccttctgctgttattatacttgatacctctactattgaatcatatggtaaatcagaaatagcaccattattcttagtacttactaccattcttgtgtgcttatcattatgaatagatgctataagctcacatgccgcatcactatagtgagttccacctctcttagtaagctgttcaggtttgtagtcaagcttaggatctttatataattcgaataattctgcttctgttttcttaactacttctgctcttgtttcacccttcttaaactcttcaagttcatcctttaacatatcatctgtactgtagtaatatctatgatatggacaaggtaatattcctaaatcttctatctgttcatagttaaattgaatatcttttatatttgcaactcctgcatccttcatttcaactctcttttcaggatgatatagcttttcaattatttctccagttctttcagttccattcttatcccaaactctgtgccagtggaaatgatttaagcctgcaaatttgaatattaaatcttctggttgtaaatcaagaactttagcacctatatgcatacagtttataggaacattgcataaacctacagttctttcccatccaccatattttattgcagcttcagttaccatacctgatggatttgtaaagttaacaagccatgcattaggacataattctctcatatcatcaattatatctaatattactggaattgttctaaaggctttaaacatccccctgcaccattagtttcttgaccgattattccatgacttaaaggaattctttcatcttttattcttgcatctaaaagacctactctgaactgagttgatacgaaatcagcatcttttaaagcttctcttctatctaatgtaagatacactttccaatcaagacctgcagccttaaccattctttttgccatttctcctactatttcaagtttttctcttccttcttcaatatcaacaagccataattcacttattggaagttcatcttttctcttaataaatccttcaattaattcaggagtataactagatcctccaccaatagttgctattttaattttcccttttttcatgactgtttccccttaattttgtctatattatttaattaacaattaataatttatagtttctaaatttcaattagagttgaaatctttacacagtttcctgaatctattacatgatttttatataaatgtatctattccaacatcttttttgaaatgcttttcatttcttgtatataaaatatcatattcttgagataaatactttaatttctacaattttggaacataactgtattaaaagtcatttgttttatgaaaaaacagtatgttttttataactaaaaccttgtaagatggctataaatcctcatctgagccattttaatttttattatttttactttaaaaacaaaaagcaaaggtctgccaaattggctcctttgctttttctaattttaaatattatacctagtatatatcctatattttatatgaaaacttttttaaagttaaatgttggtaaatatattcaacttagattttcaaaaaataaatactaaataattataataatgtgagtttctaattataaaaaatatatcattatttctatcatttgataaacaactaatgctaccaacatttatttataattaagtttttattataaattaacattaatcctagtcattctttaaacaaaaccttcaatttttttcattcttatatatgagttttctattatttcttttggatatcctatatactctaaaagcttaattgcatttcttgttttagatactcctctttttaatttataatcaaattttaatccacttttactatctacttcttcactaaaataatagaaatcataattttcttttaacatatctgaaatttccctatcatgagtagcaacgatacaaatagcatttcctttattaagatatctaagtatttctgctgaggaagcaattctttcaattggatttgttcctctaaagatttcatctattgggcaaaatactggaatatccttttgagaagcttttattattcttaaaattgattctgcttcagacaagtaataactctttccattaacaatatcgtctttaggacttattgatgataccatattaaaaaaacaggcttcatattcttttcctaaaataaaattaaaagtttgtgcaaaaagtatgtttgtactcaccatccttaaaaaagttgatttaccagacatatttgttccagttaatacgacaccttttcctgatatttcaatggaatttgaaactggattcttaagcaatggatgtaccccatcttttatttttaatgaagtttccttgataaatttaggcttgctatatttaccctcattattactttgataaattgcaattgaaactaaagcatcaatctctcctactaaataatataattctaatattgtatcctttttttctattaattttccgcttattttataatatatactttcttgtataaaaaaaggaacagaaagcatgtctataattccccaaaaagaattagtaagtttaagtaaatatgttgatttatctatagtgtttaaatcatttaatatttcttttatttttccagtataggatttaacttcatcattcttattattacataatatttgtcctgcatttattagttctcttaaataaacaattcctatggcatttatagtatcacgctctttattgtgtacatatatctttatatatatatcgaacattaatattataatcattttaggctctctcaatattattgctgctaaaacccaaagtataggagttaatccgaaaatagtatacaaataatattttaatttgctcactgaaagcaatccgcttatcatttcaattaatctattttttttatcataacgcatttcaaaaaatattcttcttaaatttactgttaactttgtatcttttttaaataaatcaattaactttcctcttttattaagctcttcttcattaataattggatttctaagcattctatataaagctgcttcaccttctgctgagtaagttgaatccaattcattaaatacattatccattattaaatcattccaggtttgatcatctatagtaaaattatttcttttactataatcaaacagtaattttattttatttaaatcccttcttttactcttagttgaatatagatcatttttcaaaaaactttcactaactgaaatactcataaactcactcttttctatttataatattactactattaggcatagtttgaacccctatgtttcccataacttaagtttatatttaacattaaatatacttgtcttaatgcaacatattagagtacatatttataatcccatacataatatattttttatttacaattcataatatatcattttgaacttttttacaatttatatatttaaagttaataatacaacttttttaatattcaaaattatcctaagattttacctcaatataatttcataaagaataaaaaaagtatcaaaatataatgttgaaattatattttgatacttttgagtaattctaaattttaataaataatattttcacctaagtctcaataaattataatagtttgtgttagttaatatctatcttttataattacattatacttctgctacttcagcattctccccatcttcttccacatctgcttctttagcaacaaaataaactcctacaataactaagatactacataatattgtttttaaacttatttctgttccatttatgaatctatcaaacactattgaccatactacatatgttatatttattcccattgctcttgttggtcctattctatatattgcattgtagtagaataaatatgatattgttccacttaatgcagttgctgcaatccaccaaattacatttgttcttaaaatatcaaagcttaatccgattccacctactattggaactataagaattccatatactacagctgaagtaagttgtcttatctgaagagcaaattctgaactcacttcatcatctttcataccatatgcacaaattacacattcacttccccatcctattacacaaaggaaagcacataaaaatcctgctatgcttattcctgcttcacctgaagaatatccaagaactgtaactcctactattgcaaaaagtaatccgatccacgcttttttatttaatttctcttttaaaataaaataagataaaatagctccaactgctggatataatgaagatataatggctgtataagatggtcctataagttttactgcaagtaaatatccagtcattcctattggtccacccataagtgctgctattacaacaaacattgcacttttggttttcattgctttaaataaacttccaagttgccttttacctgcaagatataagaatgtccaaattgctgagaatgcatcatggaaaaatgccgttacaaacggtgctaagaatactgcttcctttggtaaaaatggagtcattgcaagaactaatgacattaaaactgtatccaatccccatgttgcagctgatataacaccactcataactccgattttataattgcttttactgtttaacatgtataatcccccttaatttataattgttatattgtctcttatactttcattcataaatatcattcttattaattataaaaaatattcatacaatattttaaacttaaaataaaactctcaatattaagaacaatgcttgaccaaattttctaatatgcttgcaatatgtgtttcatcattattatttaatgattaaacacatatcaataatatattttgattcaaataaaactcaaatcttatttgaaccctttttgttcaaaatgcaaagttcattttatgaacaaaattatcttatcattgttcaatgttcaattcaatatgttcagcaaagaaaaaaataacttttgtaagttctttcaattatttttaatttctaatgataaatagcttgttttagaaagtactttctaaaacctaaaaattattgaaaatattttcaatagtatttatactatagttacaaaatacttcaagaaaggagctgagaaatatgaatcataatctagatagtttaaaagctagattaatagtttcttgtcaagctcttccaaatgaaccactacattcttcatttattatgggccgtatggcacgagctgcaaaagaaggtggtgctgctggtattagagcaaatactaaagaagatattgcagaaataaaaaagatagttgatttaccaatcatcggaattgtaaaaaaagattatgctgacagtaaagtttatataacaccaacaatgaaagaaatagacgaacttatggaagttagcccagatatcatagcacttgatgctacaaacgatttaagacctggcaatattacattaaatgaattttataatatgataagaaaaaaatatcctaatcaaaaattaatggctgattgctcaactgttgaagaagcagtttatgctgacaaattaggatttgattttataggaactaccttagtcggatacacagaccaaagtaaaggttatcacatagaagataacgattttgaaataattagagacattctctctaaagtatcaaataaggtaattgcagaaggtaatataaatacccctgaaaaagcaaaaagagtcattgaacttggatgctttagtgtagttgtaggatctataattacccgtccacaactcattactaaatcctttgtacatgctttagaaaacaatcgataaaaagttaataaataattaaatataaatttatatgaataatagaagggatgctgattattatgaaaaacaatcaagatatgaaaggtatttatagtgcactattagtttcatttgatgaaaatggaaaaataaatgaacaaggagtacgtgaaataattcgtcataacatagataaaatgaaagttgacggattatatgttggaggaagtactggtgaaaactttatgctttctactgaagaaaaaaaggaaattttcaaaattgcaaaagatgaagccaaagatgaaattaaacttatagctcaagttgggtctatcaatgtatatgaaagtgttgaacttgcaaaatttgttactgatttaggatatgatgcaatatctgctgttacaccattttactataaattctcttttgatgaaatcaaagattactacaacacaattataaatagcgtagataaccgccttataatttattcaattccattcttaactggtgttgatatgagtgtagaacaatttggtgaattatttgagaatgaaaagattattggtgttaaattcactgctgcagatttctacttactagaaagacttagaaaagcatatccagatcacttaatttatgctggatttgatgaaatgatgctacctgcaactgttcttggtgttgatggttctattggttctactttcaacgtaaacggaattcgtgcaagacaaatttttgaattagcaaaagaaggtaaaattaatgaagcattagaaatccaacatgtaactaatgatttaatatctgcaattcttggaaatggattatatccaactataaaagaattattaaaattatcaggtgttaattctggatactgtcatagaccaatggctagtgcaaatgaaaaacaagtagctgtagccaaagaaatctttgataagtacttaaaatagccatcccctttttaatatatatcaaactaaaaattttacaacttaatattaatctcatactctcataattttacaacttaatattaatctcatagtctcataatttaaatagatagcagaaaataatttaattatttttctgctatccacaatatacttaaaaaaaatcatcaagtaggaggacttaatttatgcaaggttttacaaaaatagatttagcaattttagtgatttatttagcagctgttttattcgctggtctatacttctctaaaaaagaaatgaaaggtaaagaattcttcaaaggtgacggaacaattccttggtgggttacaagcgtatcaatatttgcaacattactaagccctatttcctttttatcattagcaggtaactcctttgcaggtacttggatcatgtggtttgctcaattaggtatgattttagcaattccaataacaatcaagtttttcttgcctatttatagtaaattagacatagatacagcttatcattatcttgaaataagatttaaaagtaaagcactacgaattttaggtgctgtattatttataatatatcaaataggacgtatgtctataataatgtacttaccatcaatggtattatcacacttgactggacttaatgtaaaccttttaattatcgttatgggtgttatcgcaattatttattcttatactggaggtttaaaatctgttctttggacagacttcatacaaggtacagtcttattaattggtgttacatttgctcttttctatctagcaaatggtattaatggtggatttggttcaatttttgactctttagcaaatggtaaatttataggtgctgatgaagttatatttgatcctaatatattaaaaaacagtttatttattatccttgtgggcgctggtattaacacttgttcttcatatatttcaagccaagatatagttcaacgtttcacaacgacaacagatactaaaaaattaaataaaatgatgttaacaaatggagctttgtctatatttattgcaactgtattttatttaatcggaactggattatatgtattttacaatcaaaatcctgaattagctcaaacagtacaaagagatcaaatatttgcttcatatatcgcttatcaactaccagttggtattacaggattactattagcagccatttatgcagcttcacaatctacactttctactggattaaattcagttgctacaagctggacacttgatattcagacacgtttaactaaaaaagaaatgagttttgaacttcaaacaaaaattgcacaatacatttcattaggtgttggtataatcgcaattttagtatcaatggttcttgcaaatggagaagttaaatctgcatatgaatggttcaacggcttcatgggacttgttttaggtgtacttggtggaacttttgtacttggaacatttacaaaagttgcaaataaagctggagcttttgcagcacttactgtagcatcaattgttatgataattgttaaatacaaaatgccagaagtatcaatttggtcatactctataatttcagtttctgtttcattgatagttggaattcctgtaagctacattacaagaaaacttagtaatgacgtttcagttcctaatatggatgcaactatatataacaaataataacatacataaatttataattattaagaggtgttgaatatgatctttggaaatgtaaagaatttaaatgaatttgattatttaaaagacaatataaagaaatgctttgaatatgcaaaagctaatgatttaaacacttacgaaaaaggaacctacaaaattgatggggaaaacctttttgtaaatatagtagaatacacaacaacagaaagtgaaaatcgtttttgggaagcacacagacaatatcttgacttacaccttatgcttaatggtattgaacaaattgacttaaactttattgataacatggaacaaaaagaatttgtagaaaaagatgactttcttcctttagaaggacaagaaaattctcatgtaattttacataaagatgattttttaatctgctacccaaatgatgcacataaaactgcaatatgtgtaaatgaaccagttacaataaaaaaagctatttttaaaattattatctaaaatttattttaagggatactataaagcaatttatagtactcccttattaatctataattacaaattaatctattataattattaatctttattaaaacaaagacttttcagtttttacagataaaaactttaaatattataattgttacttaaaattatataattataagaaagcaggtgtttaaaatgaaattctatgtttcaattgatattggaggaacatctataaagcatggtatcttagatgaaaatataaaatttataacctctggtgaagtagcaactgaagcacaaaaaggcggtaaaaacattctagaaaaagttataaatatagtatctgaatataaaaaagaatatactctttctggtatctgtatatctactgctggtatggttgattgcgaaaaaggagaaataatacatgcttcagatttaataccaaattatacaggaacacaaatcaaaaaaactcttgaagatattttttcaattccatgtgaagtagaaaatgacgttaattgtgcaggtttagctgaatatttttcaggaagtgcaaaaggaagttctataagtctatgccttactatcggaactggtataggtggctctataataatcaatgataaagtcttccatggcttttctggaagtgcttgtgaagttggctacatgaacatgtttaagggtaaatttgaagatctaggtgcaaccagtattttagtaaaaaaagttgcaaaactaaaaaattgcagtgaaaatcatattgatgggaaactaatctttgaaatggctaaaaataacgataaagactgtataaaagcaatagatgaaatggttgatgttctaggcatgggaatagccaacatatgttatgtaataaatccagaagttgttgtgcttggtggtggaattatggcacaaaaagattatttatatgataaaataagattaagtcttgataaatatcttattcccactataagttcaaaaactaaattagaatttgctaagaaccaaaataaggcgggaatgcttggtgcttattataacttcataagcatccataaggattaaatcattaaataaaaaagcagattcacattaactttttataggatttggagtcaataaaaatgcaacagtatgaaaaaactataattccaaaaattgaatcgttatatgaaaattttacgccacttgaaaaaacaattgctaatttttttattcacaacacagaaaaaatagatttttcttctaaaaatatttctaagaaactatttgtttctgaagctgctctctctagattttctaaaaaatgtggcttcaaaggatatagagaattcatatttttatatgaacaaaatttcgtagaaaaaccctctaatgttgctactaattatacaaaacaagtattagatacctatcaggaacttttaaataaaagttatgctcttttggatgaagagcaaatggtgagaatcacaaaactctttaatcaaaagaaaagagtttatgtatatggaagaggtagttctgcacttgtagcacaagaaattaaactccgctttatgagaatcggtgttaatattgaatctattgttgatagtcatattatgaaaatgaactttgttcttttaaattctgactgtcttgtaatcggaataagtgttagtggaaaaactgatgaggttttagattcattaaaagctgcaaaatctcgtaatgctactacagttttaataacttcaagaaaagaaaaagaatttgaagagttttgtgatgaaattatccttttagctgtaaaagagcatttagataatgggaaagccatttctccacagttccctatcttagtaatggtagatatcttctatgctcactttcttcagtctgataaatttcataagcaagaattacatgattatacacttaatgcacttcacaataataagagtatgtagacaaattctacatactcttattaaatttttattttattaacaagctaataaatttacatatattagttattatattgagtccatgaaccattttcataaatcatcttatttccatttgtaagtttaaatcctttttgtccaactcctggattttgattcttaccatctgtgaaaattacataagcatcttgttcccaatctttaagtgtatagctatataaaccattactttctttagtcattgtaacacctggccatgatgctagttcttttttaggacttacatcttcattataaatatatacttttacgctgctccaaccatctggtgctttacaatatatttttgactctgctattttagcagccttagtataagtgtaatttttcacatctgtatttgttccattgctaacctttaatgttaatttaattgcctctcctggctgtgcattttctcctattgtgatcttatctccatctttatattcaatttcttcactaccatttattgaataagttgattttgttccatttttacttccaagtgtcaatgttaatgaatcatcaaattcacagtcttcttttgaaattgatgcacaaggatttattttttcttcgtatttactccaacttccattatcataaatcatattactaccatttgttaatttaaatcctttttgtccaactgctggtgtttgatttttaccatcagtaaatattacataagcatcttcttcccagtccttaagtgtataactatataagccatcgctttctttagtcattgcaacacctggccatgatgctagttctttcttaggagttacattttcattatagatatatgccttaacattactccatccattaggtatcttgcagtatatttttgattctgcaacttcagctgcttttgtataagtatagctctttacatctgtatctgttccatcactaacttttaatgtaactttaattgtatctcctggctttgcatcttgacctattgtaattttatctccatctttatattcaacttcgttactatcatttattgaataagttgattttgttccatttttgcttccaagtgttaatgttaatgaatctttgaattcacaattttcttttgaaactgacgcttgtggtttatctgattcaacatattcactccaaaccccattttcatataacatcttacttccattttttaatgaatatccatcttgtccaactcctggatcttgatgttttccatcatttaaaattatttttgcatctctaaatcctgttggtaaactataactataaagaccatcactttccttagtcataggaacccctggccaagcctttacctcatttgtagtacttccatctttattgtacacataagcatttaagccactccagctatctggcttttgtacataaacctttgttgtaaaattaggatttctctttgtataagtatatgtctgagatgcttccccatcagaattggatgcataaactgaaactgtagttttcacatcatatgatgtgtcttttccaattgttattacatctccatttttaaattttacaggttcttttccatcaatagaataactaccagtatcagctccactaacacttaaagttaaatctaaagtatcagaataatactcactgctaattttgcttattgaaacatctggagcattatcacctttttctattaatataactccattttcatcagctttaaagttaaccttaccatctttaaccacggaaacgttaccagtatatgcatctttaacttttgctccatcattaaatacaccatttacatttacgcttgtctctccagatgccccaactacgcagacaaccttatccataattccatttttactatacactcttccaaatgtatatggactttcatttaaagtaatattttgtcctgcacctacagcaaggtgattatttctaaaatctccaactttctgccagtgctctaatgtcttagctgcatcactatttggattattaatatcatcccagttcataaaactacggaaacactgatctttataatcacttgtaaatctatctgtccatttaagaggtcttcctgattcatcaccatagaatatttgaactgcacctggtgcaagtaataaagcagttccaccatctctcaaactttttctgtcatataatgagtcatcgtgagaagatatataacttaaaacattaaaatcatcatcattattaacactacttaagttatcataaattcctttaagattagatatatttgcacctttgaatccaaagttaatcattgcgctaaatccgccttcagtaaagaatgcatccttctttacaccatgtccccaagattcacctactgtccaaaattcagcattttcatctaaaactttgtcttgattcttttctttgtattcatcaaatgcaacacgtgcttctttatttaaagcagcccatgaatctaaatctacttgatttgcagtatcacatctaaatccatcaattccataatctcttatataatctgttaaccatttaataatataatttctaggagtttttggaagatttctttcactaaagaatttatttaaacttgccatttcttcatcgtatctgccttctgctttccacttattttcaagtaatggaggtagttctacttctttagtgctttctgtctttacgtctggtaaaccacaaagggatgatgtccatccatctccctgtggtgtctgaggatatccgtcatatcctgctgaacttcttacaaagtcaggaccccaccaattattcttccagtttggagatgttttatcataataagttgtatcctctgtgccacctccaactaaatttgttagaggaccataatagtaatctttccatccatctttaagccctccaaatccatattcatcagcatctttcatagttgtatatccaacatggtttaatactatatccataacaactcttattccatgagcatgagcagtatctacaaattttttcaaatcatctttcgtccccatatttgcatcaatattagaataatccaatgcccaataaccatggtatgaataataaggaaaacctttaccattacttgttgcatttccccctgcatcattacctgatgtaaatccatgtatctgttcatatggtgcagtaatccatattgcattaacacctaagtcatcgaaatatccttcttcaatcttttcagtaagtccttttaagtctccaccttgaaacgcacctggattgcctttataaccatcttgtatctttccattttgatcaagacctcttccataagagtaatcattagatgaatcaccattattaaatctgtctgttaatgcaaaatatacagttgcattatcccaagaaaatggtttttcggtaccgttaccagttttcccaatagaagcttctactggtgttaaagtcaatacactagcacaaactatagctgctgaaataatgtttctcaattttttacctttcattcttgctccccctcaactttacaataaaaaagtaaatttactaatacttatttttcctcctttctatgatggatgctataacaatataatcttgtttattttattgctatagaaatatattaaaagtcaataattataatattattaacttaaaaacaaagtatttaaattatttatcaccactatgtacaacaacattctgtttaacgttttcatctttatatttgtataatataactatttagaatatttttcaagctttttttgtatttttttcaatatttttcctataatatttatagatactagatatattcctctgaatattaagcattccataactaatacatagcttattctttttataaatataacccttactatcccttgtaaagcacataaaatcagcattaaaagattttatatttacagaaacaatttatatatggttatactaaatatttgaatatatgcacttatgaggtatataattaaacaaattaacaattgtacattattatgtacaattgttaatttagactatgatttttagagatagtgaggtaattatttaatgaaaaaaagaaagatagatgaacaggcagaacttttattaaatgaatttaaagaaatgtacgaacctaaaaacaaaattattgatgatattatattgaaagaacaaaatgaattgagtaaaggtgaaattccccaggttgttttacagcatttagtcggtgcaatttatcgaataatttttattgaaaaggtcactattggagatagagccggtgaaatcttaaaagaaatggataagctttcaagatcaaatggctattttttaaatttcttttatcgactttaatacttaaaaagagataattctcaatgttattaacttgcgaaatatgaaataatggaactcattttcaggagttccattattatatgatatatgatcaacacttttccttaatataaactaaatattatgcttacaatcaaaatataaaatcatacttttgattgtaagcataaaatctaatcaagctgtaattcaccatttttattaaatctaaataaaataccatctatatttaaatcacttgtttgcatttgtccattttcatttaaataataccaatttccatgatctttaaaccatcctgttctcattgcaccatttaaatcactataataccagtttccatcatctttaaaccatcccactgccatatttcctgtctgttttaagtaataccagactccatcctgctgagtccatcccctatataatgacccatcttcattaaaatagtaccagtcacctttatcttctagccagccacgttttagctcatttgttttaccatctaaatagtaccatacctctccatttttaatccatccagtcataacatcaccagatatataaaaatcaacagttatgcttccaattatatttttatcactttcatcataaatagctccattaacacatgctattccactttggacagcggttacttctccattactgttaacaacaatactattattttcactagtactccaaataacatgattatatattttttcatctaaaacagcttcaattttgctgctatctccaacctttttaacattctgaagtcctgtcactttaatttccttataattaatattgaatttgtacatttcatcattagtaagtttatttattattcttattggattttctcccttttttaagttaacatctaaaacatatggtcgctcattagatattgatcccactattgaattatctgtcccaacaacaatataattgcttatatcaacaccctctttagtgtcaaactgtatttgaaccttatattgattatttataacatcagctttaaactcattatgatctttgctagtaattactagtggctctcctgtttttattctaaaattgtatatatcctttgtattgaaagtctgatttgccatttcatctttcaataaatcatcagatttactttctgcacaataagccctttctgaagtattaaaagatacacatgtagtaatcgaaaaagaaactactagtaaagaaaaataccgaaataaatttttttccataaaataacccctcccaccttttgttaatttttcccataactatattatataatatacttatttttttacaactcacagcattcgatgggttttgctattatacacgaccatattttatcattgttttataataaaaataagcttctacgaaatatctatataatacctcataaaagcttattttttcaccttaaaattgattactttataattttaaattttcttaaaattttatgcgataattcaaagaaagtttcatcttttgttattattaatattgctaaatatgcaagaccgcatgccataacttctaaaatgcagcatataaaaatatttcctacaaatttctttattacaaatgtaatcggtataaatataagagaatataacaaatactttgtattttcatatgcaaataattcaatatccagctttattacttttcggactagcctgtattcaaggaaaataactattaaattagcaatcagtgtagtggatatagcagttaccatattaaatgttccggtcacaactaaaagtacatttaatcctaagttaattactcctccaattaatactaacattgcatcatctttttccctaccatgaagatatatcatctgatttgcaattacgccttccacacctatactaagcatgtatattgagaataccaccattacaggaactgctggtaagaatttggctccaccaaacatatatattgcttcttttgaaagacacaaaagacctattgatgctgggaataagaataaaaaataaatctttataactcttttaagaagacttaaatactcttttttcgattcatttcccaggtaatttgataatcttggcatagtaacttgaataactgtaagcattaatgtatttattattgtcattattctctgggctgtataatagtatcctacatctgttgttccagagttactcttaatcattattttatcaagctgagtatataacactcctgtatttgacaatattacaacataaagcatcggtcttatatgttttgcaaactggaggtctgaaaaatcaaatttaattctcttctttacataaacaaaacttattatattattgataaagttaaaacctacaactaaatataaatagaataaataatccttatcacttcttacaaatagcaagattaatgcagaatatattattcttactatcatagtctttattgcaataaaatcataattctctagagcttcatttacccattcaacatagaacatattaaaaactaaattaaagcccataattatgcaagtgtacatatatggtttatctctatatgaaactgctacaaagatcatatatacagctgatgcaattatattagtcataaatgtaaataaacataaactggtgaaagtttgtcttaatttctttttatcatcacgtactttacttatctctctaagtccatactgatatatcccaaaacttgcaaagataaggaaatatgctgttaatgaatctccataccccatgtacccataaagatctgggcctactgatctagttacaagtggaattaccataataggaagtattatattgaataagtttaacattgctttaaatatagcgttttttgacatagatttagccattgtaattagcctccacacttttcaacttatttgtttctatattttatcttatacaagtttacattttataaaatatattgtcaatttctttaggtatatgaaagaaaataacaaatccaaatatgaagaaaatgcttttttgatacttatatttttcatgtcattatccccaaataaatacctatttttatgtttttaaatctatacttacagctctttttctatttccattttttatttaacttttttgtaaaaataatggactttttactatttttagggtataattaaactaacgtttgttagtttgaagaaaaactgaaaaacaccttattttcttatggatttttttaaacacaaatatataatattagtattttgtgtttaattttataatatataaggtttaattaatctattatttagttaggagatttagaatgaatactaaagaaaagattttatctgtggccttaacactattttctacaaaaggatataaagctgtttccgtaagacacatcgcttctgatgttggtattaaggcaagttctttatataatcattttgaaaataaacaagaaatattagatgaattaataaaaaaaaacaccaaatacattgaggattttttaaaagatgcaatggatctagattcttttattgtttctaaaaaatataatcgcaaaaaacaatgtgatattgattttatagatacgactttaaagatagtgaaattttttatcgaaaatgataatgtcataaaatttagaaaactgcttacaattgagcaatttaataatcccactttatcagcattatataaaaaatatttatatctgatatcctggaatacgagtcaaaactttttagctatcttatggataaaaatcttttaataagaaatgatccttatattttggcgctacagtttttctcaccaatttttttattattgtataacgatgataaggtaactttagaggattactcaaccgttgaaaaacacatttttcaatttaaggacatctatagtatgaaaggatgatttgcttgaatgtaactattatttacgacaatttaaaagatgataattcatatgaccatattaattttttacttaaaaatctaaaactaaatactccaataaattgtacagaatactttttaccaactgatttttcacttcactgtaagcattattgtcaatgtattataggaaactgtgattattttaatttttgttctgttaacaagatagcaaaatctataagtgattctgacctgataattttagtatgttctagcttaagaaaatgttttctaccaccttcacttaagctgctcatagaacatctatcatatatatggatgccacataaaaatcacataccaatggctgataaaataggtttagtaatttcaaatgattatgttcctcttttgccatctacaggtcgtactttaaaaaagcatcttaaattctggggaataaaaaatattcttaagtttacatcgcatgattcatctaagataattcccaatactaatctgctatcaaaagactatattaatttactaacactatcaataaaaattatgaatatatattcttccaatcatactacttcatcgcactctggaaatataataaaattcccatattcacagttgataaacaataaaaagtttttatcaaataacaatcctactgataatgttattcctctaaagaaaattcaaaatgatttatagattccatattgaaattaaaatacttcatttcaaattaaaatgattaagttgttttataaaaaaagaaccctttaacttataaagcactgaaaatttcaagtgtttcagtgctcatataattttaagagttctttttaatctttgtatagttcagtatgatttattaaaaattttactatacagttatttattttattgaataattagattttcaatatatgtttttttaatatatattctacatctaaattcaataaatattttaagactgttctatttcatttttaattgttaagtagattacatattattaagttttgattttaaataatctaaatcttcaagtgtatctatctcaaatatatcatcactattaattttttctatatatacgttcatattatcatagttttcaacagctatattatcccaatatatatcaaataacttatcttcttcaacagcctttttaactttttcagaaatgattttcccatctttttctgtccaataagatgcaccagacattatgtaacttgctttagaattcttaggcgctatttcaacatcatatattctacctgtttcagtatatttaagtatccattcaccagttatattttctttacatgctgagtaataaactgatgtctttggttgaacttttggtaaaaagtttcttgtaatatagttatctgcatcaattacaaatgcatcttttaaataatctcttacaagatacatagtatatatgttattatacacatcatatttatcattaactacttttataagattatattttttaactatatcatcaaatttctcatgaagatatccagttaaaactataatttcttcaactccaatttctcttaaattgattatctgtctttcaagtagaggcattccattaacttctattaatgattttggtgtattttctgttaaaggtctaagtcttgtgcccattccggctgccattaatattgctctcatttttccaactccatatccagtttattctcatttgaattacttgtattaacaagcttaaaggctctacaacaaaatgtgttcttgacatttaaaataacaatattatttaagataaaaaatctatatttaggcatcataatattaatatttcttgtcaagtacactttttaacgatgattcaatttaaaaactataattttttcaaatattccttagctctattatatctgtctattccatatgttccaaaatcatcgccttctgcttctttaataagagtccatactgcccataaagtatcctgacaaatttgatgaattaacaatcttcttctagaattttcatctggttcttcaccattaaaatataatctgaacattaattcaatatcatcttccgaaaactcattttccaatgaaagtgccgctagatcccacatatcatcattaattccactgtattcccaatctataagataaattcttccttcagtatctttaactaaattttcagacacaagatcattatgtgatggaacaaaaactctgtcacatctttgtaattcttcttcaagtgccattaccttttctcttacttctgcataatcatcaaagaactgtccttcatcttttcttaatatttcttcatacttttctaattctctgaacatgttgaattcattatccatacggaaatcttctgattcatgaagatctcttaatatctttgtaacctgtcttaggttttcttctttttttacacttctatgagttaatgtttctgcattttctataaatttagatatttttactccagtttctaaattaaaatatggaacttctacattaaaacctttttcagaagcaattgcagagttgaacatttcagtatttctattaatcatctgctcagttccagttcctgcaactcttaagatatatcttgttccttttacgcaaattctataattcttgttagtcattccaccagctggagtaacttctgtaatatcttcatcttcaactttgaaagcttcacacactattgattttatattatttatttcataattaagctctcttcttcttattgtaggatataagtagttctttatcttttcatattcctttatagaatcagcatctccccatgcaagatcatctattttaacaaatcctatattataatttcttgcaacatctaataatacatattcatagtttaaataaggattcacattccccttgaattcttctagcatcatttcatataacttatatgaaacttttgtaagccctatcatttcaccatctattctattaaattgatgtatatcttttgacatcttatataaatgattatctcttatttcaacaaaagcctcatctcctgaaccactttcattggtaaataatatacaatctctatttggactttcagaaagttcttttatagctctcttttcaaatataagatcattttcaattaataaaaagtcatcatctatgtattctttagcaagtgataatgaatgcattgttcctgtccatttataaatatcactttttacaattttaatatttctgctgtttttaaaatactcttcaaattgttcactttcataacctgtaactaaaactatttttgtgataccattttcctttagtatgtttagtgttctatcgattaatttaaagtcttcaatttcaagaagtccaacaggctttccaaagtgttctgctctacctgctgcaagtataactgcttgctttactatcttcttttcttcttcatgtagttttaatcttgtattttttgcatttgcaatgctttcttctaagaacttcattcccttatccgttactttatataaaatccctctattatttactattctatctatgaaattatcttctgtaaattcctttaatactgaattcacttttccaagtgacatatttgttctttttgataattctctctggttaatattaaaattttcatttaagatttttaatatttctaatctatcttctaacattgtaccctctcccttaaaacctgttaattatcttatgagcaaattactaattataagttaattaataattacaatttaagaattataatttaattattaatcgtaatttaagaattataatttagttcttaatcttaactcaattactaatcttaatttaattaatcattatgaagtaatcatatttataagttacttaatacttattagaaaaattaaataatattaagactattataaataacttgccattaaataaaatttacataacatagtaaatctttgttcgaattttgaactataattattatattcccatttattccaaaagtcaattttattttattcatactaaactatttattttattcttattaaatcattattatatgcataaaaaatcaacattaaaaactcaatttctaaatatatgtactcaaacccaattttcactaagcttaagctacctaatataatgttattttatgcccataacctttttaaaaataattgttgttattaaatacatataatctcactgttgaatacataacattcataaaaacaagttattcacttcataattaaaactttttatattaaatgttttaataattttcaatatgagtttttctcagttcattcacagatgtataagatccattttttaaaagttcaaaaaagatactcatataatcaaaaactttttctgaatcaattaatgaataaaaattataataatgatttatatattttgtagcaattcccttacatcggctcaaccatgcagttaaataagccatgatatttttctttttatcttcttttattttatcttctattctatttcctataatttttaatccatatttcttttttgtttcatttgaaagttttttattgtattgtagcaaattattctttaattttttatttgtaaaatgatccgtacgcatataacaatctttagctgcaattttcaacacattattattaaaattatttactattgtttcatcattttctgttcttcttattaatggcattttcccactttcttctgctataagtacacttacattcctaggtacaagtccatacattttatcaaatttattttttactttatcagcatatgtataatttttatttctgcttcctttataacatttttctgtatagtaagtatctacatcaacaacctcatcaaatttttctggtttatagttattttcaatggcatgaaatattttatgtctccagtaaaatgctgtcactattgatatttctaatttagctgcacattcatttaatgttgtatgctcacccataagctcaataaactcaaaccatttctcaggtttatgttttaagtatttccatacagaatttgttgtatttgaaaatgtttttttgcactcttcatttttacatttataacgctgaattccattatactttccgtactttataaaacttttgcttccacagtaaggacattctttatattttttaacatttcccttattataaatattttctctcaatgcattttctttatatttttttatcttctcaaattcccaatctctttctatcatagataacaactcctttcatacacttttcaattactattcagatttagattaaatttatgttcgattaatatttaaacttacttaactccacaaataactgaactaaattatattaaatagtttttcttatctatgattattgacattctattatatttctaatcttaacaacatttattttaaaaaaggtttcacctattatttcacacaacaacccacccttttttcacatatcacatccccataattcactagtatcacaacattgttttatattacaatctcacatatattctatatttaagtttttaaatttatagattattataatcaaatgatttttttcaacaataaaaaaacctcagaaatgctatatgcatttctgaggttaaaatttaaacaatgtcttttaattctcttaataaataatattaaataatgtatatactaatattttattaatataaatataatttcatatttatattaataaattcttccgtcagttgcaaatctatacatctttccatctataaccatactctgatttgttatcatctcaccattttcagtgaaataataccaattgttattaagccataaccatcctgtatgcattactcctgtagttcctaagtagtaccaacttccatttagattcatccagcccattttcatttcaccagttacattatccatataatatctttgaccagtttcatcatcaattttccatcctgttgctctatatccagcttcatttaagtagtaccacttcttacctgtatatatccatctatctttaacttgacgtcctcttttatcgaagtacataactctattctttattgtaccccattcatcatacttagttgtatcaacccaacagtcattatcataatcatagtatatatcttcagttgtaccttgattattatcactatcatcatctgaaatcacacttactctcttaatctttaatgtataagtagtagtgctttctccatcttctgattcaacttctatatctacttctgtagtctgctttcctgcaaggcttacacttataggttttccagtaaacttttgtccattaatagttattttagctttactatcttcagctattggtgttatagatattttgtttacactttgttctacttgtacctttgtagtataaacatctgaatcaaacttaaaatcacctgaacttaatataaggtcctttaattttgaacttccacctttactattatttataatactaagattataaacttctgtcttcttaccattctgtgcagttactgttatttcaagatctgttattcctgatgaattaagcataaactctgtttcttcacctggatataattcatagcttgtatcagtacctgaaacagttgctactattgattttacattttcatcttctggtacaactgttaatacagctgttgtttgatctttaggcacagttactctatagttacgagaatcaatactaaatccatttttatcttcatctagattgtaaagagtttgtccttttactttaatattacttaatacagcattatctgatttttgattatcatctgtatctgatgaatttatgttagcaggaataaagaatatatactttgaacctaacgaatagctttttactagtgtgtatacgccatctttctctgtaacttcatcataatatgcctgaaccattattctctttgctttacttatatcaacatataaatcagtatctcttataccactatttatatcaaattcattatcaatagaagcttgtgcttctgtaaagttattaccatctaatgtatctgaagtccatactttaaagtattcattactatttgtaattccatctgggtcaagagttatctttacttcatttttatcttttgtgtataagtcaaatgtacttctgttttcagatttaccaactttaaaacttatcttttcttttgaaccttctcttgttaaatatgtatttgaattattatcatcaaatataaagttttcgttgaaagctttttctgcatcatctctttgcttaactgtataaatatatttagctaggagcttttgtgtagatgcatcttttatttgtaattctaactcattttcatcaccaagattaaaatcaatatatgcctgtccattaattaattcataagctttagccgcctttgttatcccatttacagtataattattatataactcatactctacattaactcccgaaacaactttaggtcttaaacataccattcttgctttaggatctatagttattgttcctttatattcaacatacctatttccatctgcatctgtctttgctgtttcagtaaacttcttaccaatatatgctttaacacttgaatcattagcgtattctgcttttaaaacccctgcttctattaaactgaagtcattttctgtctttttctttggaaatcttatttctgcagaataactcttagcaatatcagttccatttttagttttaattacaacaaactgatcattgttacttaaatcattaaggaaacctgaaattgtatttgaatctattgcttgcccctgtccctttgtaccattaacatatacattcgtattatcatgagtattaaatagatccattgtgaacttcattttatagtttaatgcagttaatgaatccggaacttcccatgtatatctcatctttatagtttcatcagcttctgcttctgctgtataaagtaatggagccttattgttatatttagtttcttcagaatctattaagtctctcttaccaacatattgatctaatgtaaaactctcaacattcttacctacgaaatctttaccattatttattataaaactatcaatgctttctgataaatttacattatcataagtacctgatttttctaaggtaacagttgatgtttctttatttactgtatactttatcttttgtacagtacctaatagattgtaatcaattctatcaaccccaagaggcatattgtcaaatcttacaccaaatctgtttaatgcacctgatggagttattttttccatctttatttctaaatcatctaatgcatctctaccttctggtatttccgcaccacttcttgttgcaagttttatattattaagagaaattatgttcatgtatgcatttgatacatatgttgtttcccctgatccaccttctggatacttctttaataattcttccttaatttgattttccgttttagaaaaatcacttattgttaaatcaaatgtattttcaccatctgatgtgttgtaatatggaagcttacctactatatcatctgtcttcttatctaatatagatgttcctccaacaactctcagacttaaatcagcatatgatatatctacacttgaatcatttgctgcattagcttcttgtccattatctccaaactgtaatggaagaaatgaaaacatactagcaaacactataaccagtgcaagcaatctttttactatttttttcatcactctttccctcccaaattatgttttataaatatagttttaaataatcttctaaaaattagccttttagattatttatcgaaccatattaaattttctttaatatagttgtataaatacttataagtaaatttcatttcaacaccaaaactctttttaacaaatcatatatctgttgcaataattattctgcatataatttcaaaaattctgcaaggattttcaccttaattgacaattctaaactgtcaattgtcaattgcaatatatatacatatattcttgttgtttttacatactctttcaaaataaaaaagacttcccttatataatacataaatactatataagaaaggtcctttttactttataaaatacaaatatttgataaagataaacactatgattttgccttaaatgatgtcttacatttagggcatgttattgttatttttccattgccctttggaactcttaactcctgaccacagctaggacatttgaaatacttatgagttttcgctccttgtattttgcccttatatttttttgcttttgaaagcatagaattcttaaatgatatatatttataattttcttgttgtcttttaaaaatattttttgaaaatattctaaaaatatatattaccataggtatatatgcaattaatgatagaatactcaatgatcttggaagtaagcctgacagtaacaacaaagcaattgaaactccaactaacaccattgaaagctcatctactccatatcttccatacataaattttctaaaccaattcataatcttcacctcttttacataaataatatgttctatactaaaacatcttaattttaatataattatataagctttaattatattagttccaaataataaaactacataaagcatgtgaccataacttatagtattaaacttcgtttagtagattattaaatatgaatttctaattagaacatatatattattatacattgtatttatgaacttttatatagatattttttgtataaagtgttaacaaaaaagagccatatcagattttctttgatatgactcttaacaattaaatattcttttttaatcaggcatattaacgtattatcttttaataacgccttatattgaacttgcaattgcttctgctatggctgatgcagcaaggtcttgattagtccatgttgcacattttgcagcttcagttggatttgatacaaagcctaactcaactaagactgatggcatatttgtatttctacatacatataagtttccatctttagcacctctgttgtactgtcctgtctttcctacaatagcattatttatttttgttgccatatttctgcttatagaaatattatttgaattacttgcattagaactatagtaagtttctactccatttgcagattctgaacctgctgagttatggtgtaaacttacaaagaaatctgcatttaagctgtttgcaagattaactctttttgcaagactttcagatactgataaagtttctctatcagattcatttcttgtcataacaacttgatatccataagcttcaagtttagtctttaactttaatgcaacctgcatatttaagtctctttcactatatgtaactccactatggtaaccgtaagcaccatcatcaccaccaaagttgtgacctggatcaacaactataagttttgaacttccgccgcctactctatctcctcttttaccatctggtccaatttcccagccatcaacgactgtatctcttagcatttttcctgatgtaggatggaaataatagtaaccgcccttttcataaacccatccagtctgcattactccactttctgatagacagtataattcaccatcacgtgcaagccatcctgatgccattattccatttgaaaataaatagtaccagtttccatctggtctaatccatccagtaagcattgatccatcagtattgaaataataccattgaccacttatcttaaaccagcttactctcatagttccacttgaatctaagaaataagtcttaccatcaatagaattaaagcctgtaaccattgctccatttccttgaagataataccatttacttccatctttaagccatccaagcttcattgcaccactagactgtaagtaataccacgttgatcctaattgaacccatccattagccattacaccatcactgtatagatagtaccagttagcatcaggtttaatccaacctgtagccttgcttccgtctggtctgtaataataccatcttccaccttcaagtttccatccaatgtttgatgaaatattagttgaattatcagcagtaatagctataggtttatttactggaagaccttgtggttcaactgtatcttttggaggctgaacatttgtcgatccacctggtgtaccgctattgtttgaaccatttgagtttgatccgctgcctgagttgcttccagaattattgcctgagttatcttcatttggaatttcttctgatccaattgtaactcctgctgactttagtaaatctctatataaagaatttacttcttctccataaacagtacttggtgcccatttacctccaagtgagttgacagttggtgccttccccttgattgtaacaaaatgtcttgggtcaaaagtatcgctttttggatatccatctgcacctgcataaagagctaaatgatcaagatgagcttgaacaccctcatcccatgaattaaatttctgatgtgcatttggatcatagtcaccaccaccactactagtcttcattccacatggattatgataactttcatcaagtactccaccaaattttccatatccagtctctttagcagcctgaacataagcaattcctggattaacattaccacattcatcagcatacttaaaataaagtttagctaaacttatgaatgtatctgttgcacctttagatttagcccatttttccgcttgtgctactgttacttttgtatctgatattatgttaatatctgctacggtatctgccatgaccttcatagacggaataaacgaaaaagcaacaaataacgcaatgaaaaaagaagctaatctttctcttatcttcaaaacagttctccccccattcacttataaagtatattactaacagatttttatttcctcaaatctgtcttgctatatactatacaagtataacatctattttgggtacgttgtacataatttgacaccatattttcataaattattcataaaattcattcctttattgtaattttacttgaaatttttcataattttgtaatattataaaaaatgcaccagaacatatctggtgcattttatttaatatttctaaattatagtgtattttcataatatatcttatacataaaaactaaaaaacactacaataagttttggtagaaaaagtgaaactccaaatttcatatttggctagttgaactttctcagagagcaagtgaaactccaaatttcatatttggtcagttgaactttctcagagagcaagtgaaactccaaatttcatatttggctagttgaactttctcaatacagcctttaacattaatttcccacaaacagtatccaaaaggacacctattgtcaaatgtcaactttccattgcaaattttatattaataatgtttagaaactactgctgcgatagcttctgctactctctgttgacttgatgggtctgaacatcttactgcttcttctgcattagttataaaacctacttcaactaatacagctggcatttttgtatttctacaaacatataagttttgagattttccacctctatttgttaaatcaagactacttgcaatattattatttatttcagatgcaaggctcttacttttcgcaattcttgtactatcatattgtccaccaaaagcgtcatcttgagatacttcactataaagtgtttcaattccctttgcagtttcacctgctgaattatgatgtatacttataaataaatctgcatttgcattattggctttatttactctataagaaagactttctgttaatgaagagaatgatggtttttcaccaagatttcttgtcattattacagtatatcctctattctcaagagatgtctttagcttatctgcaacctgcatattaagatctgtttcactataagttactccatttattgtagctacagcacctgaatctttaccatagtcatggcctgcatcaacataaataacttttcctgcgcttcctggtcctgtctgtgaattatttgagttagaattattggagtttgagttgttggaattggaatcaccttgatttaccttaccttttctcttaccatccttacctatcttatatccatcaacagtcgtattcgtaaccattctgcctgttgatttatctaagtagtatgtatctccatttgatgtaacccatcctgtttgcattactccacttgagcttagtaaataccatgagtctccaatagtaatccagccttttgccattgctccattatcataaagatagtaacaagtatctccatcataagtccatcccgttgccatttctccactagatttaaagtaataccagtttgaatttacactcttccatcctgtctgcatagttccattatcataaaaagaatatacttgtccatctattctctttaaaccatttaccatacttccatcaccttgaaggtagtaccatgcattattttctttaagccatcctaatttaatttttccacccttttcaaggtaaatccatttatcttcaatctttttccatccttgttcttcaatcatggctccagatttatctaaataataactactatttccatcattctgtactccagtcgtcattattccatttttgtcaaataaataccatttactatcaataagcttccaacctgtaatcatggcaccactttcatcaagataataccatttattattgtttttcagccatcctcttaccatctttccatctgcatcatctaaataataccaacttgaatctggctttatccatccaaatgcctttgtttcgtctgatttatagtaataccaatttccatcaacattcttccatccaattgtagaagttatgttaggtgaatcatttccacttccttgagatgaatcagtaccagaagtatcatttgtaattttttcaggaagcttaatagcttcttcaatacttaaatctgctggttttttttctactgttcccggatttggtgctgctgatgtatcttcttcatcttcaacatctccccataaatcctcgtcttcatctttttcaaaagtaactcctgctgaatccattaaactcatataaagtttaccaatttcttcaccataagttgcacttggagcccattttccacctaaagaattagttgtagttgctcttcctttaatagttacaaaatgtcttgggtcatatgtatttgcttttggatatccatcagctcccgcatataatgctaaatgatccatatgagcttgtacaccttcatcccatgaattaaatctctgatgagcttctttgtcataatcgccaccaccagatgaagttttcattccacatgggttattataactttcatctaaaacgccaccaaatcttccataaccagtttccttagccgcttgaacatatgcgattcctgggtttactccaccacactcttcagcatatttccaataaagcttagccaaatctgcaaaagtatcagttgcaccttttgattgtgcccatttcttagcctgtgcagcagtaacttcagtttttgaaattattttaaagtcagttgtcgctgcttgtacacttaacgtaggaaccaaacctaatatcatcgtaaatactaaaataaaaatagtaaatttctttttaattgtcgaataaatattcaaaatgttcctccacctcctctaaatttcattgtagcaaaaaaatctatcgccttaaagagaaaagtcgaaaaaaaaaagatttgcagtaatttatcaaaaccgcaaatcttttattatatcttataaattagtcgtcgttcttaccaactgctgataatacaagatccttattatgatctaaagcccagcttataccccagtcattttggaatataagaagatttctatccttcatatccttaactttcttagtatctgaagtcaagtttaatgaatccatatcaatgctttgatcttctatccatcttacatatctgtagtcaagtctatccatcttaatgtcaacattgtattcgttctttaatctgtattctaatacttcaaattgaagaacaccaacaacaccaactataatttcttccatacctatgtgtatttctttaaatacctgaattgcaccttcttgtgctatttgagtacaacctttaacgaattgttttctcttcatagtatcaactggtcttactcttgcaaaatgttcaggagcgaaagttggaattccttcaaacttaaacttctttgatgcagcacataaagtatctccaattgagaatatacctggatcaaatacaccgataatatctcctgcataagcttcttcaacaatttctctatcttgagccataaattgttgaggttgagcaagttttatctttttaccaccctgcatatggtaaacatcttcacctttgttgaatttacctgaacatattctcatgaaagcaattctatctctatgagctttattcatatttgcttgaatcttaaatacaaaagcagagaatttatcttcaaatggatcaatatctccaacacttgaatgtcttgcaagtggtgctgttgtcatttctaagaaatgctcaaggaatggttcaacaccaaagttagttaaagctgaaccaaagaatactggtgttaattcaccatttctaacagcttctaaatctaattcatctcctgcaatatcaagaagttcaatgtcttccattaatttatcatgaagagcttctcctaaaatttctctgaatttaggatcatctggagtaccttcgatagcttcaacttcgttttgaccatggtttccaccattaaaagctatgattctgttattatctctttcatatacacctttaaattccttacccgaacctattggccagttcattggataagttttaattccaagttcattttcgatatcatcaagtaattggaatggatctctcgcttctctatccatcttatttacaaatgtgaaaataggcatttctctaagtgatgcaacctggaataactttcttgtctgatcttctatacccttagcagcatcaacaaccataactgctgaatctgcagccataagagttctatatgtatcttctgagaagtcttggtgcccaggagtatctaatatattaatacagtgatcattgtagttaaactgcataactgaagaagttacagagatacctctttgcttttctatttccatccagtcagaaaccgcatgtttagatgcttttctagccttaacagaacctgcaagtcttatagcacctccatataaaaggaacttttctgttaaagttgtcttaccagcatcaggatgggagatgattgcaaaggttcttcttttttcaatttcttttatgtaatcagccaacgatttatcctccttattttatgacagtacccttaacttcatgtgaaaaaacttatactctagtttcattctatagtcccactttaaggtttacacttgagacttttcaatgtaagaaattatagactttatacttttttaaaattaaattttataacattattatagaatttagcttaactaagtatatattatagaataaatatttaagttaatattatttctctaaatctttattccacaggtatctgccacttttagttatatattattaatttaattacttttatgtctcattaactaaaacattatatcacattagattttctatgtacatatgctacaatctgcaatatgtatggattatttccaatctataatttattatctataattaattatttccaattttaagcattaatactctatgtatctaaatcaaaaatgtgttcttgaaaataaaaaaataattaaattaaagtttaattcacagaaataattggttttaaaatttaatttataggaataattacatttaattttgtttagctcagtttgatgggaatcatcctatactactcatgtttaaaagccaataaacttttttaaagctaaatgttgttgtattgaatttaatttttatttattttttataattacttgcttaagtgcttaattaaatactaaccttgattttattaccaacatttatttttaaaaaagtttcaccattaatttcacatatactctaaccactgatttcatatataatctaactaattatcccacatataacatgccactctatttcacctatactatcaaacttaaatatggcatatacaatatataatctatcttctaagttgagccctaatattctaagcttattatacattaactaatttagagcattgccatcttaaagtgatattttttatatcattaacagttttattattttaactgaataatataacaaaaatcaaatcaatcttaacaatgctccaaagtattagttttattttatttagttttttataatttaattttctataataacagtcatttccttaaagacttttgatccatctgtcgcagttgctctaacagttacagttcctggttgcagagctgtaagcttacctgtagatgttatttctgccttaccagttgatccatttttaactgaccatgttactttcgtattagttgcagtacttggtgctatttttcttgtaaattgtactgtatcaccaacacttatatttattgtagttcctgtataacctactgcacctaatgttataccagttaccttgatagtatcttcatcactatcatcatcagtttcaacttcatcccattgtgcatacaatgttaagtctcctgttaatttcaccttatctccagcatcataacttgtaccattaccattctttttagtattccattcaataaattcatatccagccttgtctggttcatacaatgttatttttgtatctgcatctattctctttgtaaggattaaatctccatcatcatctttataataaactctatactgctcttctatcttttgaccgttttctaatggaatattactatccatcacagcatttggatttgaaatctgacttggaacatatggctgtactggatttccataatagtcatatcccttcaatggtgttggtacatcattccccatacatacaccatctggaccgaagtaatacatctttccatttattatgtttgaacctgtctgcattccaccacttggtcctaaaagatatatttttccttcaacctgaattactccagtctgcattgcaccagattgatccagataataccatgtaccattagagtttaaccaaccagtctgcattacacctaaagaattaaaataataccatgtcccatttatcatattccatccagttgataaataatatccattactatacgcaaagcctccatagtaattatttatccatgctgcttcagttttcattggtatcataacagttactactgtaagtgcaatacttacagctattaacttgtttaagaacttatttctcataataattatctcctgttaatattattacatttgtagttatctagtaattatggtcttttaattcaaaattttgctttgttaatattattacatttgtagttaccccttaatttagttcattcaccacatgtgctctaatacataaattacttttaaaattgaattatgctttaatctatttacttaataaatattttttaacttattatcactaacttgtagctgtactatcaacaactggtgcattggatacacctataataaattcactatattttgtactatcataatttgcagatactcttactacaacttgggaacctattgcaatgtctcctgttcttgtaactgataacaatccattagaacttatctgtgcagtaacattctttggttgtgatattatttcccatttaaggaaattgctatacgaacctacatcttctccatttacttttgctgtaaagttaatatttccactttgaccattttctaaagtaacctgattaattgtactttctaaatttatgttttctatagcttttaatacagtgattacatctgtagtatagctatcttctgaagaatttaaagttgcaactgcttgtagtttgattgttccaggatttactggtgtaactgtatatgttgcactatttctagaaactgttacatcactggttacaaaggcacttcctgttaaactaccatcattagcagaagtaatagctgacaatttaatcttatttccattaacattttcaggtaatactttacttgtgactttaaagtcttgtccagaaataactacatttggagacgaaactaacacaccttgaatattttcatatatatttattttaaattccttaatgatattgtcagcaacagcctttattctcacagttaccatttcacttgaaagttccttgtttgcagttattgtaagcttattaccttctatttttggtgttacgtaatctttatcacctaaaactgaccatgtaatatttttatctgttgcattatcaggaccaacttcaccttcaactgttactgatgctcctttttgaatattaaattcatatccctcttctatttctgtacgcttaattactccatttgattcaatatcagtatataaatcaatttttgtagcatatatcttctgtccactaaattcaattgtaatttctccaatagctttactactgtcattagctattgccgtaactttaattactccatttttctttgcacctattattgcactagtttctcctgaagtaagagttgcataatttgaaacatcattatccttaccatcaccatcaataagttccatgctccattttactgatgaagtatctgtagtgtcagatgggtttaatactgcttttagatttaatttacctgcattagtcgtaatctctggtttattagtaatatcatttcctgaagtatcaattgctttaatatcaacagattctgcatctttaactacagttattgtagttttacctaagatactactgtcactcttacttttagctgtaacttcaaccttacctctatattcaggatttaatactgcatattttaatctttgtccagcagcatcacctataaccccaattgttccttcatttatgctgacttgttcaccaattttttctccactagtatatacagcactccattcaacctcatcatttgctgatgctacattatctggataaatccttgcaaccatttgtagtttctttcctgttgaaaccgtcttaacattttcatatcctgaaacttgaatcttagttgctttaactgactgtccagtaatattaattgtcttagttgcagatattcctgatccatcttttgctgatgccataactgtaacttttccatcagctaatgcctttaattctcctgtatccctatctatttcagcatattcactaccatcagtaatcttccagcttacgtttgcattacttgctgtttctggagatacatctgctgttaattttacaactgctccatcttcacttattgtatctggtccattaattttgatgctctcaattagattcttagcttcaactactgtaataacctttgtagtgcttacattagatttatccattgcttcagccttaacagttatctttccaagtccattttctaatcctgttaacacaccattttgatcaatagatgcctttccagaagctgttccatctgcattgtcaacgatactccacttaacctttgtgttagttgcatcacttggtttaacttctgcagttaattgagttgtcttaccaatttcaacttcattacttccagtaatagaaatactgcttacaagagtctgttcttcaagttcttcccatctagcatataatgttaaatcttttgtaactttaactttttcatcagaatcatagctctttccagaaccatctctcttcgtattccactctatgaagtttctatcctcatcaccttttccattttcatcatctggttcatacatttttactgtatctccatctgtaatattctttgtcttaagttcctgaccattttcatctctaaatgtaacagtaaactttcttgctggttcttcataatctccatcctcactttgatcaacaataggattatcatatttagaaccatctggagtcataatcgtagttgaatctacagaattaatctgcttaatacagttgttattcctatcaaatactttatctggaactggtacagcattggatactatagccccatttacacctattgtataaaactgaccattgattattacgtttccttttttcattacaccattgtttccaaaataataagtttgtccatcaattaataaaataccagtctgcattattcctgctgaattagaataataccattcaccattataattaatccatcctgtttttaaagcaccattattatctaggtaataccaagaatcaccgtattttatccatcccttctgcattacaccagaagcatcaaaataatatactgttccatcaatatttctccatccaacagcgtatgtattactttcatagaaatagtaatttcccatattatcattcatccatgttgctgcatacacgtcaacaggcattgttgaagaaatgcaagcagttatagccatgcaacaaataagtttcttaatcaaatctcgtttcatactttccctcctatgtttttactaattttaactttaatctattattcagttattcaatttccaatgtacaattgttcatataagacataacatatgtaaagtctaaaattaaattataagtatttcaaatatacaattgttaacataagactttatattatgtcaaaatacatattaaagctaataatttaaaaataaataagtaattttcaaattattgcatcatattgatttaataagattttattcgaaactcaaacaacttcttaccctaataaaaattacataatattatttgaatttgagtaccttttatataattatttatcgttctaaacagattttactaaagggattgaactaaaacaaaaatatgctttaacattcatgtcatataaaaatcataaagttgagataaaattaaatgaaaacaaaaaatatgcttcaacttagaataaacatttaccaacatcatgtttatttgataacgcataaaatatattcacataaattcttctacattatcgtttattctaagcaaagcatatataataaaacatattcaatatttttaataaaactatgttcttaatcaaaacatatcttttgtacttttaattatatttcctatactaatctatatttttaagccattcttccatcactattaaaattgtacttaacaccatcaatatatcttgcttttgtaaccatagcaccatttatattaaaataataccaactaccattagtataaacccactcatttttcttcatctttccagatgtatcatctaagtaataccatccatcgtcaccttgaacccatcctgttttcattgctcctgttgaatcagaataataccaacttccatcagctctgaaccagcctgtctccattgaacatgaattttctctaaagtagtaccagttttcatcaatataagtccaatcatttgctgcttttccgtcttgatttaaatagtaccacttatcatttgaatatttccatgttgaatactccattgctccattacttccattaaaatagtaccaatcatcatctatcttaagccaatccttagtcatctttccgtcactcttaagataatattttctaccattatcattaacccattcagattttttaactggaccttgatcacttaagaaataccaatcttcaccatcttgaacccattgtaaaaatagctgatatcctttcttttcatcaaaataacatctctttccatcaactatctgccagccagtttccatagccccatcaattctattaaagtaataagttttaccatcaatcttctgaacaccttttaaacttattccatctttatcataataataaatgtagccatctttctttccccagccttcatcattatcaaatctatcaaagactttatcccaagcatcatctatatcatcagccttatcctttatagaatcagtcaaatcgtctatggcatctgataaatcttcaatagtatcagtaacatcactaactacactatttaccttctttataactttatctataatttcagttattccactattttgaattatttctgatatcttttcttttatatcttctaaaatcttatttttaatttgttcattaaaatctttgatttgctctacagatatacataaaggcttaccatctttctgcataattaatgcaccaatttttcctccaacaaagtatcctgcatcttcaatttgctcaccattcataacctcataaccatatataggtacactttgtccattaaaagcaagtattgtctgatacacagcattatatacttttggttttacactctcaatttgctcatcagtcatactatctacaattttatttacttcatcttgacttgcccctggtttcactaaattgggttcattttttaagatttgtcttatagtatcgttgctactgcatatctgagttgccattttttccgcaatactcttagttattgttaattttatatatttaggtgattgcactttaactgtagcgcctggatatttcccatttatatattgtgttattttttcagcaatttgtttatcttctgctgtttcttcagatgctaaacttatgctattttctaatgattcaatattgtaattatttgaaaattcgttactatacttatcggctgcttcagctctaatctgcatatttccaacaggaactattgttgccaatgtagttgctaatactattaatgcacttgtctttttaagtctctttatcatatctttccctcccaaaactataacaatattataacacttatactgatcagttcaaatattatctatatatattctaataattatttttcttagtaattattcaaacttcaatatatctaagaaaaattttattaacatatctattttctatataatcctttaataaacctaaaattatttttaaatatatatatttactttatctttctagaacttatatttatatattttcaaaattaaatttattaccatttttattaatatctttactgatatttttattaaatactgaacagtaaaaactttgttttacaaaaaattctacagcaatacatttgaatttttattatttaatcatttaaaatatatcaggaatatattttaattcacgttaaataatctatatttttaatgccaattaatattttagaggaaaattcataattctttactaatttacttttggggtatattattttttaattaacataatcacatactaaatacacatatctattagaatcatagtgtaatttataggaaaaacctttttaaaaataattgttggtaaacaaagctcttttaaatattttaataatcttcaacatgatttgtccttaaaacttcaacagatgtataagatccattttttaaaagctcaaaaaagatactcatataatcaaaaactttttctgaatcaattaatgaataaaaattataataatggtttatatattttgtagcaattcccttatatctactcaaccatgcagttaaataagctatgatatttttctttttatattcttttattttatcttctattctatttcctataatttttaatccatatttcttttttgtcgcatttgaaagttttttattgtattgtagcaaattattctttaattttttatttgtgaaatgatccgtacgcatataacaatctttagctgcaattttcaacacattattattaaaattattcactattgtttcattgctttctgtttttcttattagtggcattttcccattttcttctgctataagtacacttacattcctaggtacaagtccatacattttatcaaatttattttttactttatcagcatatgtataatttttatttctgcttcctttataacatttttctgtataataagtatctacatcaacaacctcatcaaatttttctggtttatagttattttcaatggcatgaaatattttatgtctccagtgaaacgccgttactatagatattcccaatttatatgaacactcatttaatgttgtatgctcacccataagttcaataaactcaaaccatttctcaggtttatgttttaaatacttccatacagaatttgttgtatttgaaaatgtttttttgcactcttcatttttacatttataacgctgaattccattatactttccgtactttataaaacttttgtttccacagtaaggacattctttatattttttaacatttcccttattataaatattttctctcaatgaattttctttatatttttttatcttctcaaattcccaatctctttctatcatagataacaactcctttaatacacatttatttaaattcacctaaacttaagttcgcttaaataaatgtcaatccattaaatagacttaacaattaaattagctaatataaattatattagctaaaatcacttatctatgattattgacattttcttatatttctaatcctaacaacatttatttttaaaaaggtttcacctattatttcacacaacaacccacccctttttcacatatctcatcccgatttttcactaatatcacaacattgttttatattacaacctcatatatattctatatttaaatattcattctttctaaaaatactaaaaacatataaaacaactaaggaaataataaagacatcagatttttctgatgtctttattatttattgaatttatcactttattcaaatattttattcaaatgctttactaacaatatgttattaacttgttgataatatattgttatagcacatttatttttaaagtgaatcaagattaatccatctaccatctaagaataacattccagttttcatagcaccctttgaatcaaaataatagcttctatttcctatagtctgccatcctgtaaccattcttcctgatgattcaaaatagtaccatacttttccgttatataaccatcctgttctcatagtaccatcatcatctaaataatacttattcttatcgtaagtaatccatcctttttgcattacaccatggtcatctaaataataccattttcctttatacaatgtccatcctgtttgcatttggccatattgattgaagaaataccaatttccatctagcattgtccagctatcttctaccatttctccactttctcttaagtaataccagaatcctgtgtccttaatccatccataaagcattattccattaggatcaagataataccattttccaccatcaaataaccatccatctttattcatgtatccattaacatctacatgataccattgattatcgtatttaacccatctattcttagctggaattccatctccatcataatacatccattctccacctacaagaacccaatcatttaatgttccttgtaccttatctctaattatacttaaagtataattaactgtggatttattatcttctgaaacaaccttaactactacggtatttgcacctaagtcaagttttatcttatctgattgctgaccacttttatattctactccgttaattgttacttttgacttttcattttgtgtttcaaatttaactcttacttcttcaatatttcttggaactttaacactgtaagcataaatctctggatcaaactttggtgaaaatgttccatctgttactgaaagactacttaaattaacgttatttttagagtactttcttgttatcataataacatatgtattatcattacccttactgtctgttactgttacattaattacatttccaccttcatcaagatttatataaggtgaagtagctccacttggaatctcttttccattaacttctattgttgcatttgcatcctctgcaactggcgtaaccccaactgaactaactgtattttctactattgtagtatattgatacacacctttattaaatgtaggagataatgtaccagatgttaattttaaactttttaaatttgcacttctaaacttttctgtacgagtcactgttactgtatatgtagtaacatcaccatctttattagttacaactataggaatctcattttctccttcgtcaagctttatatcctgactctttttcccacttgcaacagtaattttctttactttaattgttgaagaattatcaactgctgttggagtaaatgctattgtttcttgtgttgtaggtactgtcactgtatattctgttgtatcagaattaaatgatggtgaaagacttcctgttgatggcaccaatgatttaagtttggctacaccctttttagttattactaatgtataaactttagaataaccagcacttgttactgttaactcaatagtattatctccaccaactaaatttacaatcttattagttcctccatttaccttaaagctcattgcattattgctgtcgtcaaacatttcaatttttgcttttttagcttctgggttggattcttcataatagtatattccttcactatcacactgagtatatgttagtgtaacaggatcatcattatctactgtaattcttaatttattaaattctaaagatgaatctatattaaattcaactctaatatcataagtatttatttcaccacttgaattttttacttttacagtaagtttaaagttactgtagtcttttattgtacctatagtaaaagtattagtagttccgctaactgctttagttattttcattttatcactgctactttttactgactcaatattgtatcctgcttgaggcattatagtatatgtctgagatagtgttactgatcttaatactaaatctccactataatccatatctacatctttagtagttccactactagcatcccctattataaacttaaagctgtcgttaacttcttttgatccactagtggcagctttaactggatttgcttgtcccatttgcacaaagctaaaggtcatagcaaatataagcaaataggcaaatacccttttaaaattaaactttgctctcattaaatcgtcctcccaagttataaatatttatactatatatattgcaattgacatgcaattccccttgtgggtactcctatgagcaattgtcaattgatgctgaaatcactatggatttctagattataattgtaaagctcataatgcagcatacatattgaaattatatatacgcaacaaaatactactaaaattaagtaatttactacaatttgcaacatatatacataataatctctacaataatattatacatattaattatcgtacattgagtactattttttacataaactctatatttttattaaaaatttgttgattataccttttattataaaaaactctgcataatacaaatgtaatttgcagagttttttatatttttgattctattataaaattaactttttaaatctaatatactagataaaatctataagcattttaatattaattgctctcactgattgttaacaattatataaacactatatatatatatgtttattttcttagttcttatctcatatattgttgcacattgctcttatctacttttgaatatggataccaaatatattttccactactatctccatgttcaatttcacttattttatcaccatttttaagtgctttagcagctttaattacgctttctccctgaccttctccagattgctttatagaaaaggacatttttccatttgatatagctttgcatgcttctggtgttgcatcaagacctaaaataggtacctttgatggatcaattccattttcctccatagcatcaataactcctaaagccatttcatcattattactaataatacaatcatagcttacatttaattttaaaaatgcttcaaacattttctttgccttttcacgatcccagccagcatcatcttgaaaaacataatttacatcaaaaccatttttctttaattgtgattttaaagattctgtacgtacagaagcactctttgaatccatacttccttcaaataaaactgcattaaaagattttttatctttaaaatactcttttaaagattcaaaagtatatttagctgcttcattttcatcagaaccaacataaatatatttatcactttttaatctgcctgaatctggttcaacattagtaaaaattactggaatgtcacctgctgcatttattatctgctgtgcagtatcactctcaacaagaatacaaactataacatcatatcccttagtttttgcatctttaatctgttgtacttgtgtttccacattgttatgtgcaatcgcaacatcaagatcaacattattttcatctgcatatgattccataccgctaacaatggtctgcttaaatttatcatcatctgcaatactagcaaaaacttttgtatttcctattgatgtgccttttgaaccattttttgaacatcccaaagcagtaaacattaatacaaataccatcaataaacttaataactttttcattagaagcctgcctcctataatttgaatttttctacttctgattctaattgtttagctatatctgataaaacatctgctcctttggcaacattgtaactgctttgcgtaatattttgtgaatgctcaagcatatcttgtgatgtacttgaaatttcttctgaacttgcagcttgctcttctgatattgccgccatattatcagctgcttttcctacttcttctactttctttaacatatctgcaactaatttatctgattcatttattgtgttatatatgttatcaaacttccttacagaatcagttattaattctgaactttcatttacatgattaacactttcatttactttgcttactacattagagataagtttattaatattatttataagttttgcaatatcattaactgatgacgtactgttattagcaagagttcctatttcagatgctacaactgagaatccctttcctgcttcccctgcccttgctgcttctatagatgcattaagtgcaagaaggtttgtactttcagcaatctctccaataatagatactatactgtttatttcttcagatgattttcctacttcatcaattacatcttttaattcttttattgaagtttcaattgttctgattgaaatctctacatgttccatatcttttttaccaacttcagacatttttacagtttcaatcatcttatcttttactttattcccattatcatttgtttcacacgcaatccctgcaagacttgtagctgtatctgcaatttgatttgtagcttctgccatctctccaacaacaatatttaagttgttcatagattctgcctgctgttttgatgaatcaaataaatgttctgatatattcttactttcaaaagactgatttttttgttccatagaaatatcttttatatcattaagcataactctcatagattctataaagtttttcaaactctgagacataactgcaatctcatcattgctcttaacatctatatctatagaaaaatcaccttcagccatcttaactatttttttacttatatcatttaccggatttattatgtagtttatagttctatgtgttattaaaactaaaactgctaaagctacaattgctattatcaccatataatttctcaaagtaaacattgaacttaatatactgcttttaggtacatacgaaacaagtatccagctagtatttttcacatcatgcatgtccacaatattattctctatttcttgcgcactatgctgtccgctttcaatactttgtgcaattttagagtataataaattttcattattttcacctaatattgtataaggctctaaagaatcactacttgctaaaaccattccagtatctttgttgactaaaaaagattgagcatcatccatttcaattaaagaatttactattatgcttatcctatttaaagttacatcagcaccaattacaccaactggattattatcgttgtcaactattaaacctgttgcactaataactttatttccagcataatcatcatgtgcttcaccataacgcatttttatatgtgttaatccttctttaaaccactggcttgaagttgcattttcaaatttcatctgtgaattatcagcacttataacattaccttgcaaatcacttatgtatagtccatctaaaaaattgctattaaaattgtaatattgattaagtattttttttaattcttcttgactgtactgtgtacttcctaaagatttcttaattgtattaaatgtctgcaaattattttcaagccaattttcaatttgaatagtttgatttttaactgatgattcaagcattgaatacgaattttcttcaattatcttacttgatttattgtatgatacagttatcaatcctcctatcgccaatattatcactggtaaaattactgataaaattttgtactttatcggtatatatttaccaccttttttattaatctttgcatgccacatttttatcctccttttgcacttaataatataattctatttatgatatattctgatttgaatattatcttactatggaacaattatttaagtacaatttttacttaataataaacaatatttttataatactacatttttttatgtatatctataaaaaatatataaatatctccaaaattatatattaaagccataaaaagtatatactaatatttcataatatagatataaacattctaatacaagtatattagaatactcaaaatatataaatatacattaaaatatttaacttaaaattctatatttaaaatcatacttcttcccaattccctgtgatagtgtatcagcttatgtataaattttgtattaatatttttaatatcatgttaatattctataaatatttacgttaaaaaacctaatttcccaaaataataaaaaaaatcccctttcggggataatattaatcattaaaattcactgatccatcttcattaaaattataaagatatccatctaatactataggttctgttctcattgaaccatcttcattaaagtaatagtacttatcatctttgtaaagccatccacatctcattgttcctgaataatttatgtagtaccatttatctttatactcaacccattcaccagatttcatacttccatcattatttaaatagtaccaatcatctttatattgagcccaaccagttttcattgctccattttgtgataaatagtaccactttttataatctaaaatccaaccagtttccatggaaccatcattatttaaatagtaccagttttctttatctacaatccaaccagttttcatacttccatcttggtctaaatagtaccattcaccattatttttgacccaatcagttctcattactccattcatatctagataataccacttaccttcatattcaacccagccagttctcatcattccatcatttcctaggtaatatgtatttccgccttcattaatccagccagttttcatattgcctctgccattaaaatagaaatatgagtcatagttcatatcaaaaaaccatgtatttttcaaaggttgtccaacagcatcattatatcgccatcttccatttacaattacccattgattaggtttaagtacagagtttattgaatcagatacattaggtgttacaggtattcctctataaatattcaacacatatgttgattttctttttgtttcatcatcaactacatctaaagtaattgtgtatttacctatgcccttaaattttaatgataaagaattggtaaagtctaatttattaccattaacaaacacactatactcatcaccaaaagtttctacttcaagcttaaccaactgtccattttcgtcactttcgatattatagttctttttattaacaaaataacctatattacttttatcaagtgtaatattctttaaatatacctcatctgctccacctctataaatatataaagtataaactgttttatcttgtgcagatccatatttatctttatcattttgtacatcatcttcagaaaaatcatcattatctgtatattcttcttcattattatcattattttttattacttcaataacgaccttattttttcccatttcaagacttaaatcctttttgaatttatcatcttttgtaattacttttccatttatttttataatatcattgtcattttctggtctggtttttacatatatatcttctacatctttatctacatcaactatatattcgtatttatccttaataaattctatatcataacctaaacccacatatatatcctttagataaggcttgtcttcaatgttttttgcataagcttccacacatgttaaactgcctgataacatttctatacctattaaggaatataatgccaatacagttgctgcaatgccctctcttaattttctcattcttcctctccttattatgcattcataagtttatgttaacactatacactaaacctgtaaacctccataaaaaagctttaacttaaatttttcttaataattccttaaaaaacttatagtcaattcacatccttaactgactaaattacacaattctcactattatcaatttatagttatacttgtcaaatatactattagtaatttgggttacaaatcaaaatatgttctatgttatttatgattaaaaaaattaataaattaaattttaattcacagaaataataaagaaggactgttacaagatatcttgtaacagtccatttcttatgcagaatttatattgttttcactaatatgccttactttgcacatttaatatttacaatactatatttatctaagagtatgttagtggtaataattaatacttactaattatctgatccaagctccgtttgatcctaacttataaccatctatagttgtgtttttagccatagctccgtttgattgtaagtagtaccagtttccatcagtatctaataaccaaccagttttcattgaaccatttgagtttaagtagtaccaagttccattgtcatttaaccaaccagtcttcatagctccgtttgattgtaagtagtaccaagttccgttgtcatttaaccaaccagtttgcatagctcccttgtatccgtttgatactgggtttaagtagtaccaagttccgttaacatttacccaacctgtttgcataactccgttagcattgaagtagtaccaagttgatccatctaataaccatcctgtagtcttagttccatcagccttgttgtatgaccaagttccatcttcgttagtaacccatccagctttagtttcttctttatcgccttcatctgttacttcttcgtccttagtttgaactgtagcgaatacttcgttatctttgttccaagcgattaagttgttttcgtcatatacatctaaatgatcgatagttctgtcacaagtgtaaacttcaacgaattctgtaccattgaatttgtagatcttacctttgtttacagcccaagtgtttccttcagcatctattgatactgcatttgctccaccttcgattttttcatcatcatcttgatctttaactgctacataaacgtctaatttcttagttccatcgttcttagtaactttttctttctttaacttgattgtattaacatatacttttccatcttcgcttactgttgttacgtagattgtatcttttataactcttaccatgttgttttcatcaagtaataattcttcagcttttgctgtatcatcattatctttgtcaatgtagaagttacttgagatttcatatgaatctacagattttggcatgtaagctccatctttagtatctccttgagctttagagatcttttggatgtatgttcttgttccatcagcttctccagcaattgtaacatttacttttgttatagcgtataggtagctgctgtcttgagctattacctttggagcttctgctaatgataccatagcatcattcttttctttatcgaattcagttactcttacagcactgtcagttgttgaaactgtcatgttagctaatgctgaagcatcaatgtattttcctgattcattagcaaaaccgtataatgttttgtctgaatctgcactcttaactccgtatgagtaccaaacatctccaaattgatttccaagaacttgtgctatttcatcgttgttttcaaatactattttgttgtttactgtagcgtatctgtcatcagctttctttaatgtagttcttaattttaattcaacgttgtttcttaaatcttcaatactttcatcatcaagaactttaccagatgataaatctaataaatagtcttctccatcgttttctactattgtatatttagttccgtatttttctgaaccaaattcataatcttcatcattttctaagaatgaatcttttgttccgttgttgaagtataatccgctttcatcatcatcagttaaataaccgtcataaacatattttccatcaccgtaagcaactgctgcatcgatgtttccttcttgtacttctaattttgccgcagcactagctgatactgctggtactattgaagcaactgcagtagcagctaccattaatgctgttaatttgttcattctttttatcatattcttttccccctgaaattttttctttcccaaattagtcaattcaattacgtagatgacacaccatactaatttctcatactgtcatatttaaaattattttattttttcaattttaaacttttttctacatctctgtcgttttctgtatgtctcatctatcgacaaacttataataacatagggacatgttttttaaaacacttttttaatataattataattcctataaaacctttatattcctttaagtataatttttcactcttaaaacgttttcttttttcatttttattccttttaatacttttttatttatttaagtaatatatttatacgaataaaatacaaattgcaaacttttttataaaaaatagtaaaaaaactgcttcgtaaactatgtatttttactcctttagaaattattaaaaaattttgttacattataatatatatgttgcaataattattctgcatataatttcaaaaatcctgtagggattttcaccttaattgtcaattctcaactgtcacttgcaatatatatagatacaaaataaaaagatgacttctgtataacacagaaatcaccttttatatacttaaatgaagtatttatagaatattattatttgttagtagttgttccatttgcataatatataatgccatttctaacaactctagtaacaccctttatatctaatttttcaccttttttaactgttacataataagctttttcagattctttataatctactttagcatcttcattagtaacataaagatctctaactgcataatctccagctttgattgcattaaaatccttattattaaatgttacagtataagtatctttatcatcagttgcttctgaagagcttactacagtaatattagctgaagaactataatcctttatagcttgtggagttgatgatccatgtgatgatcctccgccgccgcctgatgatgacgaactgctatcgctatcagtatctttatcagtgtttgaacttccactgttatttcctgaatcagttgttccaaatactttatcagcctttggagcatctcctacacatgcaccattagcagcaaatgtatatttagttccatttatttcaacttcacctgttgccatagctccattagattgtaagtaatatgtttgtccatcaaccttaattacacctgtaagcattgatcctgatgcttctgcaaagtaccaagttccagcatcatttatccatccagttttcattgctcctgatggttgtaagaagtaccattttccagcatcttgcatccatccagttttcattgctcctgattgatccatgaagtaccattgaccgtatcctgctgaatagtctataacccatccagtgctcatgtatcctgtttcatcaaaatgataccaagttccatcaatttgtctccatcctatagaccatgagttcccttcagtattccaccaacctttagcatcttgcttccatgcagctgaagcagctactggagatacagctgtaactgttgctaatgttaatgccatagcaactaatttttttaaatttaaacctttcattattaattacctcctagttaattttattttcatcataaatatgtttataatcaatcctaaaaagagaataataatagatattgcgcataataattttgaaaagtattctgcacattgtaaaaacataggctcaaagtaagctttgtttaaattaatatctatatgagcatatacttttgacatatacacataaccaaaaattaagctcataataactcctgccgctaaaacagaatttccaattataacaagtccatttacaacagattctttattaacaaaaaatattagcacacaaattattactattaataataacaatacataaaaattgttatacaaagcagatgtgatttttatcgctaaattaaattcatttgaatttataacttttgaaaaattcaatttttccatttcagcgtttattattttttctgcttcttccattaattttgatgaaatttcattgaccttttcatcaaaatttttatttccatccattaatacagatgtaacaatttcttgtattttcttttttgaaactttagtttcatcatttttattatcattactagttttagatttatctgcttgtacattattatttattgttttatttgaatcagtggtatttgaagaattggatgagtcggcatctttatctgaaacttcatctttttgtactcctgaatctgatgattcttcattttgtgattcctcatctaaatatccattttcctcaagataattccaaacatcctgttcactaattcctctttcagcagcctttcttctagcttcttcttccgtcaatcctttttctttaagcatggctcttccttgcgcttcaagttctgcacggcttgccatattcactaaaattaagtcattacttttattctcattgagattgtgtacattaaacatattttcaccaatcaatttctcgttactatttacagtattaattggtgttaaacacatatcattactttgaatactgctcgttaaatttttatcatttctaatcttagcttcaaatcctgttaatgtatttaatgcttctgctaccctttctttatatattgtagtatctatttctggaatattagcttgtccactaattaaatcagaaattacacaatctaagacaacatcagcttcttttcttatatcctcttctgttattatcgattctttaagattttcacttatatcattacctaatatagccgtcattttattacttaaggcttgttcaacattagaatatgtattgctatcttctaataatcttaaataaatgcctttgttagttgccgaaaatcttatgatacttgataatacagtaagaataattgtaactactaatacaattgaaagaattatattagcaaatttttttgattttttcattattaactaactccaaatactgctactaattatttaatattatttaaataatcctctgcatctggataatattcaagaattaaattctttaaatcatcataatttttgatagaattaagcttatctgctactttgtatacattattagtattaacttgagctacaattttaccacttttaactaaagtaactgtcttagcattatcactatttattccaacagttaatgttccatatttagtagttttaaaatatttattaattgtttctactaattttgcattagattcactgcttgcattttcaaattgttctagtttacttaaaagatatttctttatagaatatactgcttcatccttttcttccttatttaaagttcttaaagttttcactatattcttttgaacaacatataaattatcatctttttctattttccaagatacttctttattttcagcttcatcaaaatatacatttaatttgttattttctaaaaattcattagtttcattaatgaaagcatctgttagataatctccaacttcagtttgagcagaaattgaaatatcattgaatactcttcccccatttaatccctttgtaactatagattgcatagcttgtcttttgttatctcttcctgcaacatctgctgctgaagcaccaattgttgtacacgtagcaattgctaatgtaagtgcacctattgataatagttttttcattttcattattactatctcccttcaattgtcataattttatttaataaattttatataataaatttattttcctaaaatattaccataattaataataccatattttttatgttatttctatattttcataattccataaaatttaatcattttttctaaaaagtactactttttttatcatttttatccattaatttgatatttgaatctaaaaatgataaattatataaggaagataaaatatattccaataaaattataatatttaccaaatataaaacttttataataatcatttagcattcggattattataaaataatttattaaggagtgtctttatatgaaagggaaaatgataaaaagctttattgttggattagcatttgttcttggagcttctgtttcaagtcctatatgtgcatctgctgcatggaaacaggattcaaacggatggtggaataccgaaggaagttcttattctactggttggaaacaaattgatggtgcatggtattactttgcttcaaatggttatatgcaaactggatgggttaacgacaatggttcatggtattatctaaataatagtggagctatgaaaactggatggattaatgataataattcatggtatttcttaaatgccagcggagttatgcaaaaaggttggatcaatgataatggtgcatggtactatacaaatgaaaatggagctatgcatacaggattcttaacattagataataaaacttattatttaaatgaatctggttctatggttacaggtgacataacattaaacggaattaaatattcttttaacacaaatggtgaaaaaataggattaactactgcagaaagtactgagtcaacaggtacaactactgaaaatgatactgttaaagatgaaactacttcaggtggtggcggaggtggtggatcaacttctagtacaacaatagaagattctgctttgccttcttattctgatttatacggaacatggaaagtaaacagttatatttctgactctggaatagaaactaatcttgctggtttattaataaattcggcaattggagaaaaagttgtagtatcagctgataaaatttcatccaatggatacagtgctgtaaatcctgttgttgaagaatctattttaactaatgctgaatttaaaagcatatggggagtaaatctttcaaagattggcatttctgatagtaaagtaaaatgcttaacaattactagaagtgaaaactcaagtcaaactgttaatgttattgctactaaggataaaaaagtagttgcaattgttgaaggtgctccatttaaattatctaaagttaaataaagtttaaataattaccttttaataaaatgaaaatagcttgtttttagtacaagctattttcatttttatataactttaaataaattatttttaaactaatctaaataaataacttcattaactaaaaattatttattcccaataaaaataacttctataatatatatagcatgaattagcataaaacacctatgctattaataactcataaatcataaaatccagtaatgatttaaactcaactttcgcttatatagtgtcaaattcaattggtataaactactctcttctaagggagtctacaggatcaagtctcgatgcctttgctgctggcattacacctgcaataatacttataattacacttaaacatataccagttattatatgattagtgtctattaaaagtaaatcaactgaaaaaatctgtaatgacattctatttataagtttcataataactatagatattccaactccagctagtccactaaatatacctattagaaacgcttcacttacaaatattcttcttatatctttttttctagcaccgactgccttaagtattcctatttctttaattctttcaacaacactcatatacagtactacaagtatcattattgaagatactacaagtgatattgctgcaattcctgacaaaacatatgttgtaatacttatcatttcattaaatagatttgtcatctgctcttgtgatgaacccgtgtatcccatttcttcagcttttaattttattccatctgtatagttttcagcactacttgtaatatatgctgtgtttggctttaactctcggttattttgtgtatatattttttctaaatcagaataatttataaaagcacattttatcattgaattaaaatctccatatgcaccttcatatattccgctcacaataaattcatttttaactttagtctcgcctataagaatacttagctttaccttttgcccaataatattttctcctaatttatcagcaacagatttatttattaatatttcaccttcttttggaagatttccactagaaagactactttcaagtattccagaagaaactgtggcaagtcttattatattgcatccgccatgatctgtacttacagaatttgctcccatggcaattacgttataacctttttcaacactatcaacattttctattgattttaacttttcaaaatcctcttcttcaaaagctgtcccactattcattttaggtatatctattatgttatcactatctttaaattcctcatcggcttctggcatattaacttcaataacaagaggatttacataattgtccatggcattattaaaatatgtttttattccatttccaaaaccaagcattaaaacaactcccattattccaatacttgctccaagtgatattaaaatatttctaagaaatttttctttcatattagtaagggctaattttactgcactaaacacacttagatttttatttttcctttttatatgtaaattactatttaatctttttccattctcatatttttctccataacttaaatcagcctcatactcttttatctgtttattcctaatatcctttactattaccccatcttttatctctactattctatctgcacatgatgctactttttcagaatgagttaccattattacaagtttgccttctttaacaatttcatttataagatttaaaatctgatctgtattgtgtgaatcaaggcttcctgttggctcatctgctattattatgtgaggattattaaccaaagcacgtgctattgcaaccctttgcttctgtcctcctgataacttatccggcttcttatcttcatatttttcaagtcctactttttttaatatttctctgccactctttactctacttgattttgaagctccactaattatcataggtatagtaacattatctaaaacagataaatgtggtataagattaaaactttgaaatataaagccaaccttgtcctttctataaatatcaagttgtttttgattatatgtatttatattattcccttcaacaataatgtcaccactatagtcagagtcaagcccaccaataaggttcataagagtagactttccactaccagattcaccaataatagcaataaattctcccctttcaaaagaaatatctatctccttaagagcatggaatctattcttcttactaccatcataatatttatttatattttttaattgcactaatttcatctatttttctccataacaaatcttttcatatgtgtagtctttttatagtgttttcctcttgcacttgaaaatataaaaaataaagtattagcaagtatacctccaccaaaatcaataagaacatccactacacttgatgtcctgttttgaatgaaaatctgaaaaaattcatctataacagctacaaagagcactgtaaacagcgtatatataagtaaattattatcatctatcttaaaatatctaaatgtaaaacataaaactatccccaataaaaaaaactcaaatgcatgagcaatctttctgactataaggttaagttcagtttcattaaccttagataataaaatttggcctcctttagtctttgatgctactttaatcacttcattaacaacttccctgcttcttgtgtttgatactgtagatacctggcttgaattaaataatataaatccaaaacacaaaaaacatatagctattaatacaaatttattcttcatctccacctccattaaattattttactttattttctaattatatcataccaagttattttaattatttctaatttattaaaataaaagtagtacactatatacattgaatagaggtttaccatagaattttctatttttcacagtctaatactgaggactaaagaaatctcataaaatgtcgaaaaataatttgaaacaaaagaaaaaaacgaaaaggagctacaaatgaaaaaagataaaaaaagcaaaaaatcaattagtattcgaacgatgttaatagctgggactttacttttagccataattccatctctagttataagtgtaatgtccatatcagttacatccaaaaataataaaaaggatactcaagtcaattcagaactattagctaaaataggtggaaattatattaatagtgaaatggagtattttatagacatattaaattctgtatctaataatgaagaatatagtagcttagataatgaaattgataagaatgttcttcaacataaattcgcaatgttcttagattctgattctaacatattagatatttattatagcgatataaacggaaatactgtccttggaactggagatagctttcctgaaaactataatgtattagaaagaccttggtttacaaaaactatgagtagtaatgaggaatacctcatttttgatccatataaagataacttaacagaacatatggttataagtatatacaagaaaatagtgagaaatggacaagctttaggagtattaggtattgatattgatttatctgtgttatctgaatcattatcatacataaaattaggagatgaaggccatttaataatcgtagataatgatggtagtattatagtcagcagtaatcacgatttggctggaagtacagaagcctctgagtatgagaactgggattatatttcaaaaaatagttcaggttcaataaatacgtcctatgataatacaaactataaagtgtattttgaaacagaaacattaactgggtggaaggtattaattaaaataccagtatctcaaatgaatgcggtaagaaatcaagttataataactaatgttattgtaagtggatttgtaattatattctcaatattagttgttattttttcttctataaaagtatcaaatctaattgtcgaaattaagaatgcaataaacaaagcagcagattgtcaattcaattttagatttacaagtagtggaaatagtactgaatttaaagaagttgaaactagttttaatagaatgcaagaaaatgtaacaaatttaattgcgcaagtaagtaattctatagaacttgtaaataacagcgcacaagattcagtaactatgggtgaaaatatattaacatcaatgagtgatgtaagtgaaacaataaaccagatagctgatggaacgatgcattcttcaggtgatttagaagaaatatcatctaatttagaagttttatctaataatatggatgacattaaaactatagttgaaaatgttacaaacaaagctgttgaagcaagcaaacttggtaaagaaggaattaacatttctgatttagtaattgataaatcgaaactaacaaaagaaagtacagatagtgttagcattgttgttaaaaatgttgcagatagtttaaaagaaatcgaaacaatgaatgagactatcggagctataactgaacaaactaatttattagcattaaatgctgcaattgaagctgcaagagcaggggaatcaggaaaaggttttgccgttgtagctgaagaaataagaaaactggcagaagaaacagcactttctgctaagcaaattaatgagattattaaaaatataaaaagtaatactgaaatcacagttgaaaaagttaatgatacaagtaaaaatgttgttgatcaagaagaagctataataaaatcacaaaagatcttctcaaatattatagattcagttaatgaattaaattcaggtgttggagaaatatttaataatatttctaaaataaacactatgaaagatagtgtagttgttcaagttgctaaactttcagtaactttagaagaaactgctgcaggttcagaagaagttgcaagtttatcagaagaagttaccaaagcagcttctgaaaataaagaaaaatttagtgaattaggaaactcagtgaaaaaattagaaaatcaaataactgaatttaaaatataggtaatccacacactttaattgctttataattttaaagttatataaaatcagaatttaaaatatagccaatttgtaccctcttagatatatttatatatatgtataacttttttaaaattaaatgttggtaatatataagttgtaattgtaactatacaatcaataatatttttaccaacatttaactataattaagtaatcagaaagattaatagctacaaatctaattgattaactccatttaaaaaatattcatatataacttttgatattgatcctattattttacatccttctaaattgttatttacattttgtgcaaacactccaataaaataatctatatttttagtgtaaaatattcctacatcattattcaaattatctaactcccctgttttattagccaaaaccacattgtcttttatgtacctttttaacatggaattatccctttgattctttaatgtctctaatgctcttctacatatttctttttcttctatatttcctcgatataatccttccattaataaaagcatatcattcaaggatgtataattattttttccttcatctatagctttaaaatccatcatcttacgttgcaattttgtactattcattgaaaacttgtcaactgtgttattaatgttatctaaaccaagaatatcaataagtacatttgttgcactgttatcacttgatattatcatccattccataagttcttcatatgtacaaatatctaaatcctgttcagttataacactatattcaactttctgtattttgtctatttcaaattctttgcttaatggtatttccatattatctactcttcttaacgcttctataaatattggaattttaattaagcttgccgaaacatatgatttattctcattataattgacaattaccttgtcattagtaagatctttaaccaaaatacctatgtctgttccactttcatttattatctctttaattttttcgttcaattccataatatccataaaactccccccatttatataaattaaaatcgttttttaaatcaaatacattcaataattatctatcttcaaaatactattaatttgaagatagatatattattatattagattttttattataattactttgcttttaattaaaaaataaataaagaagccactacatatctttaatgtatcgtgacttccttgccaataatatactattgttatgataattatattgctttttcttatcattgtaaaatgcttttattaattttgtcctaatatgtataatatattatcatatttttaatatttacttataaatattttataattatttgtttacttgtgctttttttatgatataataaaaaaggttaattatataatattttcaaattttaaataaaaataacaattcaaaggtgaacattaatatataaacttgtattttaagtttatatatcttgttgacctttttttattacttttcatttttaaggaggcaattttatgaagaaaaagattttagcaataatacttagaagtgttttaacaattactagtcttgctggatgtggaagcactcaaccatcaggaagcttaagttctgctaatggcaaaacatttatttttgcacaaagtgcagatccaagaggtttagaccctgcttttgttgatgatggtgaatctgcaaaagtaatgtgcaatatttatgaaggtcttgttaagtatggtgatgataatactaatatcgaaccatgtcttgcagaaagctgggaaattaatgatgctggaacagaatatacttttaaattaaggcaaggtgttaaattccatgatggaacagattttaatgcagatgctgtagttaaatctgttgaaagacagttaccaccaaatgctacaagtgatatgccttacgcatcatttacttataatggtgtaaataaagtggaagctttagacgactacacagtaaaattcactttagattcacccaacacaccgttcctagcaaatcttgcaatgactcttgcagccccaattgtaagtccaactgcacttgaaaaaaataatggtaatttaaatgaagctccggttggtacaggcccatttaaatttgtatcttgggataagggtgaaaaagtaactcttgaaaagaacaatgactactggggtgataaagctaaactagacaagcttataatcaaaattacaaaagaaagttccgtaagagcaagtgaattaatgactggtgaaattgatgctatggatggccttgatccaaatgatgttgataaattaaaagaaaagaatatgaatatcttctctaatccaggtatgaatattaactacattggatttaactgtcaaagagagcctttcaataaccctaaattaagagaagctatagcacatgcaataaacagagaagaattagttaaatacttatatcaaggatattcagatcctgcaaatacaatacttccatcatttattcctggttataagaaagatgttcaaagttatgattacaatcctgatactgcaaaatctatgttaaatgaactaggattatcaaatttgaatatccatatgataacttattctccttcaagacaatataactcagtaggtggacaaaaacttgcagaagcagttcaaaattacttaagtaaagtaggaattacttcaacaattgatgtttaccaatggactgagtataaagaaaaagttcaacaaggcgaaggtgatatgttcttctatggatggattggtgataatggagatccagataactttttatcattgcttgattcaaaagaaattagttcaagtttaaattctgcaaaatattcaaattctgatgttgattctttattagcaaaagcaaaagctatgcctaatggagatgagagaaatcaactttatggaaagattcaagatatagctgctaaagattctccatggataacactatcttatgctaatcaaatggctgcatattctccaaaagttaaaaatttctcattgcacccaactggatcaatattcttcaagaatgttgataaagataattaatgaactttttcatatgtatttttcaataataataaagttaaggttcctaaaatttggagccttaaactttactatttatgtaaataatttattatgacaacaaatcttctgtgtttatttttattatttaataaaagtatctatcttgcaatttacaattggtaaaatactaccctttgcatcatacatactataatctacaaaataacttcatattttgctttttacattaaaaattatttaaaattaaaaaaagaggtgactttatgattaaatatttttttaaaagacttttattagttattccagtaattttaggagtatcaatattggtatttttcattatgaacgttcttgcaagtgatcctacttcaataattttaggacaacatgcaacacaagatcaaattgttgcactaagaaatcagcttggattagacaacccattatatattcaatattttgattttatgaaaggattatgtactggagatttcggcacatcacttattactaaaacatcaattgtaaaagaaatagcttcaaggttccctgcaactattgaacttgcaattgtctctataatcgtagcttcagtaataggaataactcttggtattctgtctgctgtaaagcaaaattcaattattgattatttaagtatgggattatcacttataggtgtatcaatgcctgtattctggcttggtcttattttaattgttgtattttctgtatcattacacattctgcctgtttcaggaaggataacaataggtatggaacctgctaaaattacaggactttatcttttagacagccttatgacaggaaattttgcttcattttttgatgcattaaaacatcttgttcttcctgtttgtgctctttcttcatattcaactgcaataattgcacgtatgactcgctcaacaatgcttgaagtattaaataaagactatattagaactgcaaaatcaaaaggtataaatgataataaggttattacaggacatgcacttagaaatacattaattcctgtatcaactgttatcggtcttcagctcggttcacttttaggtggtgctgttctaacagagacagttttttcatggcctggaatcgggaattatgtaattgattcaatacttaaatcagatattccagttgtacaaggcgcagttattatgatggcaataatctttgttttagtaaatcttgttgtagatatactttatggatttattgacccacgtattaaatattcgtagaagaggagatgttgttatgaatacagataatgttatgttaccaaatgttaattcatctaaaaatacaagcataaaaagaaattatcttcaaaaagctaaagattttttctctgctttaatttctaataaagctgcattactgggtttaattataattcttatattaatttttgtagcattgttcggtaaatttcttatgccttatgatccttacactggcgaactatcacaaagcctacagtctccttcagccgctcattttttcggtactgatgaacaaggaagagacattttttcaagagttattgacggtactgctgtttctcttcgtgtaggggtaattgctgtagccatatctctatcaataggtacttttttcggtgcggtgtgtggctactttggtggaaaaatagacatgatacttatgagaataatggatatcattcttgcctttccttctatgcttttagcaatagcttttatgagtgctcttggaaaaggtattgataaagcagttattgccataagtattgtaacaattccagaatatgctcgtatagttcgtggatgtgttctatccttaaaagaaagtgaatatgttgaagctgctaaagtaattggaaataatgattttacaataatatttaagcacattcttccaaatatactttcaccaattattgttcgtgctactttaggaatttcaagtgcaatcttagatacagctgctcttgggtttttaggccttggagttcagcctccactagcagaatggggaactatgcttggttcaggacgaaattattttaacaatgctccttttataatacttttccctggacttgcaattacaataactgtacttgcttttaatttattaggtgatggtttaagagatgcactagatcctaacaaaaatgcataaggaggctttcaatatgttattagaagtaaaaaatttagcaactcaatttataactaaaaaaggatgtgtttcagctgttaacggggttaatttcaatattgacaaaggtgaaataattgctgttgttggagaatctggaagtggaaaaagtgtaacttctctttcaattatgagacttttatcaaaatcatctaaaataaaaattactggtgatataaattttaaaggtgaaaaccttctaaataaaagtgaaaaagacatgcaagaaatacgtggaaagcatatctcaatgatttttcaagaacctatgacttccttgaatccagtatatacaattggtaaacaaatttgtgaaacaataataaagcatgaacatctaaacaaaaaagaagcaagaaacaaagctattgaaatgcttaagcttgttggaattccatctcctgaaaaaagaattgataactatccacaccaattgagtggtggtatgagacaaagggttatgattgccatggcattaagctgcaatcctgaacttttgattgctgatgagcctaccactgcacttgatgttactatacaagctcaaattcttgatttaattcttgatttaaaaaataaactgaatacttccgttcttctcataacacatgacttaggagttgttgcagaagttgctgataaagtcgttgtaatgtattgtggacaagttgttgaaaaagcttctgttcatgatatctttaatgacccaaaacatccatatacaaaaggacttttaaattcaattcctaaaatagatgaagatactgatcgtctttttataatcgaaggtagcgtaccaagtccattagatttgcctaaaggatgtaatttcagtgaacgctgtccatactgcacagagaaatgtttagaaaaagaaccctctctgatttctcttcataacagagaagttaactgcttcttatatgaggataataatttagaaaatgctaacttaatggaggcagaataatatgaaaaaattaatggaaatacaaaatcttaaaaaatattttccagttgaaaattcttctttcttcaaaaaacctcaatatgttcaagctgttgatgatattacattggatatatatcaaggtgaaacacttggaattgtaggtgaatcaggatgtggaaaatcaacaatgggaagacttcttgtaaatctcataactccaactagtggtactatactttttgatggtaagaatataaatttactacgtaaggaaaacagaaaaaatctaagtaaaaatatacagattatatttcaagatccatatgcttcattaaatccaagaatgactattggagatattataagagaacctatgaaactgaataatattgctaaaggtgaagaacttgaaaaaagacttgataaattattaagtcaggttggacttgctccataccataaagacagatatccgcatgaatttagtggtggtcagaggcagagagttggaattgcacgtgccatatcagtaaatcctaaattaattgtttgtgatgaagctgtttctgcacttgacgtgtcaattcaagctcaagttttgaatcttctagatgatctacagaaagaacttggatttacgtatctttttattgctcatggattaaatgtagtaaaacatataagcaacagagtgggtgtaatgtatcttggtaaacttgtagaaatttctgaagtaaaagaactttattcatctccacttcatccatatactcaagctttactttcagcaattcctattccaaatccagataaaaaaagaaatagaattatgttaaaaggtgaagtgccaagtccaattaatcctccaaaaggatgtagatttcatacgagatgcccaaaatgtaaagatatatgtatgaaaaaagaacctaaattagtggaattatctagtggacattctgttgcatgtcatttttatgataaatgatattaataaagctgctttaaaaaagcagctttattttcatatataaggattctactttcttaaattttctatttcatctaaagtcaatcctgtttttatagctatagtttcattgtctaaaatatccaataaatttttagctatttccagagcttttttcttttccccttcttcgagtccttcctgacgcccttcctcaagtccttcttgacgtccttcttgacgcccttcttgacgcccttcttggagtgcttcttcaagtttagtaacttcatcatgtaatgccatttccctagataaatatgctgctctctcttctttgctctggctcatcacattcagtatgtcaaatgctttatcaatatttttattaacaattgccattttcttcaactcctctcttgaatctgcatttataaaattaatccactgggaaagcatatcgttcttttcataccccttaagttttggaatctctataaaatgaatctccattaaatttgtaagttcaaaattttcttctgtttccttaagcctatatacactatgatactttttactttcagttgaaatgaaatctaaaatatttatacatattgttctgtttaatttcttatatatttgacctatctgcaattgttccatatatattttagaccaataatacagactccttgctggcatatatattgttcttgaaagctgtatctctatatctatctgaactccatcattaattgttgcacgaatatctaaaatacttttcttatctgcagtattttcctttgttatttcattattcaatatactcacatcattaatttgctcatttataacacaacttaaaaacgaacttagtatatctttattattttcgtcaccaaatattttcttaaatacataatcatttttaggactcataaaaaattcattattactgttatacatatacattctccagtatttctattttttcatcttttgttataattcttatcattattatactatattattcacatacattgaagatttcaatacatgaaaacagtggcaaactctatgcttttgcataaaacttaccactggaattttccggacctctcgggcgctactgagggatcttgtgactgaagttacttttggcttctcagggatactaatgacttacctcttttctaataatgtttatttcatcttctttcaaacctgttagttcaactacaattgaattatccatccccatgtttattgcttttatagctatttctctagccttcttttctattcccttttctattcccttttctattcctttttctattcctttttctattcccttttctattgcttttttctgtatattgtctaaagtcttacctaaattacttaccataacatctacctcctcctgattagatttattaagcacatcatccacttgtttttgcatttcttctttcaatcttggttttactatatttttaagccactgcttaaatacactaaactgttctggcgatatttttttcagtacatatattatttttcttaatcttcttattagttcttcttcattcatttcttgatctaataaaaatattgctgataccaaatttgacatatttaataattcttcatcgtcatatctgtttatatcaaacaacatatacttaaaattcactatattatcttcaaacaattcatatccacttagcatttccttaaaattcatattagctgtccatttattttttccattatacagaactataggaattattgctggcagtttaaatgcttttcgttttctttgatttttatctgtatttttaagaatatctctccatacttctgtcatataaaataataatctcatgggcatttgaaaatcaacttttgattgaaattctaacaatacataaaattatatttacaaaactaaatctgtcaacataaaaaccttcgcaaaacaaatattccacgaaggttctttctatttattgattataaccatttttatgagtatcatgccataaccatgcatctttaattatattttcaatatttgttctaataggattccatcctaacatttttcttgctttatctgatgaagctataagtttacttggatctcctgctcttctttcacctattattgcttttatatctttatcagttacttttctagcagtttctactatttctttaactgaaaatccttgactgcttcctaagttaaaagtattactttctccaccatcagttaaatatttcatagctaatatatgtgcttcaactaaatcaactacatgaacataatcacgtacacatgtaccgtcttcagtatcataatcatcaccaaatatagtaatatgatctcttttacctaaagctgtttgtaatactattggtataagatgtgtttctggattatggtcttctccaatgcttccatcatcttctgctccagcaacattaaagtatctaagtgcaacatatttcattccgtaagccttatcacaccacttcatcatcttttccataacaagctttgtttcaccataagtattcgttgggcatgtttccatatcttctgttataggaacctgtttaggttcaccataagttgctgctgtagatgaaaatactattttattaacattatgttcattcataacttctaataatatctgcattccatagacattataacagcatatgaataattctcagttacaaactatatactttttgtataagattgctactgagaattattatttacccctatagtaattatttaattttattatttatacattttttcataatacttttgataatcacccgaagtcacgttattcatccattcttcattatctaagtaccattttattgtcttctttatacctacttcaaaagtagtttcaggataccatcctaattcttcttttatcttatctggtgctataccgtatcttctatcgtggccttttctgtcttcaacatattttataagattttcagttacttctttatctacattttcatttatatatgatataactgtctttactatttgtatgttagttctttcattatgtccaccaacattatatacttcaccaagtcttccaccattaataaccatatcaatagcttttgcatggtcttctacgaataaccagtctcttatattaagaccatctccgtatactggaagatctttatggcttaaacagttatttattaataatggtataagcttttctggaaattggaatggtccataattatttgaacatcttgttatattcacaggcattttataagtatcagcataagctttaaccatcatatctgaacctgctttacttgatgaatatgggctatgaggatctaacggtgttgtttccatgaagaatccttcatctccaagtgatccataaacttcatctgttgatacatgaaggaacttaactccttttttccatgttccatcttctttttcccatgcttttttagcacagttaagcatatttactgttccaagaacattggttttagcgaatacttctggttcttttatacttctatcaacatgcgactctgctgcaaagtgagcaacataatctatatcgtatttctcaaaaagtcctgaaactagtccactatcacatatatctccttgaacaaatatatgtctttcgtcattttcaatagattttaaattttctaagtttcctgcataagtaagtttatctaaatttactattcttatatcttcatatttgtttaacatatataaaacaaagtttgatcctataaaccctgctccacctgtaactaagtatgtcttcattatcctaacccctaacttttaaattttctataaagctttttatagcatcctgccagtttctcatttcatcaccaacagtatttctaagcatcatattatcaagtgatgaatattctggtgtagaatctttttatttctccaatgttatcactgtatacaacaaattatttagaaatattaaaatcagaatactgacttaaatctaaatcctttaaatttggatgacacttatctttttctgacaataatatattatcaattccctctaaaggccattctatatttatatctggatcattccacataactccaccatcatattctgggcagtaaaaatctgtacatttataattaaacactgcttcatctgaaagtactacaaatccatgagcaaaaccttctggtatataaaactgtttcttattttcttctgttaatataactccaacatatttaccatatgtttctgatccagtccttaaatctactgcaacatcaaaaacttcacctttagttactctgactaattttccttgactatgctttttttgaaagtgaagacctctaagaactccctttgatgattttgattcattatcctgaacaaaagtcatattaagtccagcttctttaaaatgttctgcattatagctttccataaagtatcctctattatcgccaaataccttaggttcaatgatgtaaacaccatctatttctgttttattaaaattaaagtttcccatgttttcatccctttcagatttataaagtaacagctgcttctgatttagcttttttattttcaacttcttcaacaatatccattaagtactgtccatagcctgtcttcattaatggttttgcaagttcgataacttgctctgaagatatccaatcttttctataagcaatttcttcaaggcatgcaatatatgtaccttgagtactttgaacagcttcaacaaaattagatgcttgaagcatagatgcatgagttcctgtatcaagccaagccattcctcttcctaaaagctgtacttttaaagaaccctgttccatatatactttatttaaatctgttatttcaagttcacctcttggtgaaggttttaacttcttcgctttttcaactacactattatcatagaaataaagacctggaactgcatatttagactttggatgctctggtttttcttctaatgaaataaccttatcattctcatcaaattcaactacaccaaatgcttttgggttttgaacataataaccaaaaacataagctccattatgtaatgcagcagccttttttaaatgttcactgaagctttgtccatagaatatattatctccaagaaccatagcaacactatcattacctatgaattcttctcctattataaatgcttctgcaagaccatttggcttttcttgaactgcatattcaatattaagacctagttcttgtccatctttaaacagttctttaaaattaactatatctcttggtgtagatataattaatatatctcttatccctgcaagcataagaactgacattggataatatatcattggtttgtcataaataggtaccatctgctttgacatagcttttgttactggatatagacgggtacctgaaccgccggctagaattattcctttcataattttactttcccccttatctcaataaattgagtaatttctttactccttgcaactaggtcatttaatgcataattagatgattaagtgatattaatcttatttgtttaaataataccttttctatataatacttgtataaactactttttgataattttataatctataaactttattgaattataaaggttttttatataatttgagttaatatatattaatcaatatatattcctaccatatttcattcttataatattatattttttaacattatattgtgactaatattactctacatttgattctaatcaaccttctgttatttatctcacttctgttattcctctaccgcctgacatatataaagtatcacctattattgtgtcacctaagctacttgttagaagaactgcatactctgcaatctcttctggcatcgtatatctccttataggattctgatttgtatatatactatttccttttttatacggttgcatagatgtagcagtaggtcctggtcctattccatttactgtaattccatagtttaacaaactctgaccaagcccttctgttagtgcttttatcccccactttgatagtctatatggactccatgcaggctccaatccagattgtgatgaaatcataagaatatggccttttatttcttcttcaatcatacgcttcgctaaattttggctaaagaaatacgttcccttcaaattcaaatccattatagtatcatattcatattcatctatgtttaaaaaagctaaatcattacgcggaatatgtattcctgcacaatttactagtatgcttatatttccaaacttcaattctgcttctttaattttatttgagaatgaagaaacattatacaaatcgagtattatatatgcacaatcaattcccaattcatctgcacatgcttttagtttatcttctttcgtacctgctataataaccctacatcctgattgaataaatttctttgctatcgcaaatccaattccacctgaaccgccagttattaaagcaatttgaccttctagtatttggttagcatcaacattatgttgaattggaactatttccttttctttgaacaaattaattgtacgttttactatcgacttaattcccatattttaatatttcatctcctattccatagtatcctctgcaagtttttttcttgaattatatatgcaaattttagcatacattataggtaatacaccaatatatgccattttcaatttttgcttaagtcctacattacttttaattaatatacctggtaacatagtttttatcttaataagacattctttatactcttttgaatacttatcctttgaatttgtagcaattataagcattagcaagaagttataattcttccatatatgccaatttaccgcattatacagcttaggtgtttttattataagcttatctccaatatttttaatattatttaatgcattaattcccattacaacattataattagttagtccactgcctgaattatttagtctataattatatacttttctatgacctactccaacatgatttgaacattgtgcagccattgatgcaaaatataagccttctccagaccatggaactgaaaaattaatattattatttcttaacatatcagttttataaatcttattccaaggacctataggcatatgaggatatataattttttcagttgccttttctgaagtccatatttctatactgtcattctcagtttgtacttgatccctagttgtaaaaatcttatctgataaggccatatctgatttagtttttatagctaaatttaacaaatattctacacaatctaatgataaccaatcatctccatctattatcataagatattcgccagaagcaatttctatccccttatttctcgcctcacaagcaccaccattttctttgtgaattacaactattctatcatccttctttgcataattatcacaaatctgtccgctacaatctggcgaaccatcatcaaccaaaattatttccaaatttctatgtgtctgattaataattgattttattaacttatctaaaaacttttctgaattatatattgcaacaatcaatgaaactttaattttttcaattttattcattatttctctcccctaatttttcataacttaatataaaaataaaacattttttaagtaatctagacataataaatcaccaaaacataaccactgataaaatagttgaacatatttaatcatttaattttagctatttgccctaattatatcctttaaataatctactcctctttttctttcatcttctaatactttttctgtatccataagtatattttctaaaatcatatcataattcatttgtttttcttcattattaacataagcattcataagattatacttattaagtaacatatctaatcttgaaaattgatcaacatcttttcttctaaaaaccaaaaatggtgtatgcataataattgaaaatactgaaccatgaaatgaatccgtaaatacagcttctgcatcattaatcatattaacaaattcatctggtgctggaattatgtccccttttccaacttcatttcctgctatatttattatcttagcatttcttttctttgcacactcctgaatattgttccatacaaaatcactttgtttacttaaaaaataagttaatatgtatttctccttaggtacaatatatttcgactcacttattgactcttgccattcctttcggcttaagagaaatactggatctggtaatagtaaggcatctaaacctattagactatttataatagatttccctacatattctcttactgaaagtttttgaaaatccaaaatatatttgctatatatctccttcatttcataaggaattttttctactccaaatgacggagcatatgcataacgtttttcctttggcgcaaatctaagaaaatacaattcagtttcatacttcttatccattaaatgcattggtgaccatatctgatcactaccagctatggcaatagaatcttcaaaatcaatattaaataattgattataattaattctttcaaaacatagtttattgttaaactctttaaaggattttcttttttttctaatgtttaaccatatcctttgtttcttactaatagatggcaaataagagcatatatcctttataaaatttataaaattttccttcttatcatccatcaatatggtaactggtacgcctcctatcttctgaataattctacacattgcataattctgaagtcttgtcccataattatcatatttataaaaagttgtaatgtaacatttcattcaatttcctccatactaatatttccattatattaagctatttaacattaatcttctcaaatactaataactaggctttcttaaaacttactatcaaaaaaagaaagaacaaaattaatataataatatttccctagtaaatgatataaataaacatttaattaaatatgatcaaaatattccgccctatctttcaataaaaatcatcccattatagtattggtagtatttatatttttttaaatatcaagtaatctttgttatttctcctttttgtatatgtatttagagcttaagtaataatatatccaatttactactagctaattattataagaaaagttttattatcccactcattctctcttttaacttcattctgtaaaagattactgccaaaaaaatttatacggtaacaatcttgaaaatgccatgcaacttgcaaatcccatagctaaaatagagagtaaataaatccatcttttgaattgtctattttcatatttttctaataaattaggaataaaatatataatatatattaaaaaataatctactaatctaaacatgataacattatttataaatgcaaacatcataaaaattgctatttcagtcataaccatcataaaaataatttcattatcggcattatcatcatgtaattttaataatgcataaaaaataaccataattaatataaaagcaattattattctgttaccatcactctgctctacaaccataactccattgtctcctatatatccagaatatgatggaaaaattttaataaaaaataaaattactttttcatagcatgcaacaaatattccaccgattcctataccataaatcaatatttttttattaaatttatgacgaaatacatatataatatatataataactaatacaattgctgaattatgaatagaaattgctaaaagcattataaataatgctcttattctttttcgtttaactaaaaaatagtacattataagacttaatgcaactgccattgattgtctagctatattaaaagcagcaggatagaaactaaaaccaatataatagaataatgtcatgactaagttatctgattttttataagaaactatagcaattatactaattgtaataattgcattaaaaaatataataacttgttcactatttccccagaaaaacgcaacaatagcattatacaatgcatatcctgggaatttatcaaagtatctcgcaacatcccatccattcccaatatcattaaatatattacaatacaataatgtatctggacctactgatgtattccttaatgctaaaaataacccaaaaactgctatgaaataaacagtcaatattttctttgcaattcttgtatttatttgtatttcattataactacacttaaaaagtaatccccctataaaaaataaacttataagatttattatataaatcgccataaaacctatatcctttcaatgcattatacggtatctactgaaaagagaaacattatctttgctatgattttttaaataattccaagttagtaggatctttaattaataatttttctattttctttcctatatgcagtactattaaattatcttgtgttaaaaaatttattgaaatacatcaatataaacaccccgaccataagattaactaatttatcacttaaatctattcctttatcaattactttttttaaataaaagataactctaagtcttgtatctataaattaattaacattttctctaacaaattttcctataaagtatcatatttttttagtaatttaaatatgaatctatttcttatactcatttcaccttttttccattatccaaaatatagccttttcgattattaactttataaagctataattaattgatagtaatagtataaaagtaactgtttgaagaatataaatatatttaggtgaaataatcataattattgattgtataaccaataatgagtatgataaataatgagtatataagttaatatctaatttcatatactttttaacatttaatattctaatttgccatactataaaatatgaaaccatagtcgctatagcagctcccattgcacctatcatctttactagaaaaatatttaacatgatattagataatgctcctatcatagtagaataactatatatctttgaatctttaacggctgaaaaaatcccacctatataacctgacattgcaccaaatactattgatatcaataaaaatggagtatatttccaagcctcataaaaatccttagcatataacaatctagcaaacaccttagtagatactattaatcccgagcatataacaacagtaaaaaaattatacgcttcatacatttttgaaaaaaaaccatccttatcatttttatcaaaatctctaacagcagaaatttgccaagcttgcattataatattttgtattatgtttaatattgtaggtattttatatgcaattgagtaaattccatttacagaaacaccacaaaaccaaattactatatacctatcagatacattatttatccaccaactaattgaatttaatatgagaggtctgcaatactctttcatattcttacatacttttttgttatattttaagcctataaatttccaaattttaatttttaaacacaaaaaaacacatggaataagattagctaaaatattagcatcaaaatatccacttaatcctctttttaaatatattagaaatattatatttccagttaacatgactactgtatttatgataccagctattgataaatataatacttcttccaatccctttacgaactgtatcattaattgataaaaagaattactaaaaaacaatccccaaaaataaaaagtatattcctttattgataaagaaatattaaatatatagttaataatcaacaatatacttataataatcatactataaatttggtatcttaaagctatactaaatattgtctttttatcacttttctcatccattgcaaaacgcattacagcatccattatgtttattgtcaaaattggaattagcagtgaaatagttgacataaacatatcatatattccatattcttcagtcgttaatatattagtatacaacggaattaataaaaaagttaatattttagttccaaaactgcttatacttaataaacctatattttttaataaatatctatactgtttcatgtctacttaccatttttagaataatcttcttaataatgcctttaaatttcatccagttagattgccaagtagcatcataatgatgtatagaaacagtattctttgttatatttatgtatccactaatatagtctttgggacaaaaatattccttagaaaatatcataatatcgccaaccaattgagaatctccatttaataaaataccatgactttttagagttttagttgttctttgtactattgtatacaagttatatttgccatcttctaataggaacttttccccagtatagtcatttagaatctcttttaaaaaaggatgtgatttttccgctccaataattaaacctggattaatatttaactcatcttcaaatccagcgaatacattatattgtaaaaattcataaattggttttattaattccacatcagtatctaaatatactcctccgaatttatctaaaatccaaaatcttgcataatcacttacaaatgcatacttctttacttcatacgcttgtttaacgtataaattaatatttatatcaaaattttcttcattccattctataatttcaaaatctggacaaaactttttccaactatttatgcacttatgaactttttctggctttgttcctttaccaaaccaacaataatgaatagtttttttaatcattaatgctctccttttacctatatttctttaaaaaaactttatataaagtcttatatattcttctatttcctaagaatattaaatattgaagctttcttgttttactaagattttcattaaaaaataatttcgaaatcgattcttgtattttgtttattaaaaacttttcaaaattattgtctatactatctacaagtagcattttattataaataacaaacatccaatggcaatatgctaaatttatattatctttcaaatctggatattcacctataataaatttacattcttcatcaagtgcctcctttaattgcatagtctttggattatattcatttccacctatagatgttgatcttttacaataattataaagtacctttgaagtatatgttattttttctgctctatctataatcttatatgtagtaaaatgatcttcatataattttccaactggatatttaatatctttaaataattctcttttatatagtttattccaagatacaacatcaataacatttgtaaataaaaatttacttaatgcttctttcttagaataagttgtaatctgtgtgtttccttttaattcctcaatattaccactatcaaaaatttgtttatggccacaacatactatatctgatttagtttctttcattaatttatataattcttctatcatatccaattctatataatcatcactatcaataaatactaaaaatgatgattgtaattctttaagccctgtatttcttgctgctgataatcccatatttttttgatgtatcactttaattctcttatcatttcttttgtaattttcacagatttcatgacagttatctggagacccatcattaaccaatattatttctaaatttgaatatgattgattaattatactgtctaaacatctacataaatatttctctactttatatattggaacaatgatacctattctttcgttaaacatctatattccttcctttttaacataattattatttaggaaatccctaattccacagaatcctgccttaatgaatttcttcttattatcaaatagaaatattattttaaaccatttatataataatatccctaatatcttaatgtctttatattcccaaaataaatagtttaaattacgtatctgataataatatctcaatggttttgcatatccatatttaatttttttcccaaataattcaaatgattttgtaatagccggtgaatgatttaaaatcacatctgaacattgaataattttataccctttctttctagcacgataacaataatcataatctacacaatctataaataacttctcattatagattccaatatcattatatttatctatattaagtaaattaccagactgcattgctaattttaattctttgaattctttacatacattcgaattcatcctgtctgtatgaaattgaggtactagaaacgcaatattatctaaagaatcacctttacatataatttttttatagttatcaatgtaattttctctaaaatagctatcttgatccattgttaaaacccaagagcatcctacatttttacatgaattaattccaatatttaatgcatatgctattccataattatttcttaaacttatataataaatattttcaccaattcctttaaacaattctgaattatcctttgaagaattatcaattaaatatagataatctatttggttacagtaagactttatattattaactacatcttcttctggattaaatagtaccgttactccacctactaacataaatactccccactatcattatcatttttcaaaatattaactattctttttcagattcattgttatatctacaaactcttcataagaagagtatgtctttttagtatctatgaacctttttaaactgtcatcataattgccagtcaatgcaagaatatctttatgttcttttataagctctttatctgaatcaacattttcaaataattcgataaattcacacatatcagctttcgatggaattgtattgtatctattaacatattccttcaaaaatgcttttgcttcactttcttgttcaaaagctcgtttcttttcataagataaaatatcgttaattacttttgcaggtgctccagctactactgaattatcaggtatatcttctgtaacaacgctacctgcaccaatgataacattattacctatcgtaatattcttcaatataatactattcattcctataaatacattatttccaatcaccacttttcctgctgatccatatactttaccagttaactgtttcaaaactgcccaatcatacccatgagctaaaattactactcctctagttatttccacattatttcctatagaaatcataaaaggcttatttgtatcaacaaaattggttaccggatcatgaaagtgtacattttcgcctatttgtacaccaatctttttcaaatattttatgtacatttcagaatcagctttgtatccgcgtaataaaaatttatataactttttaattttccccattttttctcccatgcattatctaaacataattattaattttcaatagtatgttcattgctagtgaatacatcactttattattcttagttcattctattttaaaataattaatttatattaatctctaatcatatattttttcaaattcttctataacacgttttatattaaatttacttctaacaacttcttcagcattttttatcataaattcgcatttctctgtgtcatttatgatagtttcactagctactgctatctcgtttaccgcatccattttaaccaatattccattatcattattaattaagtttggaataccatctacatcagtcgcaataattggtttgcctgctatcatatactctggaagtactaatccaaacccttcccatcttgataaaagcatagcttgatcaaataactcaatatatttcattggttcatcaacccatcctgtaatcaaaacactattttctaaattacttcctttaataatttcttttactttaccttttaattcaccgtcacctaccattataaaaaaagctttaggatatttatcctttattttttttgctgcttttataaaagtatcaggtgccttttgttctgtaagtcttcctacagttcctattacgtaagcatcctcaggtattcctaattcttctcttgttaaagtgaatctcttcttcttttcttcatattcatcaatatcaatcccattgtatataacttttattttatctaccttacatactttattttcaatagcacattctttttcaaaatctgaaatggctattataaatgtacataaaggtgccaataatttttctatatagagataaattttctttttaatagaactacaattcatattaaaagcccatccatgtggattatacaagcttctgtttttaagtcctaaattagctattcttcctatagctcctgctttgctgctatgcaaatatacaatatcaggattatatttttttattatttttcgaatatgcactattgcagataagtctgattttaaatttatttctcttttcatatctacatgttcaagggcataaacaaggttctcatattttttattatcataatctaaagaacagacaagtatattatcatatttggatgaatccatgtttttaagaaacatattaatatatctctctacaccaccagctgactgaacaatatgcataattttttttttcatatatattttttctccattcttaacacgcatcttcatccccaaacaaaacaaagaatgtcttaaaaattaactttaaatccaccaaagtacttctatctttcacatattcacaatcaagcttcatccattctttaaatccaatagaacttctacctgagacttgccaatagcaagtaagtcctggttttacatcaagtcttttaagcatccatgattcaaatttcataacttcctttggaagtgatggtctcggtccaacaagactcatctctcctttgagcacgttaaaaagctgtggcagttcatcaatgcttgtttttctaatgaatcttccaaccctagttattctaggatctcttttcattttaaacataggaccgctcatttcattttgtttttgaagcttgtcctttaactcttctgcattaaccaccatagatctaaatttatacatataaaattttttacccttaagcccaactcgttcttgcttgaaaataactggtcccctagaatccaattttattatcaaagctacaatcaaaagtatcggagataatattactaaccctaatagagataataaaaaatcaattcctcttttagtaatatcataactcgttcttttgtttttgttttcgttttcctcttcccgtaaagtttcttcaatgttaacttgctccaatattattccccttcgtagtagcatccaaaataagatagttattaatttaacaaatccatacatcaatttgaattattactttttttttaaatttttattacattttattaaattattctttatatttcttaataaaattataacacaaaacctcaattatgttaataaaagctaataattattacattttttaatatttactataatattttctaatttttaattagtttattcatatgtaattgttatcttttgaaaattgaaaataaaaagttcttttttttgattaaattaccagtgaaatcaatatttttattatcaattaacaactgagaactttcctcgaacttctttaaattatcaatatctatcaagcttagtgcaccttttaaatccattcctcttgaagctgatatattatgagcatccgaaccaatgaaattatatactccatttttcagtagcattttagctgttttttgtacttcaacgccaaactttccttcaatacttccactattaagctgaaataagtatccttctccaataaatctatttattaattctggagtctgcataatatacttatatctttcaacatgtgcaattataggcgttatcccttttacttgaagttcataaagatgatcaaaaatactgctttcaaattttctcatatcaaactctataagcatatatctagaatcatttaaagttccaatatttccatcaatataatcagtcactatattttctgtaaaatatacttcctgcccactataaacccttatatctatattttcttcttgtaatattttattaatttctgccacatgccctttaacttcatcaatcttagcttcaccatactcaagaagataatgaggtgtagcaaatacttgctttattcctgactgttcagctgtcttaagcatttcaatagtcatttccatacttctagatccatcatctattcctggtattatatgcgaatgtatatctatcattattattcccctatctaaactaatacataaaaaagtaactttgcattttttaactgataaaagccaatactctaaaaaattttaaaggtattggctatatttcaacttactgatattattttttctttttatgctctccatcagttccataatagtaatagtatttacctttagtattttctactgcatgtaatacacatcctaatatattagctccaaccttttctaaagaatttttagcttctaaaacaacttctctcttagttctttccgctcttgtaacaagtattgttccatcaacttcagttgaaagaatctgtgcatcagtaaccgctccaagtggtgcactatcaagtattattacgtcatatttttcctttagctttgcaattaaattagtcattgctgatgatgataacatctcagatggatttggaggtattttacctgatgttaatatgtctaaattttcattacgcttttgaataacatcatctaactgtgctttccctattaatacttctgaaagtcctgacaagttagatactttaaaattcttatgtactgaaggttttctaaggtcacaatcaactataataaccttactctcattttgtgcaaatgctaatgccagatttcccgacaccgtcgacttcccctctgccgcttctgcacttgtaactactattgtctgtattttcttatcaaatgatgaatactgtatattggtccttagtgttctataagcttccgatactacagactttggctttctctccataacaaagccaacatgactctgattctcaactgctttttctaatttacttttaaaaaacattatattactcccttttttcctattcaaaattaagttcgttaggaataacccctattgctggtaaatcaagtatattctcaatctgttcctttgttttaaatgtgttatccataaactcaattaaaaagcttaaccctacgcttaccattaatcctaataaaaatgctatagcaatattcattttcttatttggacttactggtttttctggaactcttacactttctattattttaacattaccatttggtatcaattcagttgaatattctataaattgatcagtaactgattcaactaccttttttgaaacaactggatcaacattaatataacttatttctaaaatctgagtatccgctcttggagttactgtaagactctttaatacatctcctgcatccaaatctaaattactcttttcagtagcttgtccaactaaatccttagtctgaattacttctgcatatgtctttaataacttctgatacatctgtacatcattattattgtaagactgatcctgagttgcagtattttccttacctatgaaaagctttgttcctgcttcatattttggtgcaataagaaaaaagcttactacagctgatattaatgtagctgctaaagttattgaaagtatcatcttccatctctttgttaaaacatctacaatgtcttcaattcttataatttcctcattcattcttcaaattctccatttattatcttttttcttgtatttctttatatattgtaccattaaaatctaattgtgttaagtatttataggcttttttcttttattttgttgcattttatgattatattatttttatttttttaccttttaattcaaaacaattcattatttttaatatgtacctataattttcgttatatttttacctttttatttaatttatataatatgtttttaattttgaatttaatttgtaaagtaactttttgatttttattaacttaatgttaagtattaaattatatttcaacaaatattttatatataaatttaaatcctatatttaagatatattaagatagattattcaaaaaaattaagttagatatctatttttaagatggatatctaactttaacttactgtaaattattcaataataatctgctaattaaaacctatctattaattatagaattttccattcctcttaaatatttaataaaatcatctcttatttctggttttctaagggcatattcaactgtagcttctaaaaacccaagtttatctccaacatcgtatctttttccttcaaaattatatgcatacattgcttcttctttaataagctctaataatgcatctgtaagctgaatttcatttccctttccaggctttgtattatcaagtatatcgaatattttcggtgtaactatatatcttccaagtatagcagtattagatggtgattcctcaatagatggcttttccactaatccttttactttgcaaactctatcttcaataagtattccatcaactattccgtatttagatacactttctttctcaacagtctgaacacctaaaatactagttttatattcatcataacattctataagttgctttaaacaaggcttttcatcgttatatactatatcatcaccaagtaatatagcaaaaggttcatttcctacaaatgtctttgcacatcttattgcatgtcccaatccctttggttccttttgtcttatatagtgaatatcaaccatatctgatatatcctgaactaactctaaaagttcattcttattgttcttctcaagttccatttctagttcaacagatttatcaaagtgatcttcaatacattttttatttcttcctgttataatcagtatttcttcaatgccagaggcaatagcttcttcaattatgtattgaatcgttggtttatcaactataggaagcatttcctttggctgtgcctttgttgctggtaaaaatcttgttccaagacctgctgctggtattatagcttttcttatttttttactaatcatttattatttctcccttatgcactttttacatatatatgaaatttatcatttaatatcatatatatgattatatttccccaaaaattattatacattatttttcataaatgtaattataaaatctaaaaaatatctatgaaattattattattttataaatgttccttataaacaatgaacactcacaattattttgccatgtataggattcgctgatggaggagcataataaactttacaaatatagtctagagatcacctaatgatttcaacatcaattataaatatatcaatatttataaattataagcttaaactggtgcacttttttaatgtcatccatatatctattatgtaaacaccatgcagatgcaggggtgtgaataaaatatagattttaggaggtaatgtaatatggcagtaaacaaaatcgctgaaagtgcaagtttttcaattgaagtaagaaagggtacagactcacttggcaacccaacttacagtaaaaaatctttttctaatgtaaaagatggtgcagatcctgaaaaggtacttgctgttgcaaatgcagttaaatcagttttgtctgatgagactagaaatgtttatatgactgtaagtgatcagttagttcaagcataatattttaactaacccttctaaattttaggcagatgttttaatctgtctaaaacaatcatcttgctcttaaataaaataattaaactaaatccgtgtaccaaaaattacacgagatattttaaggaggaaatttaatatggaatatattttaactttaacttttatgactgaaactggtaagaaaaattctcttactatctctggtgttaaggaagatgttacttctgagcaagctaatgctcttatggataatatcatttctaatgatatctttgaaacaaagaacggtgcttatataagcaaagttgaggccaagcttactcaaagaaaaatcacaacttttgatgcagaataagagaaagggaactgccaaggcagttccctttttcttttctattttaatctatttaagttatttaggttatttaggttatttaattattctattcttgatttctaatatatttgtttacatataatcgaaaatctatttctttttcaaaatcatatatcactttattacagctttttaaatattcccttgcaaaatctgtatcgaattcattcatatataaaaaacatatatgtatatcttcataagaaaaaaagtctttaagcttttccaaaagagtctcttctaattcaaattcaaattcaattcttcttattgatttcaacaatatgagtatatctatatcacttatattttttctccaatgctcagtattataactgccaataacagccatagctacaatttcatcatatattttttttgaatcattaaaattgcttaataacataactgacttactatcttcattcatactaaacagcctccatattaatgattttttatcttacttcttaaatgtatttctatctcactcatttctagaaatatatccatatacatcacttcactaaaacagcattttaaaatatcttcttccacaccttctcttttataataatcatgtgtatatctatttcttagcttaactatttttaataaaaagtcacataatgaatcatcaaaaaaatcatgaattctagctctttttataagctctaacgatgtaaatccatcagtataattgtctgtcatcacaaggaatgtttcacacatatctattatatattcagtcaaatcctgaaagtatcctaaaatagaacgttttaaaaaaatagagtttgtcttattaaattctttcattgctcctattaataatgctaatgtatctttagatgattgaaatttcttttctaatctttcttttttatattcataataaggtgacatagtatccctccagtattgtcattcattatgaaatgtttaaattcatatgtatattataccctaatactattaagattttcacctacaattctcaattacaatgtttcatcaattccatccaaggagcttcttttcaagttcatcataattatattgcctttgtggaaaattattaaaagatagtttctttgaacttgagctgccccttataaaattctcgccactagaaccattgttatcatcataatttccttcgagaaccttaataaaattattaggcttaacaaaccagtcaaaggttattacccaccccctgtcattttgaccttttaaaaaacttgatttttcaatattacctatggcattgattacattacctgtaccatgttctttaattcttgcttttaatagcttctgtcttgtattttttatgcatgatatatttgaaatacctaataaattccactttttcattactttctctatactatccttatctacactaatctcatctaacctattctgggtttccatatggtcgtcacttggtataccatctactttttgttctgaaaactcataatttccatcacatttatatgattcttcatctgcatcagtttctgattctaaaaatatatcctgttggttatccttacctataatatcttcaatattgttatctcttagcgatttatcatcaccttttatttctgattttggtataatctcatcactattgttatagattaacttttcattagtatctgcttcatagacttttgtttttccgtaggttttacattcttcatatactttattggaagcaacaacaagtcttctcaattcatcttgataaacagtaggcttgtatctatctgatcttatataattatggagtttccaatgcttaactgcacaaattccattattaaaatctataataaactctgctgaaattaaaagttcaaagtctttttttcctgctcctatcattcttgttatcttttgggaattatttaaaaatccatcatcatctgcattcataataagatgtatatatagtgcctgagttgtaagcggcatatccaaaaatttatctgaatccaatattgtacgtgaaagcattcttctttcagccataaaaatccccctttatcattctttagaaaacgttttattttttatttcttttaacttatccattgcttctttataagttaatccactcatatatagcttgtttaattcatatgcatcttctttggttagcttgtctttaatacgtgcataaatcaatataacattcataaacatcatccccaaatctatatagtttacagctaacaactacaatataatcaatctaaaaacttaaccattctttcaaactttattattctaatcttcaattataaattcttcactgtccattaacctcattcgatttataatatattcttgtccctttggtgtaactctcgttgtataaaaaggaaatctatattgaccattttgtgcgaaaccttcaataacaataaagtatcctctgtcaattccacattgttttggttctgttgagttcttaaatataagtccccattctcttaaaatattccataaccttttttctcctataatcactccatatcttgaagctaattttgcaacttctctcacaagcagattatttttaccaacttttatttcattaatcaaatatttcaccacctctatacaaaaatatctttaatcatttctgggatatttttataatatcatcccagaataatattttcaaccttattttgtaaattatctatattttttacatttatattgcatttacatttattcgtttttataatatatctatggaggatttttttatgaacgataacaagaaaatgagagaaatagtcgcaagaataaaaaaaagacgtgaagaattaaatttatcatatgaagatttatctaaaagaactggttttggaagctctactcttcaaagatatgaaacaggagcaataaacagaattccaatagatagatttgaagaattagctaaaggacttgaaattgaaccttataagcttatgggatgggatgaagattatctactatcacaagataaaaaaaatgaaactgatggtgatatagtagatttacataatgcttttctaaaattaaacgaaacaggaagaaaaaaaatcctagaatatatctttgatattctttcaatagataaatatgtacagacttgtgaccaatctattgagataactaatcaagctaaacataattcgaaatataatcataataatgaatcagaaactaatacatatacttcatcttctcagccagccacattagaagaaatgtttacaacaatagctgcacacaatgatggaattgatcctgataaggaaaaagaaattgatgctgtatttttacaagcaatattaaatgataagaataagaaataatttttagaaatatgcctaacttcaacaagaaaggatggaataaatcaatgaattactttcataaagaatataatttatctaaatatgaaaaactgattatatatttagagagagaaggtataaaggtttatgagcttgatgttgaacctggtataccttatgccaaatatgttgatggtcatataggaataaatagaaatattcctgaaagtttaaaaatagaacttattgttgaagaactaggacatcatcgcaaaacatatggaaacataacagatcttactaatataaaaaatctaaaattagaaatcatagcaagacgtgaaggacataatatacttttacatcctgatgatcttttaaaaccactcagtaaaggtgcccgcaacatttatgaattctcagaacatctaaacatctcagaagaacgacttttagaaattattaagtattggaaaaatatccatggtcatggaattcatataggtgactattatttaaatttgctgcagatgtaaataatgctgattataaaatattttatttttttcatatggatatgtcacttttaatttatcaaacgtatatctaagttaacagctattaaaattatactatatgttcaaattaacttttaaaaattccaattacaatatataatatcaatttaaaaatggtaccttctttccttaaggaaggggccataagtttatggattacaaatacattgaaacattagttaaacaatcaaaagatggtaatgaaatatctaaagaaaatttagcaaaggaatttaccccttatataaaaaatttatgtagcaagactttcatccacggatatgatttttatgatttgcaaaatgaatgcttccaaagtctctttaaatgtgtgtcatcatataacttagaaaatcatagatttgttgcctatgccacaaatggaataaagaataatctgtatgacttgatacgtaaaaatcaaaatagaaaaatatttgatggaaatgactgccttataataacagatgaatttcaaagaagcctgatctcaaatgaaattaatgctgaagatttaatgtgtagaaaatgtgattatactgaaattataaatgcattaaataaacttacacatactgaacatgaaataataaccttcttattttttccacaaacttcttctaaacacacactaaaagagttctcagttttaaaaaatatatcatattcagctgctataaaaagaaaaaatactgcattaagaaaactttatgaactgttacaacctattttttatggaggtgagttacatggaaattaatgagttaatgaatcttattgtaaataacggatttcctgttgctgtaagcgcatatcttttaattcgtttagaaaaacagcttagttcattatcaacttctataaataaactcaacactataatttctgctaagcttggagttgttgttgatactgataataaaagtgattcttctgagaaaagtgcttgattagattttgagttataaaacggtggcaggctttattccttatattcagcctaccaccagagatttttacaactttcgagtgctatccttcaacaatcttaactttctttcctttaaacacaatagcaagttttagaatatcatcaacacctctatctatcagttccgcttcatatttgttttcttctatttgttttaatgcttcttttattcctgtttctatactcttcttcataaaatcatcaatctttttaaactcaattataattccaagttttgaactgtcgcgtggaataagcataacatcatatctaccatatccactctctttgttagatttaacttcatattcattatttaaagaaacaatcattccaagtacaaatgcatgatatactttttccggttctgtcccagatacatcaaaataacttacattatttaaaacaaatcgttcaaagaatccgccaaaaacttcaacatctttagttattaaagcttttaacattatattataattttgacttgtaaggctttccttaaaccactttactattagattttcataaaaaattttaacttcttcatttggtatcttaagattacacttaatttttcctcttataagttcttgtttaactgactttaaataaccactcattgttaagaagctccaaatattttcctcatcttcatctacttctttcataactatatggtcatcaactattttagttatagtatttccttttataagttcctcaaggcactcttttgtttcttttgtgcctctagatagaagtctttttattaattcatttccactgctatttatccaatatggcataaagccctgttcataatttttaatataattaagcactgaccatggattataaataacttttccgccaaacatatatccattgtaccaattcttaacttcatccatttttgcttccaaatcataatattgaagtaaatctttgacttcctcttcttcaaatccaaatttattattaaagttcagtcctagaattgtattgacttctaggttattaagtcctgaaaaaatactttccttcgccactctaagaattcctgtaactagagatttttctaagtatacattatctttaagtgcagctgtcaatattattcttattacatttattgcttcttcatagtaatttttcagataactttcctgcacaggtacatcatactcatctataaataacataacttttttattatagtgtatgttcatataatgcattaaagtgcttaaagctttataatactccaccatatcagcttttccagttaatatagcctcgaatttatctttatcttgatctataagattatcactttctagcaaataaacattatctctatatatatccatcataaggctttttattccgtatttaaattcttcaaaagttgtatatttttcgtttttaaaagaaagaaaaataacaggatactctccctgcatcttcattatttccttttcattttctatttttaaacccttaaataaatccttattttcctctttattttctatgtcaaaaaaatatttaagcatactcatattaagtgttttaccaaaacgtcttggtcttggtgttaatataacttttgctccattttgtacgaattcttttataagcaagcttttatccacgaaataatgattttcttctatcatttctttaaaatttgatgttcctacctgaattgttttcttcaaagttacaccttctttcctttttatttaacaacggtcactaaattatatttatattatagcccatatttaatctcattaaaacaaaaacagtggcaagttttatgttattgcataaaacttgccactaaaacttatcttaactcaagataaattttttcttctgatatatttagaaacatctttaaaaagcataattccgtcttacaaatttttagaattctttcacgtgctaattttctctgatagtaatcatgagtatatctatttctaattttcactatactttgaagcttttttgaatcttctttagaaataaatccaaagtcgctggataattcaataatttcaggccctgatttattaggaaaataaaccattctttatagcctccagttcctttaaattttcatttctaataacttccaatggttccctatctcttttaaatgcagaatatccaagtaaataatctaaatacttttcttcatcaaatattattttatcttcactcataagtaaaagttcactaaatggatagttaaaatcatgtataaaagtataatgaatattattatgattaaagtattctggtaaaatgccatctaaataatcttcaatttcaaattcttcatcaaaatctaattcctttttcaaaaggatcataacgtcaatatcacttctattcttatcaaaacattcttcatgataacttccaaatatacctatagataaaacatcttttaaacattcattatttaattggcaatcttttatcattaatttttccatttttcacttcgcctttcgaataaatctaaagtaaacaagaatttattatattaattatatcccaaattttaagttattaaaacaaaaacagtggcaaactctatacttttgtataaagcttaccactggagttttctggacctctcgggtgctactgagggaacttgtgactgaagttactttttagacgatttcatatcttttaaaaatattaaaaaagatatgaatatccttttattcttataatcataacttttttagtattgctttaaatttatatatttagttacaatatatagtaaagggggaacatatatggctaatatttttaatggaatacataaaatggatacagaagaactacagtatttaattgcaactttagaaaccatgacagtagctaatataagcagtgaaatgggacaaaaggctaagaaatcgcttgtaaaagcggtaaattttgttggtgatttttttaacagtaaaaagataaatgaaccaaatgtaatttcaattgaacaacgattaaaggataacaagaagaaacttgaagcattatcaaaaaatcagcttgaagaaaaaattagatatacgcttataagcaaactgaaggctattggtgaaaatataaatgaagatgattctgatgatataatttcagtatgtgtaattgataatgcagctaaaagttataggaaggaaataaatgaagatctaactcccgcaaaaaaggcagacggaatattttttagatataatgaaaaacttcttagccagaccaaagaaaaattaaaaaccgaaacttctgaagaaaaagaaaaaactgataaagctattcagtatgagatagacagaatggattatgatcaacaagaggaattaaaaaaggctcttggaataaataatctgacaggtaaagaagtaagaaagatgctcacaactgcagctggaacatctgttggtatgcttgtagtaaacacatcaggctttggggcatatatggctcttacaacaataatgcatgctatttttacaacaactttaggaatgacactaccttttgctgcatacactggagcaacatctgctttggcatttataacagggccagcgggttggctggctttaattggtgttgaagtatttatgcttaataggagtaaaaataagattatttatcagcttcttgcacaaactgtatggataagtgtacgttcatatggcagaaactttacacctaaagatgaagaacttccaagctggctacctatagttgaaagagaaaaagcagaagaaaaaagtgaagcatttatcaaactttctaaagaaaatgattctttaaaaaatgaatataatgtactaaaagaaaatattagaataaatgaaaaaaatataaataattatttagaaaagattaatacattaaatatacagatacaagatgcagaaagtaaaaaagaaaaagaaaataaagaaaaacttcaattggaacaaaaatgtaaagaacttgaaaataaatataaatatatacaaaatgaattaaatataaaagataatgaattcaagcaattaagtgaagaagaacagaaaaaatatcataatataagaaatgaatatgaaaatgcaaaaaaagaattagaattgaaaaatagagatataaaagagctttatactattattgatgattcagaaagtgaaattaaattaaagaaagacgaaatcaataatcttaaagaaaaagcagataaagacagtattcatattgttgaattaaatacacaatacgaaaaaagtaataataagtttcttatgcagcttaataaaaacacaactgacttagaaagtagatggaacatcgtatttaaaaggtttatatttgaaaataatgttataaaatctgtagtaaaaaattttcaatataatgaacttggaaatattgaagctgtacttatggaaatgcatatgactgataatcctatggctttgtcaatgaatagaggcaaaatgaatgacggacgagcacatataggattttcaacaccctctggatttccttgcagaattttttatagagttaataaagaaaaaactaatggaaaaagcataataataagtgagattacaaaacataatgattctagatatggaaaataaaatttaatacagactgctctttttagttcataataatcttcaccttctcaaacctgccatccataaagctttctcctgtagtaaagacttctttttatcataataagacatgccaaatctttgatttggcatgggtctttatattttaaacacttattggattattctaaattaactcataatataaattacttattctcaaatactaaatttctccaataagtttagctataaatcttactgcaaaattaggcaacacactaattgctaccttgaagtttttctcttcaattgatcttttaaaaacatatttagctaagtctacaccactctcgttacttttataatccttgaaatatttattctgcttaaaaaatattcctgtatcatagtagcgtttatatagctgtctatatgtaaaatcatgagaatgataaacctcagaatctgcacaatatttaattctatatcctgcattaattaacttatgagcaaaatacatatcttcatttgtaggcattctctttccatcataagcattaagctctctatatactttagttaacactgctgatgatgcatctgaataaaaaaatgttctaatttgatatttatctatatcatttttagaaacagttcttgattctgctggatagtttctttcccttgtatacttctctatattgtcatcttcaccaatctgtcgactaaaacttgcttcacattcaccttttattattggatttacaagattcttaagccacaagtcattttttatctttatgtcctgggaaataaacacgattatttccccttttgcttttttagacatcatttcccttgttgtgctatgagaaaaatcttttggttcaattaaagtatagtcgcattgtagggatttaagtatttcttcacttttatcactacatcttgttaatgcatatagtatttctatagactgtccttgacttaagtcttgatttaaaatattattatgtaaattttcgatatactcttgtccgttatatattgggcaaattattgatataatcactgatttctatcctttcatttacattttattgatattataacttgaaatattatattaattatatcccaacttctaaagtattaaaacaaaaatagcggcaactctatgcttttgcataaaaattgccaccaaaatttttattcttctaatatttttctcatataattaaattttaatttattcttatataatttttattttactttttttctaaaaatatttttctactaataaaattccatatcataacaattcctgtaacaataatttttgaaatcatataataaataagtaatttttctaccataatccacatcatagcttgatttataagcaacccaactatacttaatattaaaaatactataaattccttttttttgcttatatcatctctacgagcaaagacaaatttcatactacatatgtaattgaatactacagatactgtaaatgatattgcagatgaaattaaataatacatacctaaatactctactaaaagaaataatagaacatagtctattaaaaatgctaatacacctactataccaaactttataatttgattaattaaatttttcattatgttcctctacattactttccttaattatgtaaataggtctattttttacttccatatatgttttagccaaatattgtcctaatattccagtacagaataattgtattccactaacaaaacatattatacacactaaagatggccaacctgctactggatctccaaaacttaatgttctaattataatcaagcaaatcataattagagatactataaaaagtactagaccaacaaatgaagatattagtaatggcatagtagaaaatgctactactccttcaattgaatacttgaataacttccaaaaagaccatttagtttcacctgctatacgttctacattgtcataagctaaccattttatattaaaacctacccacccaaatatgcctttagaaaatctattatattctttcatttgtaaaattgcatttaccatatttctcttcattaatctaaaatctctcgctccatcaactatatctgcattagagattttattaattatcttataaaaacattttgcaaaaaatgatcttattggtggttcaccttttctatcttttcttctagttgccacacaatcacaatcttcatttataagaatattgtacatttctattaataactgtggaggatcttgaagatctgcatccataactgcaatatagtctccagtagcattatctagaccggcatataaagctgattcctttccaaaatttctgctcaatgatatgtatttaattctagaatctaaactagaatattctttaataatatttagtgtattatcttttgaaccatcattaacaaatataaactcaaattgtacataactcatttgttttgatatcttgtctatttctttataaaaaaatggtagagatttttcttcataataacatggaattactatcgatattttatccactacaatttacctcctatattttaaaaagtagacactctactctaaatacttttttgatttaataacttacttaatactattccagccaatattaaaactagtatatataggatttccaataagccaaatattttatttttcttatatatggtattaattcatacaaaatacctcccataaagaaatataataaatacctcaatatattttaggtatttcagttggtatgttttcataactaaaagttattattaaacttgtagacataataatattttatatactaattatttattattaaaattttaatatttttttcgtatccacaaagcattgcaaatccactcattaagaaaaataaccttgcaaacgaatcaaaattacttactatacagtcaaaaacttcatttttccctgaaaatccgcataattcctaaatatgaaagcaagtaattatacaagctacaattcctccaattgatattaaacccaaaattattattttctcattatctttttatacatataattacttcattaattttatttaatctctatttgattatctgtataagtaacataattaattcctttattatcagttatacaaatacctaatatatatgcatctttaggtataatatcagttatattatgcatatctaacgaaaacccagactcatcatacctattatctttataaaattcaccaacatcttttcttaaaaccttattagtttcaaacttatagattttatcattttttttcaataaaatactaataatattttcatctgatttctgttcttcaagagctgcccatccataagcttgcaatctatcattatttgaatcataatttatataatctacaccatgcttaaaatcagaatccttaaactcttcatttgtgtcattatatgaatacaattcttccatattataaaaaacctttattccataatatgattcaatgtattttaaatttgattgcaaataatcttctcttgtatttaaaatcctattattcttgcatttataaggtgatatgtacacatcagtatcattattatttttagctatctctataattaattcattatttttaacgaatttattataattattatagactatatatattttcacacaacacaatatagttaaaattgatatagcagtcataattacttttattataaatcctattttttttatatatttttcaatcatatttgttgaaaaatatataatagaacacatcataaagaaatctataagaaagaacgctcttgtctcaacatatggtgctccaactaatgctgccgctgatattgccgatgctaataaaaatactatattaatagtatcatatttgtatactattattttctttttataacttcttgtttaattttattataatttaaataaacatatagtattgtaacaatagctaatataccaactaaccatatattttcattaaaaaatctataagttatatttaatgctctattaaaataatcatttattgttatattttttataccaaatatatcattataggttctcattcttattttagtagaaggcgcaaaaaacataacacaaaatcctagtattaatgttgtgaatgaactccatatccatataaaaattttttctctttgtctaattctaaatagtattataccaatatatagtactataaatacaattactgtattctcattagttaatcctgcaaagaaacctagtatagtatgtaaaagaattatatattttttattattaaatacatttgttccttcataaagtaatcgcaatggcaatgcaaatataagtaaaatacacattgcccacaaataatttgaacttcctgttctccaaaaaaatatttcacctagaacaggttgaaataatattatgatacagaaactaaaaattataattaatatatcttttgtattattcattttaaactttttaccaaacgcatatgttggtatcaatactatgtatacaaaagtaatcattgtatttcctatatagtaaaaccatatatttatactaccaaaaattatagaaatttgctctcctatcctaatattccattgtgtagcctgatttataattctttgagaaatcatctgaatcagttctttaaccgaagaaggctcatgatagggataaaaactaattaatgcaaaatcctctcccatcattggcgtatttatattaataataaataaaaatgttactatcactactaatgtaagcataagtattcccatacacttttttctatgtaatactttgttctgcattattttccccctcttaatatgttggttattcttgatataataccaattctaaaccaatatctctttaaatatgtattttcaactttattatataccagcttttttgacaaattagtattattcacattattaatccttatttgagaaaaaaaattattaagaacctcatttacttcttggtcagcaatatcacctaattctctaaaactattatcttcgtgaagtctataataatatttagtgtcatctatatacaatggttcttttatcaatgaagctcttagtataaagtcccaatcatgaatatatttatattctctaaaccccttcaatttataatataactctttagtaaataccatattccctgttgatatagcaacattctgatgcattaatgcatatgatacaacttccgattctttaatactcttttgtatacctctaaaattatctgcttctatgcctttagctaattttgaatctccatttattatttcaatattagaaaatgcaattattgcattttcttttttcattttaggaatcatcttcgtaaatctgtctttttcatataaatcatcagcattaattactgcaatataatccccttgtgatttttcaatcccttcatttatagtataatgagctcctttattttcatcatgttctatatatactacattccaaaatcgctcttttatcctatcactgtaaataaaattccttattaattctttactactatcttttgaacaatcatcaattattactaattcaatctttttatattcctggtttcttatagattccaaacattcaactatataattttcataattatatgatggaactactacacttactaaattttcttccatagttattatcccccgttaataatttgagtaaatactattcttcgttgcttccaaatattccgttccatacttttcatctggttctaaatgtgttccttcagcccattcattccaagcattaataaatatatattgattctccttatcattatagttggtagtatagtcaataatccctgttatccatttttggaattcatgtggatttgcataatgaaatatgttagagttgttcccccttcttgctgtattatcccagcttagcattgttcccctaaatactttgtaataatctggtcttttatttacatacctagaaacaacatctctataatcatatatatttcctccaaattctttagttaagcctggaacagactttgatatttctcctgtaattattccatgtggagggaattctactgctgaatcgccattaaaaatatttggatctgtcaatccaaatgattgaactaaagaaatatgaagttcgtttattccattctctctacatacttttttccattttttaatagtatctgctagattaggaaataattctgctctatatattaataataatggagctccatcaactctgatatatcgatcatcttttagtataggaattacgtcttctataaatcttatatccgtttcttcgttatgttcctgttttataagaatctctttttcctgaccatcccatcgtctactccatgtctcattagcccaacatatacaaaatgggaaatctaatcctttatcattcaataagttatctaatggtttttccaatagtctctttccattaaaccaataataataataacaaaatccatatattccgtattgttttgctaattcaatttgtttatactgaatagttttatcttccactaaattataataacctaactcacctggtatatgtggttgatagtgcccttcaaaaagtggcttacccttcctaacattagtccactctgtaaaaccttcaccccaccattcatcattttcaggtatagcatgatattgtggtaaataaaatgctataggttttacattactttttctatcaactttagagactctataatgatataatactttatcaattatatgtatatcagatatttgaattttatcatctaaaaattcttctattttattcccttgtataactataccttttctaaataaaatatccattcctcttttttgattaataacatcttccttatataatggagatatatattctccatctaaaattctatcttcattaaatgttaatactttatcattgtaggtatctaatgcctctcgtatttggttgcttgctgaactagataaaccatcttctatattaaatgtcatataatatgaatcattttcgcttaatctagaatctaaaagaaattttaaaatttccttattgcaatttaatttatactcacactttacatttaaataattttcaaattcactactaataagcactaataatttattagtattttcattatatatatttattattctgtcaaatttttgtgccttaatcttttttaatgtttctatataaaattcttcttcaactatattagttgaattaattactaacgtaagattattatcctttatacttttatattcataattttcatcgataaaaatgtatggtttaattatttcttcttgctctatttcattacttatgtttttaaatttatttttaaccttttcataagtaatctttaatccattcatctttaagcttttacatgcttttaataaattttcatatgataatttattttttatattacatatacctaagtcctttatatcaataacatgattttttaaaacaatgttattatcatccctaaaaattatatttaattttgaaattctctttctttttaattttaattctaaaactattccactatctaatgcattattatcattattgaaatatttataaacatcatttcttctaatattttttattgtgtattcatatttattatttttatcatcacaaatatctacattaattcttttttctgtatcaaatgcccatcctgttaaagtaataatctttttaccattattatttgatatatttacattttctatattataattaaacataatattaaatagctccttataataagttttctctaattctctttataaaagatttttttttttttttccaattctattttttcaaatttattttttagtgcttctatttccatttctttgattttaaattcatcattttggttatctatttttttcttaatttattgttatcattttctcgctcttgtatttttatttgtatactttttatcaaattattttgttcttctattttttctttaagatttctttctaattcattttttttctgtatttcattttccaaacaaattaattttttttcacatcctttccacaattgatataaattttttgcaatctctaaatcttcttcaaatttgcactttccccaaatagttatatttctcaaataaatatctggaacattaatataaatttgtgaatcatactttaaaaaatacattccattatcttcttttactaaatcagcattgctcgtaattttatttaattctatatttctagttatattttttttatctttaaacgaaatcccctctatttttatataagaaaacttatcttctaataaatcaaaccttatattttgagcataggtattttcaatatgatcaaattctttaaagtcaacataaaaaattccattcatttcattacattttgcgatagacgtatttttctcattaaatccttcacctaaatcaatatacaatttgctatcaaactgttttacatacgaatcacgtatatctacttgattaagataattattatttttactatttggcttaatttcaaataacatttgataagtatataaatctttatttttctctttaactatatctgttaaaaaatccacttcaaaattattgcttttaaattcagtttgttctggatatttaattatattatcttcactgactatttcatagtccagttcatcaaataaattctttatagtgttcctagtaaaaaacctaatatgtgtattatctaataatccccattttccatatgtgaatttattttcaattaattgctgaactatagatatatgacttatattaggcactgatatccatattaccccatcatgatttaaaaatttagttatttgtcttaatatagttttaggtgaatataaatgttctagtacgtccatcattaatacataatcatatttttctttcaaaatctcttctagatttaattggtctaaatttccaactatcattttttcacagtattgctttgctatttctgctgcttcttcatcaatttcaatacatgttactttacaccctaattcttcagtcaaatattttgtaatataacctgtagaaggacctaattctaaaactcttgatttttcttttatttgttttagcactattgatgctggacttttatattggaaatctattttataatcatacgtatattccttatttttcattaatataccctccattttcgttcaaataatgcatatccttcacccaaatattcttgtgatattacattcaattcaaaagcaatttttttttcttctaaaatagttattccattagcttcaaaaatagctattcgtatatagtatgtgtttggaagtaatgtcaaattaggatataatagttcaactttgtttgtattatttatgtcaacatcaaactcaaatttatctacttttgtattaacaccacttacatacttaccttcaatatctagtatagcaattccaattactaatttatttattttttcaaataaatcatattctatttttatcgaaagttcatctccagttacgaaattctgattaaactcagccctaccatttaagtatatattttttatattaattatgtctgaattaatatctttttggctagttaatattgtattatccattaagcttgctttatatttttgtataatatcttctgcttgccctatcattttaaattgtcctttattcaaccacattaccctattacaaaaatttctcattgaataaatatcatgactaacatataaaattgtagttccttcgctttgtaattgtttaatcttttctaaacatttaacctgaaattttgtatctccaactgctaaaacctcatctacaattaaaatatttggattagagcttatagccacagaaaatgctaatcttgcaaacatcccactagaatatgttttgactggttgatgtataaattctcctatatctgcaaattgtaatatatcaggaattcgtaattcaatctcttctctactaattccaagcatagtaccatttaaatatatattttccataccagtatactcttgattaaatcctgcacctaactccaataatgccgaaactattccattaaccattacatcaccacttgatgcacttaatactccagtaattatttttaataatgtagattttcctgagccatttacccctattatacctaatatttcacccttattaacactgaatgttatatcttttaatgcataatgttccctactatatttccgttttgttaagcttaatgattctttcattctatctattggcttatcatataatttataaactttacttaaattttctactctaattgctatatctgacatttatacctccttaaattacaatacatcagcaaaatgtggcttaagcttcttaaatataactgttccaattataaatagtgctaatgttataatccaaaaatatattgtttggaaatatctttgaaaaaaccatacatgattaacgaaagtatctctataaccttcaactacataatacataggatttaattttactatccattggagattttttggtactatagtataactccacattataggtgtcatccacattcctatttgtaaaattatattaattatttgtcctaaatctttaaaaaatattatcattgcacttgttgcatatgatattgcaagaattaaacaaaatgtacaaaaagaataatatacaagttgtatagtatactgagtaggataaaaaccataaattgcagcaacaaagaataaaaatcctataaatactaaatgtataaataatgctgatattatcttaacaataggtaatatacttattttaaatactacttttttaactaaatagctatactccaacatgcagtttgttgcattaagtaaagcttcttgaaagaaaaaccaaggaactattcctgttatgaaccaaacgacaaatggtacatcagatattggtgaaccagctttaagaccaaattgaaatacaaaccaatatactaatattgtaactataggttgaacgaatgcccacgtaattcctaaagatgagccagcatacttagttttaaaatcatttttagctaaattccatataagagttctattattctttatttctaatgctaaccccataatactttttgctctcttaataaaaataagtactataatatcaaatataatacaaattaatatttttgatattaattttatagtttgaaagttataatctaatgaattaatgctatttttatctagatttaaatatatatacggatctccaccattagtttttaatataatattactattttctattttacaattttctatttcattcttattttcagaatatactatgctatcagtattaacttctatgtcttttccaaaactatttagttttacatcatgaatttctatattgctagcttgattacctaaatctaatcttatttgtttagtatctttaggtatagaaaactttaattcttgttctataccagccatgtcataatttactttttgtgatttttcttcacttatatcaatatcagtataataaaatacttgatatacattagacttatcagaaactaatttataactaatggttaaattgttgttaaccaaattgcaatacttaagcactaatatattggttataaataccataattattagcattgttaatttaacaattcttttattactcatatttttatctctcttcaatttttactataatttatttcttctaaatatctattaagtgcatccttccattcaggcaacacactaaactcattctccacaagttttttcttactcatcctagaattcaaaggtctctcagccttagttggatattcgtttgttggaataggatttattgtacaacttaatcctgactgtttcattatctcttgtgcaaattctgcccatgaacaaaaaccttcattagtagcatgataaactccatatttttcaccaactaccatatcacataatattggtgctaaatctgcagtataagtaggacttccaatttgatcacatactacatttaaactatctttttcttttcctaatctaagcatagtttttacaaaattatttccattgataccaaaaacccaagaaattcttacaataaaatatttatctaaaatttcttttacttctaattcaccttcatattttgtctttccatatacagaatgtggatttatatctccatcaatttcaaattctttatctcctaacccactaaatacataatcagttgaaatataaatcatttttgcatcaatttccttacaagcttttgctatgttttttgtgccatcaacattgacttttatacacactgcttcttcatcttcagctttatctaccgctgtataagctgcacaatgtataactgcttctggttttaatttaattatatattcattaacagcttctttatctgttatatctagttcatccctatcaatacctaaacattctatatttctttcatttaatactttaactacatcgtaacctaattgtccattaacacctgttactaaaatcatatttcattactccttaattataaaagtccttttttagttaattttataatatacttaaatataaaatcaggtataaaaggtagcaaagattcaattaagattgatactttatgaaaatttctatattccatcattatctttaggtcactaagagagattgtttgagaatatctctttcgtgcttttaaccacaataaacaattatctatatacattttcaaattatcatcttctaaagataatctttcccttaacgaattaaacctgataataaattcatctatcctctttatgtagtaagacttcttatcatatacgtcttttaatattccagtctgattacaactatgctgcctatatcttactagtggtttatcaatagacttaatctccccttcagttgcagctaaaattgaaatccattgatcatgtacaagttcatcaataaatggaacagccttaattgcaatatttttcttaacaatcatcgcacatccagttacaaaattagtcatgagcaaatccttagctaagccatacccacttttataaacaattcttttcctaatatcacataaactttcatgagtcttgttgctatgttcatcaattatacttaaatcacagcacacaagagtaacatcttccgtaaactcatccatcatcaatgaaattttatttgtttcccatatatcatcctgatcacaatatgcaaagaaatctccatccgcaatcttagttaactcttcaaaagccttattagatcctttgttaacttctccacgtataatcttatactcaaaattagttatatacttgttaaatatctctgtattggtaggatattcaggacaatcatcataaacatataaatttaaattttcataattctgcttattcagagaaataagctgttctataagccaattctcattaggcttatagacagctaacaatatagatactaaaggtttatctgttatcatacattttctcatagtaatttttatattcaccgcttatgatgttttcccaccatgatttattatctaaataccattctacagtcttttttataccttcatcaaatgtcgttgttggaagccatcccaattcattatgaatttttgtaggatcaattgcatatctcatatcatgaccttttctatcagatacatatttaattaaactttctggctttccaagctctcttagaacagtttttactacttcaaggttagttctttcattatgtccacctatattatagacttctccaacttttccattatgtattatcaaatcaatagctctgcaatgatcttcaacataaagccaatctcttacattttctcctgtaccatataccggcaattctttatcgtttaacgcatttgcaatcattaaaggtataagcttttctgggaaatgatatggaccatagttattggaacatcttgaaattgtcacaggtaatccatatgttctatgatatgctcctactaaaaggtcagcagatgccttacttgacgaatatggacttgatgtatgcaacggagtttcttctgtaaaaaataaatctggtctatcaagtggtaaatctccataaacttcatctgttgatacctgatgatatctctttattccatattttctgcatgcatccataagaacttgtgtccccataatatttgttcttaaaaatatttctggattttctattgatctgtcaacatggctttccgctgcaaaattaactaccatatcaggatgctctttttcaaacatttcatatacagcttctctatcagcaatatcaatcttgtaaaatgaaaaattactattatcttttacactatctaaagtttccatattacctgcatatgttaagctatctactactattattttataatcattatatttatttaacatatagtgaacaaaattcccaccaataaaacctgctccaccagttactattattttcatatattcaactatcctttcaattacttttattcctcatatataaaagtacaatcactatccttcaataatggtgcttttttatccttttcggaaagaattgggttttctatcccccattcaactccaatttctggatcatcaaacctaatgcttctatcactttcatggttataataattatctgttttatatacaaattcaacatcattacttaaagtaacaaatccatggccaaaacctcttgggataaataactgttttttattctctgcagaaagttcaacagcaacccattgcttataagtaggtgatccttttcttaaatcaacagcaacatcaagtacagcacctttaacaactctaacaagcttagcttgagcatgctcaccattttggaaatgaattcctctaagtattcccttttcttttgaatatgattgattgtcttgaacaaagtcacacactatttctggagtttttattgccgaataggtttccataaaccatcctctttcatctccaaatacctgtggctctactatatatacaccatctaatttagttttaatcaaattcataataaactctcccttatacttaaattgtctgttaataaataacttttccttctgcaacattttttaaatgttgtccataaggactctttccatatttaactgcactttcaagtaatatttctttatttatccatccatttttataagaaatttcttcaatacatgaaattttaagtccctgtctattttctataactcttacatattcacttgcttcactcaagctatctacagttcctgtatcaagccatccatatccacgtccaagagttattacatcaagttttcctttttcaaggtatattttatttaaatctgtgatttcaagttctccacgtggtgatggttttaaactttttgcatattcacaaactttattatcataaaaataaagtcctgtaacagcataatttgactttggaatttctggcttttcttctaacgaaattacttttccattttcatcaaattctactacaccaaaacgttctggatcttctacgtaatatccaaatacagttgcacgtcctgtattttctactgcttttttaagctgagttgtaagtccattaccatggaatatattatctcctaatatcatcgcacaattatcttcacctataaaatcttctcctaaaataaacgcctgtgctaatccatcaggtgaaggttgcactttatatgatatgtttattccatatcttgaaccatcacctaataatttttcaaaattaggcaggtcattaggtgtagaaataatcagtatatctcttattcctgctaacattaatgttgaaagcggataatatatcataggtttatcatatattggtaaaagttgctttgatgtaaccattgttaatggatataatcttgttccacttccaccagctaatattattcctttagtcattttctcctccttgcaatattcccttttggaaaatatatctactatctaatttactacatacattttatcatacatacaatataaatcaaagaattataggattatagttgcatttgaacccctctatatatttttatattgctcccaatttaaaacaatataccataaaaatcaattataagattaatatgcatgttggaactatcattaaattaatctataataatatatattgtaattgacaatttagatttgacaatggacaattatagttaatggataaaaagaataactagcaaaagcaatctttatagtattttcttaatatttcaattaataacttgtactaattatattattaatgtcataatgttattgcaccatacatacattaacagattttattatctgtcaatatataaagaaagggtgggggataataaaatgataaaagaaaatcaaaacctattaaataaaataaatgcatttacagatatacttattttatttgtatccatggtaatatcatatttcatacgttttaccttactttatcatgatgaattttatataaaattatatacatacttaaaatttacagtaattttaattccaatatatcttattttgtatgtattttttaatttatatgatccagtaagaacttctctattttcaaaagaatgcagcaaaattataaatgcaaatttaatcttaattacaatagcattgtcctctttatttgtttttaaacttgtacatatttcaagacttgtaattgtaatcttctattttgtaaatacaactttgattataattaaaaggggatttttaagaagaatcctttcaaacttaagaaaaaaaggattgaatttaaaacatgttttaattgtaggagcaggaaaaaccgcatctgaatatttagatgtcatccaacataataaaacctatggttacaattatgttggatatgtatcaaatgattctggattttatggagaaaagttaggcgattatagccaattgctagacatactattcgagtataaatttgatgaggtggtctgtgccctagacttaaaggatgcagaatatatagaaaagatagtttctgactgtgaaaaaagtggaacaaaaatatctataattccattttgctacaaatacatacctagtcagccttatattgatcaaataggaaatcttcctttaataaatataagaaggattcctctagataacattggtaatgcctttatgaagcgaactttagatatcttaggatctttatgtttaattttattaacaagtcctattatgattattacagctattataataaagtgtacctcaaaaggaccaataatattcagacaagagcgtgtaggattaaataaaagcatatttacaatgtataaatttagatccatgaaagtaaattctaaagaaacaacaggctggagcacaaacaatgatcctagaaaaacaaaatttggttcatttatacgtaagttttccattgatgaattacctcaatttttcaatgtgttaaaaggcgacatgagtttagtaggtccaagacctgagcttcctcactttgttgatgaatttaaagatgaagttccattatatatggttaaacaccaagttaaacctggaataactggacttgctcaaataaatgggtttagaggtgacacttcaataaagaaaagaattgaatttgatatacattatatagaaagctggagtattttattagacatagaaattatttttaaaactgcttttaaaggctttaaaaataacgaaaaacttattattaccaataaagaaatcagccaagacgaatctattaaaagctagtcaatttcaaaatcaataaataaacaataaaaggactttaaaagtccttttattgtttattggatataataatcattatataattataaatttcttctgcaatcttaacacactcacctgcttcataatcacttactataagaggagaatcggctggatatcttgtttctatgtaatatttgttcgcaaatccacagtcttttatatacttcttaaaactaacatcgtgtccctgtgcaatttgcacaaataaggatttcttaaaataagcaatatagattttataatatcacgaagactatatattgaataaaatccaaaaatatttttaatactaaaataaaaaaatcctgtaagagtttttaccttatttgttccttgtcaattgtcaactgtcaattgtaaaatccccttcacaatgctataatattacatatttgcgatgaaagttatttagtaaaaaatttatttataggatgtgttcaaatggaaaacttaaagaaattctgtaaggaaaaatcaataacatttttctttcctattgcacttgttctgacaatcgtacctttaattgtgcgtatgagaatatctgaacctgatgaagatacattaaaattatacggttctagtgcaaattcagatttatttactcaaaataaagaaatctgtttaatctttctatctgcaataattttgattattgccataacatgtttcaaaaaattctacgagaaaaaagataaattaatcaatataatgataatttgttctttaatttttcttggtttcactttcttatcaacattattctcaaaatataagcacgttgctttttggggaatatatgacagatcagaaggttttataacaatagcatgttatattcttttattcatttactcaatttatacttttaaaaagactgaggaatttaagtttatacttatacctattcttattttagtttatatcaatggtttcttaggtctattccaatattttggctctgacttaataaaaacaagtttaggtggattaattgctattcctagttcttataatattgatcctagtaaattatcccttgcatatgaatcaggtactatttatggtactctataccactacaattatgtaggaagctttacagcccttgtattgcctattttattcggtgcgtgcgttatagaagatgacatattcttaaaacttctttctatgggtggctgtgttactggtttatggcttctattcggaagtacatcccgtgctggtctaataggatttggtgcaataattgtttttgcatgtatattctttggtaaattactattaaagaagaaaaaagcaattcttattacaattgcatgtttagcagtatttactgtaggtttaaactttgcaacaagcggaaaaatattcaatagaatacctagtttagttgctgatggattaagtttatttaaaagcaatacagattttgattacagagatcatattcctgtaaagaatatagaacatatagataataatattgtactaacattacctacagataccttaacaatatcttttgaaaacaatgattatgtatttagaaattctaaaaatgaagttgtagattataaatcagaatttaattcaaaaattaaagcatatgattatactacaacagatgataatttctctaatatttcatttagatctggaaagataaagtcaaagacaaaaaatgatggtcttatgcttatattaaatggaagttctagtgaattcatgtttataacaagagatgataatagtatgcatttaatagatcctaaaacattagaagaaatagatttagatttccctgaaactataggatttaatggaaaagaaaaactagcatctgcaagaggatacatatggtcaagatcacttccattactaaaagatacacttatcttaggttctggtcctgatactttctcatttgatttccctcagcatgatatgttaggtaagctttacgcttatggaactactaatatgattataagtaaagcccataacttattccttcaaattggacttaataatggtgttgttgccttgattgcttttgttgtattaataatggtttatattgttgatagctttaagttatacgcattaaaaaacaaatatgatgaaaaacaaattcttggatcaattcttgccttaagtgttataggttacttatttacaggtctattcaatgactcagtaatatgtgttgctcctatattctggattatactcggagtaggtgctgcagttaactttataaataaaaaagctcaaactaaataatatattaagaaacagactatgataattgattattatcatagtctgttttttataaaaatatctctttcaaattaaactttaattcaggaaatacaaagcttatatattcatcagtactttccaatacttttggggttctatatgcaccatctttcaatacatattgagttaccataccgctctgctcaactatattatattcaagtacaccaaatctttgatatatgttagcttttataaaataatcatggtccgaatgctctggtgatacaacttcaaaaactatcttaggtgcagatataaaactctctccctttttatctgcatcatcacacattacaaatacatctggaagaaacttatatatttcactgtcatttttaaagataacctctatttgttcagaatatggagtacacttacttcctttaaaaaagttatatagcatagagcttatgcccataactattctgttatgagccattgaagttctcgagctaaataggatttgaccattataatattctgctttaccatcatagtttgactgtatcttttcaaattcatctaatgatataaatatattattttgcacttgcatgaaactcacctataaatgatacgataaaaatggttcttccgtatttatccgtatatatgatatcattaatatatcatatatttaagaggtattaatcatgtgtaattcatcaatagatctgcaaaactttttcccaactaacaaattaaaaattactaatatattagaagatacaaaagtgattaagataagtttaaagtcacaaagtaataattgtatttgtcctaaatgcaatatcatatctaacaaatatcatggaacatatataagaaaagttcaggatttacctatattaggtaagcaagtattattagaaatcaattcatatgaatataaatgcgagaatattgattgttctaataaaactatagtagaatcttttgatggttttattagttattatagcagaatgacagagcgtttatctgattttttatgtaccttagctttggaaacaagctgtgaaggggctgcacgtatagctaaaaatatgaatatcaaagttagtggggatacaattataaaaatattactaaaaaaatatgatgaaatgaaaataaatacttgtagtagtactgttggaatagatgatttctcttttaaaaaaagacataattatggaactattattgttgatgaaaaaactcataaaccaatagccatattagatggtagggatggtaaaactttatcaacttggttaaaggataataagcatataaaagtagttacacgagatcgtgcaagtgcatatgctaaagttattgagcaagaattaccgggagctatgcaaatagctgatagattccatatacaccaaaatctattgcaagctataaaaaaagctctttacaaagaaattccttcaactataaaaattgaaaatgatattaaaactcaatgtagctctgaacagaatgaccacggtaaaaaaaatcctaaaaactgtggataactttacagctgctgagcatatacgcattaaattaatatataaaatccaagaaatgaaaaatgatggatattcaattagtgaaatatcaagacttttaggtaaagatagacgtaccattaaaagatacattcaaggagaagtacatgatttatgtaaacattccagaaaaagaaataacccatatgaaaatagagtaattagtttaataaagataggatatattgaaaaacagattgtagatatattattatcagaaggatataaactttcaaaaagcaatgcaaggcatatgattcggaaagttgttaaagaaaataacctaaagataaataagtattctcctgttagtgaaagtgttaaaactaaaaatggtgctagagatgaaaaatatatttatctaaagagaagctatatatttgattacttatggatggattctgaactatctgaaatagaaaaaaatcatatatatgctaattatccaaaggtatttagtttgaaaaagtgtattatggaatttagagaattatttaagaaaaagaatcttgcattattttatatatttgttgagaaatatataaatatagatattagtgaattatcatctttagcgaatggattattaaaagatattgaagcagttgaaaattctatttgtagtgatttaagtaatggatttgtagaaggtactaatagtaagttaaaaatgataaaaagaactatgtatggaagatgtagtaagaaacttcttgcagcaaaactaatgttagctccaaacggataaattaggaagaaccataaaaatgtaaggaaacgatcatataagaatgtacaatttagtttttataaattataattactcaagatttattgggggtaattatgattatagaaacaaatatttattcagaagttaaaattaatacattggaagatcttcataagctaaaatcaattatggaggtaaacaatttgaaagtaaataaaagccaaatagctagggaacttggtgttgatcctcgaaccgtaggcaaatatttaaatggatatgtcaaacctaccactagaaactgcaaatctaaagtagaagcttttgatcctattataaaagagcttcttggtaaagattcaattcaagtattttattataagcgcattttatggcaatatcttaaagataatcatggattagattgcgcacaatcttcgtttagaagatacatttctaatcactcagaattcaatgagtactttaataataggaaaaaaggacatatatccactacttctcctatgagatatgaaacagagagaggaaacaagcacaattggattggaaagaaaatatagaatttgtgttaaatacaggagaagttattaatataaatgtttttgtattaatactttcatactcaaggtttagagtatataaattatctcttgataaaacacaagatgtgttactttcttttttagatgagtcatttgaaacatttggaggcgtacctaaagaattacttacagataacatgaaaactgttatggatgaagctagaaccaattattataaaggaaaagtaaataataaatttcaacaatttgcagatgactatggatttaatgtccgtccctgcatagcaggaagaccgaatacaaaagctaaagttgaagcacctatgaaactattagatgaaataagagcatataatggaaccttagattatgaaggtctgcataagcttgtttcagatttaaacaatagaattaatagtacatgccatacatcaactggcaaaatacctatattacatttagaaaaagaaaaagatttcttatccgaactgcctaaagagcagataagaaatcattacaaaataatcaccacaagtgttaaagtaaatcgccaaagtatgatttcatataaatcaaatcaatattctgtaccaccagaatatataggcaaaaaactaaaacttcaagtgtatgatgatcaactacatgtgtattataacacaaatttagttactattcataaaatacaaaatcagaaattaaattatcatgctgaacattatactgaaattagtgctttaacatttaataaaaaatcatatgaaatgatagaaatagctagaaataatttaaaaatgataggagaagtataccaaaatgaatagtacatatacacaacttataaataatttagaatatttgaagatgaagcaaatgattactcatttggacgaagttattgattttacaacaaagaataatttagcctttgtagatgctcttattaagctaacagctcatgaaattgattataaagaggcaaatatgattaaatctatggttaaggttggagcttttccacatcaaaaagaaattaaagattttgactttaattttcaacctggaattaataaagatcaaatattagattttttaacattacgttttctagaatcacaagaaaatattgtatttttaggttctagtggtgttggtaaaacacatcttgcgacttctataggaatcgcggctgcgaagcgacgttacagtacttatttcattaagtgcaatgatttgttgcaacagctaaagcgagcaaatctagaaaataggttggatgctagacttaagcattttagtaaatataagcttcttataatcgatgaattaggttatttacctatagataaagaagattcgaaattattttttcagttaatcgatatgaggtatgagaaaaaaagcacaattttaacaactaacataaattttaattcatgggatgatattttttatgatgctgttatcgctaacgctatcttagatagagttttacatcatgccaatgttgttacaattaatggaaagtcatatagactaaaagatcattttaaacaagacgaagactaaaaaaactacattcttaaatgatcgaaaacttacattcatggggttcttcctaatttatccgtttggagctaacattagttttgctgcaagaagtttcttactacatcttccatacatagttctttttatcatttttaacttactattagtaccttctacaaatccattacttaaatcactacaaatagaattttcaactgcttcaatatcttttaataatccattcgctaaagatgataattcactaatatctatatttatatatttctcaacaaatatataaaataatgcaagattctttttcttaaataattctctaaattccataatacactttttcaaactaaatacctttggataattagcatatatatgatttttttctatttcagatagttcagaatccatccataagtaatcaaatatatagcttctctttagataaatatatttttcatctctagcaccatttttagttttaacactttcactaacaggagaatacttatttatctttaggttattttctttaacaactttccgaatcatatgccttgcattgctttttgaaagtttatatccttctgataataatatatctacaatctgtttttcaatatatcctatctttattaaactaattactctattttcatatgggttatttctttttctggaatgtttacataaatcatgtacttctccttgaatgtatcttttaatggtacgtctatctttacctaaaagtcttgatatttcactaattgaatatccatcatttttcatttcttggattttatatattaatttaatgcgtatatgctcagcagctgtaaagttatccacagtttttaggattttttttaccgtggtcattctgttcagagctacattgagttttaatatcattttcaatttttatagttgaaggaatttctttgtaaagagctttttttatagcttgcaatagattttggtgtatatggaatctatcagctatttgcatagctcccggtaattcttgctcaataactttagcatatgcacttgcacgatctcgtgtaactacttttatatgcttattatcctttaaccaagttgataaagttttaccatccctaccatctaatatggctattggtttatgagttttttcatcaacaataatagttccataattatgtctttttttaaaagagaaatcatctattccaacagtactactacaagtatttattttcatttcatcatatttttttagtaatatttttataattgtatccccactaactttgatattcatatttttagctatacgtgcagccccttcacagcttgtttccaaagctaaggtacataaaaaatcagataaacgctctgtcattctgctataataactaataaaaccatcaaaagattctactatagttttattagaacaatcaatattctcgcatttatattcatatgaattgatttctaataatacttgcttacctaatataggtaaatcctgaacttttcttatatatgttccatgatatttgttagatatgatattgcatttaggacaaatacaattattactttgtgactttaaacttatcttaatcacttttgtatcttctaatatattagtaatttttaatttgttagttgggaaaaagttttgcagatctattgatgaattacacatgattaatacctcttaaatatatgatatattaatgatatcatatatacggataaatacggaagaaccattcatgggttgacatttatactcaccactttccttatttatacatataaaattcattgtttaactaatttatattatatcctaaatcttttccttataaaacaaaaagaggatactccttatgaatatcctctaaaattattatttaatcatagctccgtcagcacctaatctatagctatcaacataaacattgcttagcataacaccatattcatttaggtaataccatttaccattagaatctttgtgccatcctgttttcatagttccattatcatttagatagtaccaagtacctctatcatttacccagcctgtttgcattattccagcatcatttaaataataccagctgcttccttgacttatccagcctgtttgcattattccatattcatttaaatagtaccagttagctccatctttaaaccattgatttaaaagtggttttcctaaagcatcattatattgccataaaccatattcatttttaacccattgatttacttttgctgatggatttacagtagtattattaccagcatcaccattgttgttattatttgaactgttattattattttggcttgaatcagtagtagttcctgccttctttatattaagattatatattctttcttcataatcatcttcgtcatcatcataatcattataaactttaatttctatagtagtagttccagttgagtttaaagcaactctctttctgtaactgctatcagctttacttccatttattttaactaaatcatcattatcttctggctcagcctttacaataatatcttcaagatctttatctacagttacatcatacgaagttattctcttatcaaaagttactggaacatctccatcatttaatactaatttctttacataaatttcatcttgtttagtatctatttcacctgtagctgtattagagcttggcttagttcctctatatatatttaatgtatatgttctttgaggattatcatcatcatcttcatcctcaatatagatttcaactacatttttacctgtttttaaatctactgaagttctccacttggaatcttcatcaacttcttcgccaccgatttctactttgtaatcttcatcttctggctttgcttgaatttttattgagtcaacatctttatcaacaacaacatcaaattctgctttctttcttgaaaaatcaatgcttccagcacttaaattgattgaatctaaatagatatcatcattatcttcatcatcatcacttgaaacattctttctgtaaatctttaatgtgtatgttctagatttactactatcgtcatttttaactgttacttcaaattcatttgcagtacttcctttttcatctaaatcaactttaattttgcaagtacttcctgaatcatcaacatcaccactatcagatgttatcacatcactgcttctatccttttttatagtaatagttgcactttcttgacttttaggaacatatatactgtacttagttttactgtcactaagtttaatatttcctgcacctgaaactcttaaagaatcaaaataaattttgtcacttgtagctgcattagcttcttgtgcacctaatatgtttattgaacttgccggttcaattgttgctaaagcactcaatgtaagagccatagccactgtacgtttaatatttttattcatatttcttccccctatttcattatagttataatattaccatatataactatttaagtaaattgaactcttatttcattactcattatataatacaaagttactttcacttttaggtacttaataggtgactgtcacctgccgagttatacatttatatgtcgaatcattttgattttttataaaaaaataccttataagtggactatagctagtccaccatataaggtatttatatatattagagtaattctaacttattagatttaattatctaatccaagctccgttagctcctaatttgtaaccatcaacagttgtgttagcagccattgatccgttagcatttaagtagtaccaagttccgttatctaataaccaaccagtcttcatagctccgttagcttgtaagtagtaccaagttgatccatctaataaccaaccagtttgcatagctcctgaagcattgcagtagtaccaagttccgttgtcgttaacccaaccagtttgcatgattccgttagcgtttaagtagtaccaagcaccagcttgtacccaaccagtagccttagctccgttgttgtagtaagaccaagttccatcagcattcttatcccatcctgatttaactacttcttcagtcttatcgtcttcttttccagcttcttcatctgttacttctttaccttcgttaacagtagtgtaaacatcaccatcttcttcccaaacgattaagttagtgtcattgtatacatctaatttatctaaagatctgtcacaagtgtacatttctttgaattcagttcctgtgaatttgtagattttacctttatctaatgcccaagtgtttccttcagcatcgattgcataagaatagttttctacgatatcttgatcatcatcatcatctgaaattacaacatatgtatcaacattcttgtgtgatttgtctattgtatcaagtttagttttctttaattttaaagtatatactttaacattgttatctttaacaactgtaaccattatgttaccattttttactcttacagctttaactgtagtatctgttccatctgcgaatccttttattaattcagcagcttccttaacatcactatcatcatatatagtttcatctaattggtatgaagtaacgctttttggaaggtaagcatcatctttcttatccccttgagccttagagatcttttgtaagaaagtttgattttttaattcagctggaacacctgtaacttctacagttgctactgcgtatatgtagtctgaatcttgagctatagcatcaagactaacaagtgaagcttcaactccatctttatctttgttgtattcagaaagcttgattgtctttccttctccattgtatacatatatgttagctaattgtgaagcatcaacatattttcctgattcgttagtgaatccaactggattcatgtttgcatcatattcagcagcagaacctgtagtagcagtatacttgtaccaaacatctccaaaacttcctgcagctacttgatcttcttcatcaaaatcaacagttacttctttaccatatctatcagtcttctttaagtttgtttttaacttagttctagcattatctaatttatcttgtactgattcgtcatctaagattttaccatttgataaatcaactaagaaagtatctccatcttcgatagtagcatacttagttccgtatttagataagttgtcgtagctgtaatcttcatcttcgtcaaccattttatcttttccattgttgaagtataaaccagcatcgtcatcatcagttctgtatccatcataaacgtaagcaccatcaaatgcgattgcatttgtgatagttccttctttagttcctaatctttcagcagcagttgcaggtactattgaagtaacagcagcagcagctactaataaagctgtcattttacttgttctattaaacattttatttcctcctaagtaatataaattcagataaattgtaacatcaattttatttcatgtaaagtaatatgtttcataatattgaatgttatgacaatatttttgcctatattatactgaattctatattttaatctaataatattattcaaatttaattctttagcaataacctattttgttatcgcaatatataatacatttttacattttattttggggaccttttttaaaatttatttttttaatttattttttatttacattcttatttttgcaaaaaacatttaaaggctcaacattactaactttttttataaaacttaatatatacttgtacaaaaaaagatgaagcaaaatgcttcatcttttttaattcaaatattatctaacccaagctccgttagatcctaaataatatccatcaatatattcattggcagccatagcaccatttgattttaagaagtaccaagttccgttagtatcttggaaccaaccagtcttcattgctcctgatgcatttaagtagtaccaagttccattatcttggatccatccagtcttcattgctcctaagtatccattagatactggatttaagaagtaccagttaccaccttctaataaccaacctgtagccataacaccgtcagcctttaagtagtaccaagttccaccaaggttaacccagctagctttcatttgagcaccagttgcatcatagaatgaccaagttccattagcattttgattccatcctactgttggagttgttgggttcttatcttcatctgtaacaccagcatcttcatctgtttgcttcttaccttcagcaacgttagtgtatacatctccatctgattcccatatcattaagttgttttcatcatatacatctaatctatctaaagctctatcacaagtatacatttctttgaaatcacttccattagatttgtatactttacctttatctaatacccaagtgtttccatccttatcaattgagtatgcttttttagattcttcttcgctaccaccaactacatcttggtcaaaatcatcatctttgatagctacataagtatcaacatccttagttgatgaagtatctatcttaccttttttaagtttaatagcccaaactttaacatttccactcttaacacctgttgcatataaagttgagtttttaacttcatagttaacaatttcatgatctaaactagcatcatttaaaattactttagatgcttcttctacatctccatcactataaagatcttttgcatctaattgatatgaagtagtgctctttggtaagtaaccaccatcttctttatctccttgagctttagctattttttgtaagaatttttgtactgatttattattatttgctacaatagcatcatttggagcatatccattttcataagttaattctactgttgtaattgcataaatataatcattgtcttgagtgatagcttctgttcctaagaatttagcagtaactccaccattatctttatcatattcacttaattttacagtttttaacttatctgaagttgttgaactctttacaagagcatatatattagcatcatgagttacgtcaatatatttaccgctatcatttgtaaaaccactacgaataacaccttcttcaagttttgcagcagcatctgttgtaactgtatctactgaaatacctgttaaagttgaacttgtatctactgaaattgctgatccagtagtagtatcacctaatgcagtgtattgataccaaacgtctcctcttttaccttctaatattggcttaaagcttacaatagcagaatctttatctctttgatccttacttacagaatatctgtcagctttctttaaatttgtataaagttttgatttagcattatcaaatttatcttgtactgattcatcatcatcaatctttccagttgataaatcaagtaagtagtaatccccactatcttctacagtaacatattttgttccgtagaatattggtgattcatcttccatatcataatcatcataatcatctatttgcttgtctttatttccatcattaaaataaatagcggcatcatcatcatcagttctataaccatcatatacatatttgccatctgcataagcaaatcctcttgttatagtaccatcctttgttcctaatctttcagctgcactagctggcataattgatgttatagaagcagcagctactaataaagctgcaactttagttgactttcttaacataattctttccctcctaagatttcatttttatatagtaaagtttaacttattttaaagttttaacttttatctaacatttcctgttcgatatataatacagtttgtattaccatttttgggcctttttttataaaaatatataattattacaaactttctataattttaattctgaaattccattactatttatcttaaaaccatcaataatagtatccttttccataattcctttttcattaaaataataccaactaccatcaatatttacccattgcgaacttttcatcataccatcttcacctaagtaataccaatgaccttcatccataatccatcctgtaactttagatccatcttctaaaaaatagtaccatttatttgatatacgttgccatcctgttaccattattccgttcaaatcaaaatagtaccactttccactaatatttatccacgatgatttagcttgtcttcccgaaacatcataaaattcagtttttccattattctttacaaatcctgaattactatcacatactagttcaagtacagcatttccctcatcatctacttgtaacttattattttcaacttcaatatttgtttcatattgttttttttcagcagcattaactggaaaaataacattcataattgctaatgataaaagtaatgttgctgctttattaaaagattttctcatatattctccctccattatagttatatgtacattttattaataatctctttttattaattcactatataatacaactgtctttataattttagggtatgtttttacatttaaataaattaaatacccctagaaaatttctaggggtatcctttaaaagaatatttacatatcctctattaatttttaattattaaagcatagctccgttagcacctaaaacataaccatcaacagttgtgtttgcagccattgatccgttagcatttaagtagtaccaagttgatccatctaataaccaaccagtttgcattgctcccgatgcattgcagtagtaccaagttccgttatcattaacccaacctgtttgcattgctcctgatgcatttaagtagtaccatgatccagcttgtacccaaccagttttcattgttccagctgcatctaagtagtaccaagtacccttatcgtttaaccaacctgtaactttagctccatctttgtagaatgcccaagttccatcagcgttcttgtcccatccagctttaactactggtgtttcatctttcttatctgtgtcaactccagcatcttcatctgtttgtttcttaccttcagctactgtagtgtaaacatcaccatctgaactccaagcaattaagttgttttcatcatatacatctaatttatcaattgatctatcacaagtatacatttctttgaattcagttccttcagattttaaaatcttacctttatctaaaatccaagtgttaccatctgcatctatagaatatctttcaccttctttagaagttgcagcatcaactacatcgtgatcccaatctgaatcctttttagctgtgtaaacatcaacgtctttaactttgctgtcaccttttttatctacagcttctgtaacatctaatttatctttctttaatttaatcttgaacattttgattttgctgtctttaactaatgttgcataaacatttccatcaatcacttcgatgtttttacaaacaccatcatcaaatgttgaaccatcaacatagctcatgattacatctgctgcatcactagagtcaccatcatcatataatctgttatcgctatattcatccattttaacatttaataaataagaagttgtttcttttggtaagtaacctccatctttcttatctccttgagacttagaaatcttttgtaaataatattgtgtagtttctttttgtttatctccacttataacaaccttagcaactacatataaattatctttatcttgagaaataggtgttacgctatctaattttgccattaagttatttgcgctatatgttttaccatattcttcaatttttacagttttatctttatcagtatcatatgcataaatattacaatcttgagtaacatctatatattttcctgaatcattagagaatccttgataatatcctacttcaccattaactgcagcacctgttgttctctttatagcatcttcgtctccagctgctgaaaattgataccaaacttctccatatttatctgataatactcttgcaaagctatttgtgttagcaacaactttgtcatcttcttttgaaaaatcattttctccatttttaaattcagtatatctgtcttctttatttaatttactctttaatttattctttgcattatctactttatcttcaagagtttcgtcattatcaattttaccattagataaatctaataaatattcatcactaccatctttaacagtagcatatttatctccatatctttctaatgtataatcatcataatcttcatcttcatcagtgtttacatctttacttccattgttgtagtaaagagcggcatcatcatcatcagttctgtaaccatcgtaaacatatccaccttcataagcacgtgcattatcgatagtaccatctttagttcctaatctttctgatgcagatgctggaactattgaaacaacagctgcagcagctactaataaagctgtcattttgcttgatcttttaaacataatttatttcctcctaaaattatactttgtatacttttatattttttgcaatgtaacataacataaattggttatgtattcaatcattttaaaattatattaaatatataattaaaatacttttgacttaaattatgtatttaatggaatttttatcaattgcaaatcatgtaaattataatagcacaatttttatttttgtacaatttctatatttttaattatttatatacatttttatctttttttaccttgtatataatcaatatactacatatttattttttattttagggacttttttcaaaaattttttttaccatctaaagcaaagtggcaccgatagtacgtttgttttatattatttttttttatttttttctttttaaaacaataatcaaataaatattaatattttagttatttttagacataaaaaagtcataaaaatttcacactatgttaatatttgtaaacgatttgtttaaaaattgttcatttttcccaataaaaaaacaagtagatttctctacttgtttttttatttaaaattatttttttattttaagttattaaagcatagctccgttagcacctaaaacataaccatcaacagttgtgtttgcagccattgatccgttagcatttaagtagtaccaagttgatccatctaataaccaaccagtttgcattgctcctgatccattgcagtagtaccaagttccgttatcattaacccaacctgtttgcattgctcctgatgcatttaagtagtaccatgatccagcttgtacccaaccagttttcattgttccagctgcatctaagtagtaccaagttcccttgtcatttaaccaacctgtagctttagctccatctttgtagaatgcccaagttccatcagtattcttttcccatccagctttaactactggtgtttcatctttcttatcttcgtcaaccccagcatctgtttctgtttgctttttaccttctgaaactgttgtataaacatcttcatcagcccaagcgattaagttcttttcatcatatacatctaaatgatcaagtgatctatcaacagtatagatttctttgaagtcagttccatcagcttttaaaataacacctttatctaaagcccaagtgtttccatctgcatcaatagaaactgctcctttaacgatatcgtgatctccatctccatctttcttaactacatatgcatctactttttcattttttgcttcagttaatactgcattagcatctactttatcttttttgaattttaatttccacatcttaactttatcagtagccttagatgtagcataaattgttccgtctttaacttctacatttattacttgacgattgtcactatcagtttcagttttattaacaaaacttaataatgcatttgttgcatctttcatgtcgccattatcataaattttgcttgtatctaattgatatgaagctacgctctttggtaagtaagctccatctttcttatctccttgagatttagaaatcttttggaagaagtattgagttgattgaactccagctactgctgcttcattatcatctttagatgatactgttacttgagctactgcatagatataatctttatcttgagatacaggtgtaactttatctaatttaactgttactccataattatcatcaccgtaatcttcaaatttaacagtctttcctttagaagattccattactgatcctggaaggtatatatacatgttagctgtttgtgaaacatctacatagttacctgaatcattagtgaatccaacatatacttgtccagcagttgtagacattctcttagatacatctccatctcctgctgcttcatattgataccatacttcaccatatttgtcatttaatattttgctaacatctccagttgagaatccatcaaagttttcatatctatcagttttgtttattttgctcttaagtttattttgagcattttctaatttatcttgtactgtttcttcatcatcaattttaccagttgataaatctaataagtatacatcttcaccatctttaacagtagcatattttgttccgtatctgtttaaatcatatgaatcgtaatcttcatcttcatcaacatttacatctttgcttccattgttgtagtaaagagctgaatcatcatcatcagttctgtaaccatcatatatatatccaccattaaaagcaactgcatgtgtgatgttaccttctttagttcctaatctttctgctgcagtagctggtactattgaaacaacagctgctgctgctactaacatagctgttaacttgcttgatcttctaaacatattattaaatacctcctaaaatcacctttaaaaatttatgttaacaagttgtccatttataaaccacttgttaatattctatttacactttgttaatatttcataacatattatatattatattacataattttcttttttggaatactttttttactttttaactttaatttttcattttgaattccattatttagtacagtatccgttttcagttttggtacctttttgaacaaactattaacaaaaaattttttagaattttctcactatttataatcccttgatttatctagccttatcgcatgttataaaatttttttcttgttaaaatttagttatctatttatttactttaattaaaattaattatgaaaacataaccttttttaatttttttgtgattttttacaaaattattttttgaattatttatattaaaaatcactctttcaatataaataattcaaaaaaagatatcggataagcataatattatacttatccgatatcttttcacatatattatttacattgctaactaataactgttacttgttaactgttaactaattaaagctccactagttgtaaacttatattcttttccatcaatagttttagttccagtagccataactccgctttgatcaagataatattttgaattattatcaattacccatcctgtctgcatagctccgcttaagttcatgtaataccacttatcattatctaaaagccaacctgttttcattgtaccatttgcttgtaagtagtaccatgtttcaactttctttgtcttagctgtagtttcttcttttttatcatctgtcttgcttgtatctgttttatttgtagatccacttgttgaagttttttcatcttccttcttatcagttgcagttgatgtatcttctacagttacagttttttcttccttaagccagccagttttcattgctccgcttgattgaagataataccattgtccaccagtatactgccatccagtaagcattgctcctttactatctaaaagataccagtttccaccttcttgaagccatccagttgctctaaatccatcttctttaagataacagtaaaccccttgttccttatcataaagccacttattaacatagaactttccgtcttcacctctgtacttccagtcattatcgaccttcacccagcctacaccattcttgtcatctgatgaattgtcattcttatcatcagtatcttctttatcatcttcgtcatcttttacagttcctctgtttactgtaactttataagttctttttgcatcttcaacttcatcttcaacaactactgtaatagtatttttaccttttgataatgaaaccttcttttcatattcatcaccagaatttacttcactaccattaatagttacaagatattcttcatcttctggttctgctgtaacaagaattttacttacatcttcatcaacatcaacttcatatgaagtcttatcttcttcaaaatctaaatcagcttcatcaagttcaaggctgcttaagtaaacatcaccttggctgtctccagctgatgaacttcctcttgttatgtttaatgtataaactctctggttatccttatcatctgtaacttttatctttatttcatttttacctttgtctaaagatatagtctttctataattatcatcttcatcaacaagacttccatcaattcttactcttgagctttcatcttctggttctgctgttattttaatttcatttacagatgatgcaacttttatattgtaacttgttctttgctttaagaaagttatgtctcctttatttaaagacaaatcttttaagtatacaggatcttgagttgtgtcctcataagaacttcctgtagtctttttaacatttacttcatattcttcttcacagatagatacatccttatctttatcttttgcttgtctaaaatcagataaagaagcatatgttcttacataaacagtagtattacctttacctaaatataatttatctccaggcttatatgctgttgcatcactatcatctgtaaggaatattcttactatacggtcagaacctttagcttcagcatttattactattccttcgctgtcatctgtaagctttatgaagtattccttctcatcacttaatttaactgtatctccattatagccatctttaaggctaagcttgtctccatttgttgatttaataactaaagaagttagttctccatttcttgcagtgtagcttgctgcataagctggcttagatgtcaatcctaaaaaagtctttggcgcaattgtcgtaacagcactaaaagctacagtaagtgctattattttttttatccttttattcatattcttcccccttttgccattatacaattaattttaccatgatttatacctttatacaacgaatctacaaggctctaaaccattgcatgaccttaattttttattaagtttcgacatttatatttcagtacaaatatatagattcttttatttcttaaaaataatctttaaattgtaaaataataattatatttattggcgaaaaatttttttcatctataacaatatatatattgaactatgaaatttacaattataatctaaaaatcaaataataatttttaaaattcattactcacaggtagtacctataagggatatcaccagtaaatcataaattacaatatatattatttataaattttcattatatatttcttagttaaaataaaaagcgtagttttgccacgctttttattttgtattgtatattacttaatccaagctccatcagctccaagcttatagcctccaatagttgtattagaagccatagcaccattactatttaaatagtaccatttaccattagcgtcctgaatccatcctgtcttcattactccttcaccatctaagtaataccataatcccatgacaaatttccatcctatatgttttgaaccatcttcatttagataataccaattaccatccttctgaagccatccagttaccataactccattttcatttaagaaatatgattttttagcattaacatcgttaaaccattgatttttcatcatatttccattctcatcataataaagccatattccttgtgtagttacccactggttcttatactgagatgagttattattatttgaattttggttgttattattgctatcttcttttacttcatcttcatcagaatcatcttttttcggaggttcaacccctttatatacatttaaaatatatttctttgatttttctgaattctcaattcttatagtaattttatttttaccatcttttaaagttactgtttgttcgtaatcatcatcttcttctgcttcttcaccattaatttcaacatactcttcatctgaatccattggttttgctttaatatcaagatatcttacactatcatctacacttactgtatattcagttaccttacttgaaaaattaatttttccagcacttaaagtgatattatctaaataaacatcatcttcatcaagatcttctccatagcttgctgaacctcttataacttcaagttcataagttgtctttaaatcatgttcttcatcttttacccttattgtaattgtgctttttccttgcttaacatcaactttaaccttatatttatcatcttcttttgcgtcatcaccattaacactaacctcatatgctgaatcctcaggttttgctgtaactgtaatttgatcaacatccttgtccacttttatactatatgaataagtttctttatcaaaatctacatcatagccacttacttttaaatcacttaaaagaggatcatcatattttgctgcatgagcagtttctgtaaaaatactaatttcctttgcaggttctattaatgcaattgcatttactgctaaagtaagggcaattaccttttttaaattcttgttcatgtgaaatcccatccttatgcttatatgctttattatttaatcatggctgattatgagccatacgaactactaactcttaacccattttatactttattatttgatccatgctccatctgaacctaatttatagctatcaatagttgtattgcatgccattgatccatctgaatataaataataccaattcccacttagttgtacccatcctgttttcatagctccatcactaccaagataataccatttgccaccattatttaaccattcagtagccattgttccatcatcatttaagtaataccagtttccaccaaagctaacccatcctgttgccattgttccatcgccttgaacaaagaaccatttatttttagctgcatttccatttgaatcaacatagtaccattttcctgctgaattctgttgccactttcctgaatttgatactgtatttgttgttgaacttgatgaatttgttgttcctgtagaagttgaattattagtacctgtattattgcctgtgtttgtactactatttcctgtacttgtagtattattggttgttgtacttgatgttggaatatcaacacctctatatatatttaaagtatatgttctttgtttcttttcttcatcttcaccatctgtaagttttatttttatttcatttttaccttcagttaaggtaaatgttttctttatactttcttcaccttcataagtatcatcacctattttcactgtataatacttctgatctggttcaattacaatttttgcttctttaacatctttgtccactttatagtcataaactttcttatctttagataaactcatttctttaccatttattgtaaggtaatcgatataaagatcttgttcaatttcctgatcattttcatctgttcctctataagcttttaatgtataagttttactttgtgattcatcatctctgttttcaatctttattttaaagatattttctccaacacttaacttaaaattctttttatagctgtcatcagaagaaacactttcatcatttattgtaactctgattcttttatcactgccttctggagatacttttatatctatatttttaacagctttattgtaatataccttataagaagtaacatctgatgagaaatctattttaccagtacttaatgaaatagattcaagatttaaactgctcttatctgaagcaaaagcagcaacagttccttcccctgataagtttaaatttttaacaccacatactgctgaaacagcacaaagagtaagagtcattgcaataattttttttatattcttattcataatttacctcctaaattcttttcttaaatttcatcacatatgtttactaagttcactaaaatgtcattacttctattccattataccccatatacacatatatttattactctcatttaaattttcgattaaactatatacacttgaagccttataatggtcataattaagcttataacaaaaataggtcccataagaaaatacacttgtaaatgtcttatatgggacctatttggattattttaagtattttatatattatttaaatgattttgcttatacagactcattaaattttgagtttttttatatataagtcaaaaaatcctacacggattttcacctcaactcgtaattactaactgctctatatcattactccatttgaagcaaaactgtattgaacaccatcaactaaaacatttcctgtaaccattgatccatcactattgaataaataccagcttccattatcatttaaccatccagttttcattgatccatcgctgtttaaataataccatttacctgcatcttgataccatcctgttaccatagctcctgatacatttaaataataccattttccatcattgcttatccaacctttttgcatcttcccactattatcaaaatagtaccattttccattaatttgtgcccatccagtttgtgcatatccatctttatcaaaatagtaatcacttgctgaacttacatcaaaccaccacttattctttagaggttgtcctgttccatccatgtacatatatttcccgtttttacttacccatgaattcatagttccactattgtataaaaatgaatctgaaccagttattatatttgtgctatctttttcatctgatgaatttgatgaatctgatgatttaccacctctatttacaactatattataagttgtagtttcatcatcattttcaactgttatcttaatagtattttcacctttatcaagactaaccttcttttcataatttccatcttcatctacagaatcaccgttgatttcaactaaatcatcatcatcttctggttttgctcttacaagaagctctttaacatcttcatctacattgaccttatagcttgtcttgttctttgtaaaattcattgatccatcactcaaataaattgaacttaaatatggatactcagtatcatcttcttcatctgaatttacactatcctttgagatatgtagagtatatgtttttacacatttcttaacattcccatcatccgaagcatccttataatcatcttcacttctgtatgttcttaaatataaatttgtacttccagagtctattggaacaagacctaaatctgaaggatcataaccttcagcatctttatcactactcttaaacaccttaactacataatcattgccttcaacttcagcatctaattcaacaccatctgaaccctttaaatcaatatagtaatcagtactgcttgttaattcagtttcctttgttgctgcaagattgctgtatagttgtgcttccttacctgtacttctataaacagataatgactttaactgtccatttgatgcacctgagtaagttgatgcattagcttcaataacacctaaattaaaaatatttgctggagcaactgctgaaaaagcgcttataacaagagctgcagcaattaaatgtctaacattcttattcataattaattatcctcctaaaatcatctaacattattattaaaaattaaatttcctattttactttcttagtaaatcttttttaaatttattactcacaagaagtgccttcagtcccattaattttctatgtgaattacaatgtatataacttatagcaattgagaatatagtcaaaataacaattccctaaagatatagctataagatatagttataaatatataactatttaagtatactatattctaacatttataattattaattttttgttaatatatgtattgtatttatacatatatccaaattaaaataattatttctatataaaccaaaaaatactataatgtaagtgattttacattaattttaatgatttataagatgctaataaattcataaaaaaatatattgcaacatatatatattagttattaactcttaaagctattataaattgaaatatacctgccattatttcattaatacctataactttatcattcatttataatatttatcttacgtaaatattaaattttcctaaattttaaatctaaagtaatttaaatgaaccattatcaaatactacttcttcaaactacttcaccaacatttatttttaaaaaagttaactacacattttacctatatatcatctaaaaactcatccaaatatatgtcgcaacatttatctaaaaaatcacttgaaataaattaatacctatataatacatatacaaattgaatataaaaaaatatttagtacacactatatagtgtaaatattaatatacaatttgtgtgttaatatctatggttattacttgacaacccaacaattataaatacaactgtataacaccaattctaaatattcattaaagcatagtaattaatttttgttatgcatactgaacaaggagtgataaatatgactcataaagataagccttatcttccaaaggtaagaacagactatcatccaagtaattctgattgtcaaagttctactggagttggccaaacaacaaacattccaaatcctgcttctgattctattgttgttaacaacattgcaagtcaggagtttgattacactcaggatttaatggatattaatgatttttctcaaaactcaaaacacacaaaaaaatattaattattacagctaataactagttgttagctgtaatatacactccatctttctaataattttttaatattcacctttatggtgaatattttttttattaatggataaaataatattgtaccccataatactcgggcgctaaaattttataatttatgcccactcaaaaaaagtttcctataaaaaattttataggaaacttttattttataaatttatattatcttttacatataacttaaaaagatacttttatgatttttatcttaatttttaattgcttacgagccactcttaaaagacatcaaatgtaaattaagactaattatctttacttgcatcttccatgctccagttatcttctgtagcatatacagaaataccaccatttttactttgacttgtttcatatagcattacaccattattaactaagttattaaaagcagtatttttatcaatactatcttcagctctacttacaattccaactggcgcattaacatatttcaagaaatctccagttgaagaagtattgtatccatgatgaggaactttcaataaatcaactttttttccatcaagaagatcacttacccagaaatctttttctgaagtccattccatatcagctgcaaataatccttggaaatctccataatttaagtacactatagctgaattttcatttattccccagtattcagccatatgtttctgagatcctattggaccaaaatcctttcctgattgaacaaactgtaatatttcatttgaatcaatatattgtcctggtgttggatttatgaactttaagccgttatcttttactgctttagcagcttctttataaatctgatagtcatatttaagcatatctatatctgcctgactaacttcatcatttacctttagtcctgaataccaattctgcatagctgcatttttaggcatataaattttacctacttcaaaattatcaagaacagcagcaagtcctccaatatggtctgaatggccatgtgtgattattacataatcaattaactttttgccgcctttttttcttaatttttgttcatttaaaaaattaactaattgttctcttgttgtaacatctccagtatcaattaatgctgtttcaccatttggaagtctaataaactgacaatcagcattacctacacttaaatatttaacaaataaataattatctgcatcttcactttcaataaaacgtccattgttatcaaatacttgaagctttccatcaataattatattgcctttagcaattgaactatctgcttttgcataatactgataattttttgtttttatccattggttagtaaccattaccccgtctttatctgaataataatcttttcctttatatgtatagaatccagtctgaagctttccatcattagcaaataagtaccatttatcatctatatactttttacctacaaccattgttccagcatcacttaggtaatactttgctccatcatcttttatccagcctttttccattatgccatttttgtctaaatgataccattcataattaataagctgccatcctgtttgttttactcctgcttcattgaagtagtaccattgtccgccaatcttattccatccagttacagctgcatgattttcatcaagatagtattcattatcattatcagcatcttggttttcatccttttctttgaaccatccttcttcttcgatgattccatctttagtaacatagtgaagttttccgtttatattttcccaatgaggaactatttcaactttaataacctcatcgtctttagtgcttgtctcgtcttgttcttctccatctacaatatcttcatttttaatcgttgatgaatcttgatttttcttatcttcttttttatctgtttttgatgaatttttatctgaattgcttgtactatttttatcgtctgttttttgtgtactttcgctagaaacatcactgcttgtcttattagaaactgcataagcgcctgtacttaataatgagcagctgaaagctaaagtcatagaaattgtcataagtaattttttaatgttgtgcataaaaaatgtcctccttatctcatagatttcattataacctaacttttacaatgtttcaaactcttaaaaattcatggattcatctaaaaactttatgttctatactatatttttaatcaaattaattattttattcacaaaaaatcactaatttattattttcaaaagaataaattagaatatctgcgctaactctgtattttcaatactttacaagactaaattattttatttactcctgctgtttttttattaataattatttaaatatagtttttaataatgtaaagctcccactcttatataatatttttcactatgtttatatttcaataactacataaaattaataaaaatttaatgaaaattcaaaatgtttacaataaaattctttccaataacttaagggtttataatgaataaatatctgaaaattcaacattataaatttccactttatcttgtggtgatgtagttatattctgcttatcctcttttttttcaactgtccttacaggaaggctaaaatctatttctgcacccttgattacttcattattaacccatacccttccaccttgaatttctaacaatgactttaccaagaacaggcctatacctgtgccttcacaaggtctattcaataatttatcaagctgaacaaatttatcaaaaattcttatactatctttcttttcaatagcaacaccatcatcccatactgaaactattatttcatcttttttttcacttagccttatcttaactaatatatctgtattttcatcgctatattttattgcattggataataaattgagcattattctttctattttatctaaatcacaagctataattatctcttcttcttctgtatcaaaaattatatttctctgtgaaacctttatataatcagaaactgatatgactataccttctataacctcaactatattacaattagtataattaacatcgtagcacatatgatctaatttttttacatcgctaatattatttataagccttaacatcctatttgaattctgcttaatataattcaaactctttattattctatccctatacccctcacattcatgagtctttaaaatgtcatctattgaatgtattgaagtaattataatatttagaggtgttctaatttcatgtgataagcctaaaaagaactctgtttttaaattttctatttctaatgcttgtctgtattttatcttcttattttcttcttcttttagttttcttgttataattttattttgaaacaataatccaaatttatagcatattgaatttattaaatctttatcttcaacatttaaattttgatttttatcataatacacattcattattccaactatattactgccatattttattttatatatttttatattgtattttttattaccgtataacttatgtagcattttgtaatctattgttatattaacaccagaaaatttaaaaaatctcctattacctaaatttatatttttcttttcaatagtgtctatttcatgtgaagatatatataaattcaaatcattttgttcttcatcgtataagtatatatttatatttgatgcttctaattgttcacatagatttttacatattgattttattttatttttgtagttatcatctagcaaagcatttcgattttctgtatcataaaatatatcataatatccataagtagaaagtgaataattttctatttgatcttctagtaaattcaccatttttttatttagcgttacttcttgtgatatggtaataatacatttttcattattcatattaaatggtgatttatacatgtaaaaccatctctcattgtcattaattattcttagttttctttcagaaaaaatccctttatttttttctattacttccttatctatttcacgtattttttcataatctttatgactccaaaagttactcatattttttttataaatttcttcaaattcacaatttaaattcttacaaaacttttcatttgcatatatatagttataatctaaatctttaattgtaatttcatacggaattaaatttaaaatgtccttaagttcaatttctatatcttcttctctcataaaaaaatcctcccaaatgttattaacaaatttccccttgtgaatacaattataatacattttattcatttttatacagtttttatatttatttgtaattatttatcacattgatagattttaatttatatgaataatataatctcccttaaaatcaaatattattgatataattcttaaattatttacattaatataaactaattggtgtattcttgataaaaaaaactgacaaagcgtatacttcatcagtttctcaagaataaaaagttaattaatttttatgtacatctctagaatatatcataggacaattttatatccgatatatttacaggcttagaaaaataatatccttgaattattttgcatccaatatcctttaagaatttaaattcttttatattttccactccttctacaactaaatctgtatctaattttttagataaagttataagagcttctattatatattgagccttagtattttcatgaatattacttataatggatttatccaatttaattatgtctacattagtttttgtaagaaataataaatttgaactacctgttccataatcatctacagcaattctaaaatttctttccttaagatttttgaatacttctgctatcttatcaatatcctcagttaatattcctctttcggttatttcaaattccacataattatttatattcatatttccaaataactcatcaattgtatcaataaaattctcttccattaaggtacctttatatatatttactgaaataggtattattttcttattgtttttttttaactcattgatttgagttattacttgtcttatcatgtacatatcaatatcatatactagtccattttcttcacacataggaataaattctaatggatagataatagaattatttcttttccatcttattaaagcttctatagaagctaattttccactttcagaatatacttttggctgatataaagtaaaaaattcatttctttttaatgcttctaatatatcatttttctgtatgctactttttatattcataaacttcacatgtccctctccatattataatacgaattacatattattttatttttttacaaattttatagtatagtagatcagaaaatatgtttaaatttttctatttataggaatttttatactatttatataaataataagacaaaatgaatattatgtcttatttttttatttgttttatacaaaatgaacaataaattagctattataaaaaatttagttacaaaatattaaaaattatataaaaaataatattttgttaatattattttgtaaaaagcaaaaaaactggacataatattcataatgtccagtttttaatttatatcatttccccaatttcttcaagcttagtatacattctttcttgctgtttacttgtaaattgaaagtatatctctgtattatttaccgatttgtgaccaagccaccattgtatctccttaatatccatttctgaatcagctaaatgaacagctgttgtatgcttaatagtatggaaatgatgtttactaacatcatctatcttcgcaagtttacaatattttttcataagataatctagagtttttctagatatgggattatttttttgacttttaaatattatttcatcactattatatatacctttttgacttatatattcttctaaaacattttttgtctgtaaatctaatcttatagtattatttctactccctttcagtcttttacagtaaagttcactttttctaatactatagtcatcaaattttatcaatgaaatttctgtagctcttaacccacatctgtatgcaactctaaatatagctaaatctctcaaggaattatgtccactatatgtttcaatggcataaaataaatttcttaattcatcttgtgttagatatctcaatctattattattttcattcatctaaaaactcctacaatttattttaatttactacaataaattgtagatatataagtataatatgtaaactggaaaaataccccttttgactgataaaggaaaactttatattaaaattatttttatatacttatacataataaaagatgatgagactagatctcatcatcttttacctaaaaaaatacttctattttcatagttcccttatgtcttggaattattttttcatcacacacttttccatttataatcatagtatattttgttattctttctgaagtacttttactgaatcttaaaccatcatttattcttctaatctgtatagtataatcctcagtttcattttttattttaatttcatactcattccagctttctggaatacaaggattaatctcatatcctttatcttcaactcttctaagtccaagaatattttcaattccaaccctatacatccatcctgaggctccagtataccagctccagccacctcttccaccgtgtggctctcttatgtatacatctgcactcataacataaggttctgttttatataacatacattcaagctcagtttttgaatgatttataggatttatcatattataatattctacagccttattgccaaagccaagcttagtgattgctagtataacccatactgctgcatgagtatattgacctccattttcacgaactccaggtacatatccttttatatatccaggttctagatatgaattattaaatggtggtgctaaaagtaaaatcatccccttatcttttttaacaagatttctatccacagcttccatagcttcaagtgctctttcactgtattttgcactttcgcttttattttcagcttttaaattatcaatattatttgcactaatttcagagttttcttcttttttattaataaatttcatttttggttgtgttgtttctttattattatctaaatcataatgaacttctaaatttgaatcattatctatcacactattatttatcatgctatcatcttcagaattatcaattcttgaagcaccagaaattacagcccagctttgagctaaagaatcaatctgacactctggattttcacgacttccaagaggagttccatcatcaaaataggctcttctataccagcctccatcccaagcattcttttcaagattatcctttatgaactttttctgttgtctataataaactacgctacttgaatcatttttatattctgcaattttaataaagctgtttaatatatcatataagaaccatccaagccatacactttcaccttttccctcatttccaacagtactcataccatcattccaatctccgcttcccataagaggtatgttatgctggccatattttaaagccttctggattgctttttggcagtgttcatatatagttccttcattagatgacatatttactattgtatatctttcatcttcaccttccctcaaaggctcatcttcaagatatggtgcttttatatcaagaatttcataatctcctgttgagtttatatattctgctgtaacataaggcatccataaaaggtcatcactaaaccttgttcttattccactgttaacaactggatgccaccagtgttgaacatctccttcaacatactgtctagatgcacttcttataatctgagactttgttatttctgaatcaacaactccaagtgctattgaatcctgaagctgatctctgaatccatatgctcctccactttgataaaaagcacttctgcttaaatatctacaactaaatgtttgatataaaagccatccattaagcatatagtccatagatctatctggagttgatacacgaatacctccaagtaagtcattccagtatttctttacattttcaagggcagtatgagcattattaatatctttatatttatcaataactttaatgatattttcttgttcatcctgaccaaacactattacaacttctttaacttcgtgaggctttaatttaattctgctacacgcacttaaacatggatcatatatacttcctgttttattgcttaaattgctgaattccatagccttaggtttttcagcttcaccgccaaacccaataaactccttagtatctcctgaaacagtaatattctctccaccaagtattgttagatatgcatgaagatttccgaaatattcactgtaaggattattaccaccaatatattcaatagcattattgtctttaaaagtataagttgttatatatctttcactttcatacccgtaaactcctaaaactagctttgcataatagaataatgaaagttccctttcttcatttaataaattttcaagctttattatctgaagctttaccttttcatcttttggagtaaacaccttcattgttccctttatgtcacacgaagtatgcataaattgtgagtatccaaaaccatgttttattatatattcattcttatctctaacaggcttagggcatattgaaaaatatctgccatccttatcatctcttatataaaaagcttctccaacaggatctcttatataatcattactccatggagtaattttattttctcttgaatttccacaccatgtataagatgatccgctctctgaaatgtggaaaccaaaatcactattagacattacattaatccaaggtgcaggagtattcttataatttgaaagctttattatgtacgtaccgtctctcttatcaaaacctccataaccattaaagaaatctaaatctgccttagaataatattcttcactatcacattcataatcattttccgcttcactatcatttactattttttcatttcctttattaaattcactatcacttatatattttttactatcatcatgctgtgcaacactattactatttatgtttttatcttctttattatcatcttctgatttatcaatgccatttattaaatcagttttttcaataaagtccacatcatgatcatattcactataatttacatcagaattattgttgctgactttttctccattataatcatcaaactcaagatttaaagaatcaatttctttaatacctaaatctaaattatcttttctagataattcattatcctctttgaataattcttcattatcatttccagataacttgctatgctctttggataatttttttgatacttcttttttaggcaatacactattcttcttcttgaatgcttttccttcatatggattatgtgaattatccaaaatatgactactctctattgctttcgctccatattctgctctctccaattcacttacatcagcattttgtgtttcacttaacacattatatcttgaatacataagtgagcttgctgaaatatcattgtcttcttttatttcagcatactttttaaactggtctaataaagtcccattcttagaatcaatataaatcctacttattcccactaagaaatcttttatttcttcattcatagttgatttattgtgaatataaattcctgcagacttattaagactatttcccgcattaaccatattaacagcctgcattatacttttttgaagtggttcatcataagatacttcttcattgttatatataacaagatcagtctttacacccttcaattttaagtacgaataaaactttatcatgcttattacaagatttatatcttcttcatcttcgattgcaagaagaattataggaagatctccagaaattccgtatgcccataaatccttttggtgttttgttatattctttatataatcttctctgtcttttcgtcctctttgaagataaaaaatataactacttaaattttgaaataaatctgcttgaatgcttctcatttcaaggtttttaagttcaagctgaactcccacactatatctttcaaagattttttcagcttttgaaggatcattatatttctttcctatttcaagtgcttcctccttagaatcacatgttcctgtaataaaaaatatctcccgtttttcattagcttcaatacgtacacgcactctcatgcttagtattggatcgagtacagttcctattgtgttatctagggctttatcattatccatagatctaggattcttaagatctctatttcttcctataaagtttacccttgaagtttcataggttatttcaccttcactctcaccatttacaattattttttgaaaaatatatggaacttttgcaccttttacccgtccacgcctgcttccaagaagtattttttcattttcatcatattcagtttgaataaacaaatttgaaaatgcaggatgaacggaatccgcaccaaaagatgcaagagtaatttcacaataacttgttacttcaatacttcttccattttctccagtattatttaatgttatttttcttacttcaaagtcttcctctgtagagagagcaacttcagttatactctcaatatttccatcacaccttgaaaatcttgctttatcaaggctgaactgtgcttcatattcttttccaaatgatttacatggctcaaatgtagaactccaataatcatttgagtttaaattttttatatagaagaatagcccactatcatcactagtgctgtttcctttccatctataaagcatcatgtcatttttcttagaatatccgcttccacatatatttatcattgaagaataatctccatttgataaaagaagaacctgctgttcatcaaatgaagtttcatcaatagctttaaatacccttggttcaataacctctccttgaaagtatctattttttactgaaaaatcttcgtttctttcaaatgtaacatgatatggtatcttttcctttaataaaagttctgaagcctttacctgtggctgtttgtggaacctatttattaaaatattatcctttaaaacgttatctagagccatgattgacattcccaaatgatgaaccatatatgtgattactttattaggttttacaccatcattgtaaatatcttcataattctgtggataactttccacagtaaagtttttttcatttttcttatcattttgtggattattttgttctttatcgccttctaattctattgctatatcttcttttcttgttttttctacaaagttattcacattatctacattatccacagggcataattcgtcattgttaacaacagcattatccactatatatccacacttatccacattaatcacagagttatccacatttccactattattattcacatcatatgcagaaataaacttatcctcacgtgcttttgtatagtcaatagattcaataaatccatatctgcctaacgctccgcccccttgaattttcttcaaattttcgatggattttttaacacaaaatggaagtgctattattgtagaataaggagaaactactacttcatcctcaagtcccctctttaatccaagaccaggaaccccaaatgccttatactgatagttatcgtcattatcaaactcataaaatgcagattctgatataccccacggtattttcttttgctttgcaaaagacatctgtgcttttattacactcttatatgtctgatcaagcaatgttttaggataattcttcattacaagagaaggcataaagtattcaaacattgttccactccatgaaaccaatgaatgagtgtgaaatgcattagtcattgctctacttaaattaaaccaatgactttttggaacatcattttttgaaacagctgcaaaagatgcaattctgcattctgatgctaaaagatcataatatgaatttccaagagaattttcttcaacattatatcctattgaaaataaccctctacttgtgtcatataagaaattaaagttcatttcattacttatttcatcaatttcatctattatgtcatttatactgtttaggcatttttcaaaatactcaatttttacacctagattgcaattaaagttatccccagaaatttcttttgtctttttgcacttcttgataatctcatatacattaggaactccttcaaaaaactccttactgtaaagattgcttatattatcaaaaatattatgatagttttctattttcctgcttacttcacaaaatagcttattaagccagtattcaacttcactatcaaatttttcatcaagtgagtcaatttttataagtatttcttcaagagtgctacaatattctccagtatatatatcttctgaaaatcttattcttatttctggattttcttcttcaattattctatatatatcattaattgctgtaacttcttctattcttattataggcgctgttttaagttcctccattgcttctctaagtatccacagatttgcaaggagattgccattatcaactgttgaaacataccttggatatagaggtgctctagttcttgtatcgtaccagtttagataatggccattaaatttttctaaggttctcatactatttaaaatggactttgttttatttataagatcctgaaatgttatatatccaagatcatatgctgtaacatttgcaataagtcccattcctatattagtaggtgaagtcctatgagcaacccccttaaatggtttttcttgataattatctggtgcaagataattgttttcctcatttacaaaatcctcataatatgcatatatacgtcttgaaagctttctcaaatattcacgttcattttcatcaatagtttgtttttcatcttttatatctttacttatataaaaagctgtataaggactgcatatccataatactgctggtatcaaactataaatccatactcccacagaatcatttaaagcaataagaaaaatgaaaattcccattactggtgcaaaccacattcttaatacatatgactttaaatcattttttacagacttatctgcaaaatgtgatgactgccattcaagaagattacgttttgaaaaaataagtctaaataacgtagttcctatagctttaaccataagaaacgcctcatatggtataaaacttattattaagattatctgtttaaaagtcttaaaagctcccataagcctattcttaggtgtaacaacaaaatctgttacagtaaaaacaagaggcataataaatactaaaaaacataatagtgcaatctgacgatttttcattgaatcgctcagtgatattattagaagcaaaagtaaatctggtgctaataaactccttcttaagttgtcaaagatcttccacttatttaaaaaacttatctttttagaaaataaccatccgataagttgccagtctcctctaacccatctataaagtcttctacaacttccttcataatatggtggatatccatcaacaagttcaacatctgttacaagtgcacatcttgttaatgctccttcaagaagatcatgacttagtactctgttatcttttattgattgttttgttatgtcataaaactgatctatgtttattattccttttccaacaaaagatccttcaccaaaaagatcctcataagtatcagaataagctgttgagtaaccatcaacgccactatcaccaccaaatatctgggaaaatctcgttgcattttttgcttccatgcttatgcttaccttaggttgcataatattgtatcctcttataaccacattctttttattaacgtaaggcacattaagtacgtgactcatagctccaacaagcttatatacagtttctcttggcataaaagtatcttcatccagtgttattatgtattttgcatctcttatatcatcaataggtgaacttattacatcaaaagtattatctgagtatcctcttataagagacataaattctaaaagtttaccacgctttctctctctccccatataaacgcccattttttcattataagttcgttttctgcttaaaaagaaaaatttattaccatattttttgttcaactgggatgcacatcttaatccgcaatctactatttttttatcaatatcattatattcatcttcactatcacaaaaatcacttaacaaggcaaaatatacattaggatcatcattaccacaatgataaacttccagtttgctcataagttctttaactttttcagcactattaacaatggcaggtataactacaactgttttgtattcttgtggaattccactgcttaaatctagctttggaacaagccttacttttaccgttcttcctacaatataatttacaattccaagtactatctcatttataggaatgaaaagtaataaaaatccaattataagctctcttaatgtatatctaactccagtagctgcccctataactaaaaatatataactcaacactaccgttgtaacaatgtttattgctatgtatgttccatgtgaaattacttccgtcacatcatgataatatccatcaagcatacggcttccatgttcaataatataatatccaacatgacacttatattcttcttcatttttttccctactagcttttgcaagatcaagtatattcatagctacttttatttcacttgtttttattaatcgtgctatttcttcaagcttatgtctgtaataatcctttgtttcaaaatccatatttttataaacttgagctggatcattttcaagtatggattcaacaactgaagtcttttcaaaaaagtacctccagtttattccttcaacagttctaatcgctgttatatactgacttatgttatgttcaagatcttcttctttaaggtttgctcttattgaaagcttattataatccatatctagattcaattttaattttgaataattagaaatatccttatcttcaatggaattctctcgtaatattcttataaactctcgcaaaaataatggtgacaaatcaatattaacgtctgaaaactctttactaaaatcaatttgttccttaatcttttcattatttttataatcaataatcttttcagcatacaccttccccctaaggacatccttttgaacgctaacaagttcatcagtatagtgtgctaaatttagtattattcctattctaagcataagagggaatgcccataactcccccattgtaaagcaataatcactattatttttgttttcttcaaaatcctcataatattttatgtaatctatcaaatcattaatttcaaggttccttttttcatttatataccttttagcaactattaaaatacgaggaatattattttccatgtctgaatatttgtttaaactgctctttctatttatttctgatttagcatttttagcatttatattatcacaagcagttataatatcatcataattaacatttatatactttagatactcttctccataaggaagacttttaaagtattctaaaggcatacacttttttacacatttatattccttttcaataagataaatattatcaaggagccattctgctgctccaataatcttaactttattcttatttaatgttttgaaatatttaaaattatcatgaatgcaggaaaatccatcagctaactcccttagaacattttttctaagttcataataattattcttactcaagtaaaaacacttcccttcatcacctagttcagttaacgctaaagttatttttaccaaaaattcaaaaataattctcttaaaagaaaaaattatccataaaaagttcagttgattaactatccctttatatcccccaattgaaagcagacaattacaatatatgatgataaaaaaatatctttctaaggtattagagcttgaagttcatctccccatgtttgatttttaagattatatattccaaagttagaagcaaactcccagtatgcccatgaaaaattatagctatcagcttctgttcttactgattctatccatttatatctatattgttcctttacctttttatttacaccgaactcacctaaaaaaactgggattttattttcttttgaatacttttttgcaatatcaaacttattatccataactctaagttctgcatctgttccattccattttatatttcttaaattttcatattccttatgatatgaatctccctgaaaagtaaaagtttctggctcataataatgaaatgtcagtataagatttttatcctctggaataataaggtcgtataatctttcaacagaataacaactgtcaggacctactattatctttctctttttatcatgacttcttataacttcaacagcattttttaaatactcattccataattctccttctaaattctcttttggttcatttaaaagttcaaaaacaagcttatctgaagatccagcatatctactacttaactgatcccaaatgcttaaaaacatacccttataatcctctggtttttccattatttcttcaaaatgatgcatatcaagaattaaagttagattatcatttaaagcataatttatatagttatctattgtgttcataaactgctcatcaagaacatatgtagttttatctgcatagtctgaaaatcttacaggaagtcttacgctatcaaaaccagcatctcttattatgtggaaatattcagctttcatttgtaaatcccatggaatattttttggtgattcaagtgcatttcctatattcatgcatttatgaaaagatgtttttctattagcctcaatgtttttttcaacagatttatatgaaattaccatacctacactaaggataatagctgctacaatacccattaatacttttcctttcttcatatatcttcatcccttcaaaatatactttcataaatttgatttaatcttttctcgtcttaaatctgctcctccagtataaaaacaatatccataataatacaaaagctgaggcaacaattattatgaaagataagataaatttattatttaaaaacttattatcttgatatgagtcataaagttctatttccttagtttcacttatgtttccatcaccagcacaaatccttattctctttaaatcagcagaatccttaatagtaagaactccatcttttgtaatagaaacattatttatatgttctggtatttcaaaaaccatattatctttttcattaacttcatacttacttatagtttcaccattggtaggaatcatcactctgctgcttcctgttatttcaaaatcattagttaaatattctccttttatttctcctgaatttattactgaaaatctgcttaacttaaagttagcctcaatatcttcttcacaggtcatatgtattccccataaatttatttctgtcaaagcacttttataatcatctctatagacaggattatcaccatcttctgctatcaaacttacaaagggtatataaacattaccatcaaagccagggtatatactaatacctccatcacagacagtaactttttctatcatactgctactgtcacttttaattagtattatccttccatcctcagctataagattaactccattcttgctttgaagattaatattaatcttaattatttcatcatctttattatcaatatgaaaggcaaatccatcataactgctccagtctgaatttaatgtatcaaatataaatgctgtataatatccttcctcaagattttctgtatttatatgtccatgtacttcatgctcaccattatcatttaaattattgataactttagaaaccccactttccattgtaatttttattccattaactttaatttcagtaagttctatttcctcaaccgcatatataggtgtactaaatgccataaaaagtatggttaataataaaaatctctttattatcttctgctttaaattttcatgcatattatttatcactaaaaacacatcccagcacataattctatactttctaaaattcataaatttctatattttttaaagtttatcggttctatatttttttattctacaactatactttcttcaatgttcataattctatattttttaatactttaaaatctattcttccaccgcctgaaataataaaaagcatgacatcataaaatcttatatcattattcatattttcctatgttgatagataaattattcatattttgcatattatactcaaataaattattaaatataaaaaatagcctttacattcttatttctaaaattatctattaaaaaatcatatataaaaattctttttatatgcatcaaaaaaagaccagcaaatagctgatcttttttgattaaaagaacttaatcttattttattcatttttaatacatgtttaattatacttcaatataaaaaatcacatatttatagttttactagtcacatattttactttaaattttcattacataattgcaaataaaatagaaaattattaattaaagaattctgtaaatgcttttattgtatattcattatccttaacagatgctaattctcttattgaatgcatacttaaaagtggtgcacccatatcaataactggaatattaagttttgcagctgttatgggacctattgtagttccacctctcatgtctgaacgattaacaaatacctgacatggaactcctgccttttcgcatactcctttaaatactcctgcagcataactgtcagttgaataacttccacttgccgctattttaattacaggacctcctcctaataatggtttattagttggatcacatttttcagtataatttggatgaatagcatgagctaagtcagctgaaatcataactgaattcgataatgctcttctaaatccttctctatccttgtttaatcctaaaactattctttctaatatattttctaatattgaagagttagctccttgagaagttaaacttcctatttcctcattgtctaaagctactaaaactttagttgcctttattttattactttcagttaatgcttttaatcctgcaaataccatccaaagatcatccaatcttccaactgaaattaattcttcatttaaaccaactaaagagccttctgaaacatcatataagaataaatcaaaatcaagaatattttctttttcaacatttaaagtttctgctaaaagattcattaagtaattatctttttctaatttttcattacataatgctaataaaggtaaaacgtctttttgtttattaaactcataaccttcgttaacacttctattcatgtgtattgctaaattaggtattattaaaactggtttatttatatctacaagtctagtttctggcttaaatacattatcactctttaaagtagctctaccagcaatagataatggtctatcaaaccatgtgcttaatataggaccaccataaacttcagtatttaactttacataattattttcaactgtcatttcagcacttggcttaattctaaatcctggagaatcagtatgggcccctattaatctaaatccatcttcctcaatttctccacatccaatttcaaaagcaattatagctgaatcatttttcattatataatgcttatcaccatgctttaaattccagcagttactttcttttaattctgtaaaaccattcttgtctaatatatcttttacttcatatgcaccttgaaatgccgttttacttttattgataaaatctaataattgttttgtattactcatatttttctccttcttgctattagcttattttatttaataagacagttatcatattaataaaaactgtccataaaaatcttaaaatatatttgtaatatacaagatttaaataaaagtgccctagctcccctaaatatgcttatgctttttatgtttacgtttaatatggtaatatatacttcactattaatactaatacatatttagtctattttgcaataaatttattaaattatatgaaatagattcaagctatttatgtttaacatatattgttctcttgtaaattaatttcaaaattaaaattaaaagtatgcacctatatatggttaatttataataaaaatctactcaataaattgtataaaaaatagtttggtacacatctatatattattaatttatactgataacctttttaaagataattgttggtaaacaacgctcttttaaatattttaataatcttcaacatgatttgtccttaaaacttcaacagatgtataagatccattttttaaaagctcaaaaaagatactcatataatcaaaaactttttctgaatcaattaatgaataaaaattataataatggtttatatattttgtagcaattcccttatatctactcaaccatgcagttaaataagctatgatatttttctttttatcttcttttattttatcttctattctatttcctataatttttaatccatatttcttttttgtctcatttgaaagttttttattatattgtagcaaattattctttaattttttgtttgtgaaataatccgtacgcatataacaatctttagctgcaattttcaacacattattattaaaattatttactattgtttcaccattttctgttcttcttattaatggcattttcccactttcttctgctatcagcacacttacgcttctaggtacaagtccatacattttatcaaatttattttttactttatcagcatatgtataatttttatttctgcttcctttataacatttttctgtatagtaagtatctacatcaacaacctcatcaaatttttctggtttatagttattttcaatggcatgaaatattttatgtctccagtgaaacgccgttactatagatattcccaatttatatgaacactcatttaatgttgtgtgttcacccataagctcaataaactcaaaccatttctcaggtttatgttttaagtacttccatacagaatttgttgtatttgaaaatgtttttttgcactcttcatttttacatttataacgctgaattctattataatttccatattttataaaacttttgcttccacagtaaggacattctttatattttttaacatttcccttattataaatattttctctaagtgcattttctttatatttttttatcttctcaaactcccaatctctttctatcatagataacaactcctttaatacacatttatttaaattcacctaaacttaagtttgtttaaataaatgtcaatccattaaataggcttaacaattgaattagctaatataaattatattagctaaaatcacttatctatgattattgacactttcttatatttatagtcttaccaacatttatttttaaaaaggttttacctattatttaacataacaaccccaacctcttatttacatataccctatttatagtctatatataaaataattcctaaaatcagttcttattttatataatacatctaaaattcataaaaaataaaaaattgtgctactattaatataaaacatgtaacatagtcattaatccaattaatttaattcatccagcagtttaactatagattttcttaaaactggatgaattttatatggacatatttccgaaagaggcttaagtacaaattccctttcttccattcttggatgtggaagtattatttcttcatcatcacttattaaatcatcgtaaaatacaacatcaagatctattattcttggtccccattttataattctttctctcttcatttcactttcaatgtttaataatgctcttacaagttccttaggtgaaaatgttgtttttattttaattgctccatttaaaaattcttcttgatcagtatatccccaaggttctgtaactaaaaattcagaaactttttcaacttttatttcatttaataatgataatctttcaattgcatcttttaagttgctttgcttatctccaatattacttcctattgataaataagcttcatgccatcctctttcaatttcaatacctgcatagtcaagatgtcttccaatcggcgcccaaggtttctttaatgttacttttgtactatgtaccatatcataattatataatatgtactctgctaccttttgagctgctgtttctattaaatcatatgattccttcgtgaaaatctcttcaattctatgacatagttccccataatgaactgatttagttaagtcacctgttactcctgcttcttttgtatcaagagacagttctatatctaatatgaacttttgcccaagagtcttttcttcctgaaaaactccatgttttgcaaaaatctcaacattctttaaaaatattttatccatgagatactcctttttatataatttactcattttgtttattagtttataatacttttcctaaacacttaaaatcttatctgtcataatgcatgctcttttgttttcaagtacatcatgaactctaataaattcacagcctgacataattcccatcactgtagtaacaagtgtaccttctactctttgatctacaggtaaatttaaagtatttcctatcattgattttcttgatgttccaagtaaaacaggataacccatatctcttatctcttttacatttttcattacaattaagttttcttcatatgtttttgcaaatcctatacctggatctaatattatattttctttcttaacacctgcatccatggcaatttttatagattctattaaatcatttttaacatcttccattaaattttcatatggcttatcttctctattatgcataagaatacatggtacatcatatttagctgcaacagaagccatactcttgtcctttttaaatccccatacatcatttataatatcagcacctgctttaattgctgcttctgcagtctttgccttatatgtatcaattgaaacagtaatatcaaacttctcttttatagccttaattactggcactactctatttatttcatcatcaacttctactactgtaaagttaggtcttgttgattctcctccaacatctattatatctgcaccctggcttatcatttcctcaactctttttaatgctatttcaacttcattaaacttacctccatctgaaaatgaatcaggtgtagcatttaatattcccataacataagttctttcccctagtttaaattccttattacctattttcatgaataatcaccattcctttgtgtaaccttttaacatttacttgtctatttaataatactatttataatattcatttctattttaacactattttatatcatgtctattaatactttatttccatattctttttctctatactccagtagcattccttttctgccttgcaatcaaaacaattccttgataatttatcacttttgtatattatgtttaaaaatttattttctgcatctttgttaccatgattagcaatagcatttaaaattaaatttatctcatcagtgctatatgatgtttcttttaatattttttctgatatcatcacacctgcctcatcatggtttatgttgtttttatactcttgtgctcttcctatatcatgaagcagacctattgcataaataacttctttggaataagatagtccttcttctaatacaagtatgtatgctattcttgccatatctaaaaaatgatttatattatgcctacagaacactctatcttgttccataacttctatctctttaatacatttcttatatattgtattatttagtatctcattaacttttttcaacgactatacccccaatttttttcttatgaattattatatataagttctcataatgaatctacatattaactttaataaatgtctaaacaattagaattttaattatacattatataatatttacaataaaaaacaagttaaagacataatgcattaatactcttttaattttataatcttattcttgagtcatcttatagctttaatgtatgtatctataagccttttaattttataacgtatagtatttactaaatacatttatatattaaaaatgctacagaatgtaaaagctcaattctgtagcattaaaattataatatattaaattatttcatgttctctgaatctatattaaatttctagcttttaattctttctttaaaacttcaagattacattcttccattgaaaataatggcattctaagatgtcctacattatatcccataagacctaatgctgtttttactggaataggatttacttctataaataaagcatttataagatttaagtattctaactgaatctttgcactttcttccgccttaccgtcaaaaaataactgacatatctcatgggcttcttttggtgccacatttgaaagaactgaaattacgccctttccaccaagtgataatattggtgaaatctgatcatcatttccagagtaaatattaagttcatcaccacataatgctcttatctctgcaacctgtgataaatttccacttgcttcttttactgctacaatatttttatgctttgataattctaaacaagtctttggagttatatttacacctgttcttgatggcacattatataaaattataggtatattaactctgtctgctatgtagttataatgtttaactaatcctaattgagttgttttattataatatggagtgacaattaataatccatcaactcctactttttcagcatattgagataattccaaagcatataaagtatcatttgatcctgtccctgcaattaccggaattcttttatttacataatctactgtaaacttaataacttctttatgttcttcatcactcattgtagatgattcccctgttgttccagcgattacaatagcatctgttccattttctatattaaagtctataagtcttttaagttcctcaaaattaattccttcttcattaaatggtgtaacaatagctactgctgcccctgtaaaaatcactttcttcatcaatataatcctccttaatattttgcattcagccccaatatttttgtccaaaatattatactttgaattgacatcatattcctattaattttacaataaatagtgttatataacatatttctattatttcttatatgaatgctaattcattctttctttgattataattatatcacattaaatgaatactatgaattagaatatatttttatcaaataaataatactattaaggaaataattgcaataagttaatttaaaaaatttataatatatgtttcaattgacaatagacaatttaagatggacaattaatcttataaattaaataaatcttgtaagatttttactttcattgtcaattacttaaaatgagtattcgtaagaagcctcaaatatcagttgacaattagagcatatatatttatttaaacttacaaaggagaggtatattatgttatcccaatttttagtaaataaatttataaaagatcatgataatattcatgatataaaagttcgtaattcttatggatttttaggcggaattattggtatcttagtaaatcttgttttattcacaatcaaactttctgttggattaataacttcaagtatatctataactgctgatgcatttaacaatttatctgatgcagcatcttcaattataacaatacttggatttaaactttcaagcatgcctgcagataaagagcatccatttggtcacggaagaattgaatatatttctgcattaatagtagcattcatggttatgcttgtaggtgttcaatttatcaaatcctcatttcagaaaataataaatcctgatattgttgtatttgaattaataccttttatcttacttttagtttccattcttcttaaagtatggctttcaagattcaataaacacataggaaatactattaattcctctgcattaaaggcagcttctgttgatgctttaggagatgtatttacttcaagctgcgttgctatatcatttttagctgcaaagttcacatcaattccgattgatggatacatgggtatgggagttgcattatttatagtttattctggatttaatcttataaaagaaaccttaaatccacttcttggagaagcacctgaccctgaacttgtaaatgctataaatgaaaaggtaatgtcttatgacaacatcttaggaactcatgatcttataattcataattatggtcctggaagatgtatgtgctcaattcatgctgaaataccaagtgatataagtcttgtaaaaatacatgagattatagataaagctgaaagagacatttcaaatgaacttaatatttatcttgttatacatatagatcctatctgtataatcgaaggtgaagttaaagaaatttatgattatattaaagattatttaaacaattttgaatatgttgattctattcatgatttcagagttattggtgaaggtgaatataaaaatataatttttgatgtggttatagatacatcaaagaaaatctcactaagtgatggtgaaatcaagagtaatataaatgatcatgtccaaaaagtacatcctgattatagaacattgattactgttgataaacattatacttaatagtattagtaacaaaaaagtcggctaattagccgactttttaatatatatttttaatattttctaccataaaggagacattctatcctctggatttacatatatcttatcatctgaacttattccataagtatcatagaacttttgaaattgagataaaacaacattaaccctttccttatctggtgaatgttcatcatctactaacgcttgttcgtatgattctttggtctttatgctcttataagcctttgcatatgattcaaaaaataatttatagtcagcatcttttgtattttttaataattctaaaatacatgacattccttgtatatccgccatattttcacacaaagtaagttcaccatcgatatatttcccaggtaatgcttcaatttcgctataataattcattatatacaatgctttttctttatatttattaaaatcctctttcgtccatatatctttaacatttccttctccatcaaaaaatgctcctaaaatatctaatgaatgacctatttcatgagcaataactatgcctattccagcaagtttttcctctattgaatcattgatatcatataattcaggctgaataattcccggagttataacaactgtattatttaatgtatgatattctgccactacatcctgtggtattatctgatcaataatttcatttttatttattggagtatttaaagtctttatctgattatctcttgctgttaatgcaatatttatcatattttctaataagcttccaccgtgtgaatacaattttatttctgcatttgaataatcctgattactgtttgaatatcctatatttatcttcatcttattcaacttgtccatcaagttttctctagtaacatcacttatccagctacagctctttatcttctccttatatacattcataacctgatcagctatgttctgaacatcagccttctccacttcattaaaagtcttttgtgtatataactttccaagtgatattggaaaaacgctgcttatcttactgtatgcctcactttgtattgatacatctgaaaatttcacacctaaaatattttctataaaattataatacagtttgtccatgtcttctgaaagatatcttcctgatgatcttattacattcaactttatataatttttaatcaattgtagattttcctgtatccataattcatttaatttttttaaccagttaacttcacttacttcaatataatttgcattatcaatttttagggatttcatcatacttgataattttatatttggtgcttctctatcaagatcctctatcttcattaaaatattatactgacttttatcaatctgactttcatcagtatcataacttaaaattgaccctgcaatagagttttcaaatttaaacaaatcatcaatcatcttttttgaatctacttcactatatccacatttactcaaaagactcatataaaaatccctgacttttgaataatattcataatctccatttgatccatactttccggaatcaactaaacttaattcagtgggatctatagctatttcatatgctgaaccattgtaattctcttttatattaaaatctataatattagttagtatatcaatctcactgtcacccaataattgagttaagtcatccatcgtattaacagaatcaattttcgaaagatacttttccataggttctattccttgtgaatttcttgcctctctattaatataattttcatatacatctgccatctttctttcatcactgttttctccatatttatttttgttatggagaaaattctcaaattctgactttactatcttatcattattttcttttatatcactgtaagtactcttttcaccataaagatcattaatattgttttcctcatttttcttccactctccattaacagcttcataaaaatcatcctgagctcttacattacttatgttaacagtctttaaatcataagttcccgttctttctgctgcatatccttttgatagtggcgtaatcattgaaattataactgctgctcctgctaccaggctaacaatccgtctattcttcttcatattttacctcacttgctttttatttagtatatataacaactgatattttacaataaacaattgtgctaaattccttatattctataaagttttattcttagaatatatctagctttatttatactcatatataattatacctaaaatatgtataaatagggatatttactctgaagtttattattcttcacctttcctaatcaattaattaaattttcaaaaatgccacaatactaaaaactacatcatacaaatatacttcttgaaaccttgaataataccaaagtttaattggtttaatgattaataatatatcaggaacaaatttggattttaaatcaaaaaaagtacccaaaatattaattctggatacttcttatagtataattttaaagtactttagataaaaaatctattgtacgaggattcttaggattttggaaaatttcttctggagttcctgactctaaaacttttcctccatccataaatattattctatctccaacttcccttgcaaatcccatttcatgagttacaacaaccattgtcattccttcttttgctaggtccttcataacatttagaacttctccaaccatttcaggatctaatgctgaagtcggctcatcaaaaagcataacatctggctccatagcaagtgctcttgctatggctattctctgtttctgtcctcctgaaagtgatgcagggtaagcatctatcttatcttcaagcccaaccttttttaataattctattgcttttttctttgcttcatctttagataattttctaaccttcattggcgctaaacagatattttcacatactgttttgtgtggaaacaaattgaactgctgaaataccatccccattttttctctcatcttatcaatatttgtttcctttgaagttatatcttttccttcaaatgtgattttcccatctgtaggtgtttcaagaagattaaggcatcttaaaaatgtactctttccagaacctgatggtcctattacaactacaacttcaccttttgcaatatgctcatctattccctttaaaacttcattttttccaaaactcttataaagattattaacgtatatcacttgccttcatcctcctttcaacatagcccagtactcttgttaatgtaaatgtaattataaagtaaattatagctgcaacaactactggttcaagtcctaacgctgtatttcctcttacaattcctgcattgtacataagctctgctacacctataactgataccattgaagattcctttattactgaaataaattcatttcctaatgctggtaatatatttttaaacgcctgtggtattactacttcaaacatagcctgcttttgattcataccaagacttcttgcagcttccatctgccccttgtccactgcttcgatacctgctcttattatttctgatacatatgctgatgaatttaatgataatgcaattatccctgttgccatatcaggtaaatcaattcctattaatttaggtaatcctatgtatattatgtatatttgaactaatagtggtgtacccctcataaattcaacatacgctgttcctataaaacttattgctttaaactttgatcttcttattaatgtaattccaaggcctaagattgtaccaaatagcactgcaaaaaaagctagcactatagttatttctgcacctttaacaaaatatccaaaatacttttctaaaaacgtaaaattcaaaatccctacatcctttcttataagttgatagttgatgccactcttttctgtctgtactcttttagagtaattgaaagttgatagcagtggataaaaagactaattttctaaaaagtgattcttagaaacagcttattctgcttcatccccaccatcagctttccacattaactgtcaacttgataagattaaaattcattggaattccaatttttaattaactcatctcagtcgttattaaatcatcaactttccttatatcaacaatcaactattgatttttattgttcagctgctaaatcatttgcatcagaaacaaattttgttattttatcttcagattttaatttatttatagtattgttaacttctgtttgtaattcagtagatcctttctttaaagctattgctgatccaccatcttcatctgttactacaaagtcagacatagcaattccttcattcttgtcacagttaatttttgcaactccatcttcaattaaaatagcatctactttgttgttttttaagtctaacactaaatcagtaactttagctaaagatttaatatttgctgcatcaaagttatcttttgcaataccttcttgaatagatcccttttgaacaccaatctttttatcttttaaatcatcaaatgatttaactgaaccttcttcaccacttcttaaaataaaacgatgagttgctgtatagtatatatctgagaagtcagcattttgctttctttcttctgtaggagtcattcctgcaaataccatatcaactttatcaccttgaagtgctactagaagcccatcaaaatccatatctttaatttcaagttttacccctaaatcatctgctactgcctgtgcaatatcaatatcaaaacctttgatttcatcttttccatcaactgttgcatggaattcataaggtggataatatgcacttgttccaactacaagtttaccactttccttaatcttatctaacgctgttttattttcatcacctgatgatccacatcccaccatacttattgctaatactgctactgcagctacagctgctattttttttactaatgcacttttcatatattgtacccccttaagataattgttttctcttttctttagtataattatacatacatttttataattattcaatatatattttaattttttataaataaatattaaaattatggttataactattcttaatcttcggatttattttgtaatactatgctacaattaatattttttaacaaaaaaatgaaaaagtaatgatcaaaatagttttaaatcccctttttcatgttatttttctctatattttaaaacttatatatatttatatgtaatttatcaattattatacctaactgtaataaaatcagatttatgcatatttacaacaaaaaatatgcataaaatatgaaaatccatattttatgcatattaaatcattatcaaaaaataataaatcaatccaccttgctattttccattatacttagtcataataatttctaataaatgaatattatgaattctagttacttgtataatgaaaaatattttcctcatactttaatttattatttctttcatattcttaattaaaactatatttatatatttttaattactgaaagtctgtgaagtgctcttgtgcacattatatatttcactaatggctgaacattattattttcaactattattacagcatcaaattccaatccttttgcaagatatgcaggtatgattacttttccacctttataaagaatatcttcattatcaaggttttgtattcctattctttgttttaaaattggtgcatattcttctaagtcatgtgtattgctaaatattactgcaatattttcatatccatcttcttcgtaatcctcaataatcgaaagcatagtttctatacaatcttctgcattttctgtttcttcttcaaagacagcttcaccttttctaactaaaggtacaatacggtcttcctttaagaatctatttgcatactccattatttcctgtgtagatctatagctcttatttaaatcatacttctttatttcagtcttcatatcaccaaaaacttcatctaaatgaagcattgcaggttcatcatcagttgttataagcctctgatttgaatctcctactattgtatagctgctacactttgttacttcctttattatttcaaactgcatataactataatcctgtgcttcatcaattactatatgcttaatgtcatccttaatttttaatccttcaagtttaaccattaaataaagtataccgcttaaatccatgtatccaagctcaatatggttcttgtttgaggattctattatagcttcagcatcaaaagcagagtcaggtttgtttatactttctccacttattattctcttgtaaatatctattataggttcaatcttaagccagttatcaagagtttttctagaattaataacttctcttacaatttctcttatttttattcttcttagaaactctaagttgttcttttctatatcagcttcatcttgtgaaagattcttagctttctcttttatttcttcattaagtttataaacagcttcatctcttttatccttaatcttagatgtaaggattcttcttaccttttcacttcttctaaataaaggcatatccttataataattattaaataaatcttctacttcattaacagaaactatttcctcattgttgaagatgacaggctgaattttaaaataatcttcatttaattctttaattttagaatcaagtacttctacaaacttcttagaactcttatatttatattcttctaaagcctcatgattatcattcattgcatcttcaatatattttccaaaactctttatgttttcattttctaaattaagttctctttttgcaaagttttcaaaagtagtctgcttaatgcctccactttcacctagtgttggaagtacttgagctatataatccataaatatatcatttggtccaaagataagaaccttatcaccaaattgttttctaaaattataaagaagatacgatactctatgtaatgcaattgttgttttaccagaaccagctacaccatttactactacaattttatttctttcttctcttattatttcatcttgttccttttgaattgtcataacaatatctttaagcttttctgatgaattacttgttaaaaccatttgaagtatttcatccttaacatcaagggctgaatcaaatacaccttttaactcacctttttttattataagctgctttcttgataaaatatcagctttaatttctcctgaaggtggattatagcttgatggtccaactgatcctttatagaatagtgaagcaataggagctctccagtcaactattaaaggctcatatgcatcttctaaagttaatccatatcttccaacataaatatcctcaggaaggctgtcttcttctttaaaagtaacttttccaaagtaaggtgattctttaagtttagtaaattccataagtcttttatctatagtcttataagattcttctgtaacataattttcatggtcaaagtaatctataacctgatcttcatcatccttatactcctcaatatacttctttctcgcttcaagcatttgatttgtcactaattttcttcgttctaaatattttaaaacttcttcatttaatatttcctttatttcatttaacttgttttcttccattaaaaaatctatctgtctgctcatgcttacaactcctttttgttttgtttaatgccctgctgctgtaatcaagcctaaaaatccatatttattaaggcaagaatgacttaatctttcgattaagccatttcttatctcaatattttaatgtattaaactctctaaatactctaagtctaagtatatatacttagacttaggctcagacttaaaattcaaaaaatcctataaggattttcaccttaattgtgaattatcaactgtaaatcaactaatactattgtttagtatcatcatctttaacatcttctattactttattatcttcatgacttgaagctgattcttctgattcttctgattcttctgattctgatattactgagtcagtattttctattattggctttacttcctgattttcaaaacctgcagataaattaatagttttattaacttcttcttcaattggtttatctaaagcatgccttctagctcttctttcttcaacttctttaagtcttttttctttttctatcttttctttttcagcttcttctttcttttcaggatatacttcataaattaaatccatgaattcatcaccaaaaatattttctttttctataagaacagctgaaattttatctaacagttctctgttttctcttaaaatctttcttgactcagcatgagcttcttttattatttttaatacttcattatctaaaactgtagatgtctgctcactacagtttctaacagctcttccatcaagatatctattttgaactgactctaatgccatcatatcaaattgctcactcataccatacatagaaatcatagctcttgctagttgagttgctctttcaatatcgtttgaagcaccacttgttactaaatcaaacttttcttcttctgctgatcttccaccaagaagaatttttatttcattcatcatttcatctttagtctttaagaatttttcttcttcatcttctatctgcattgtatatccaagtgaacctgtcattcttggaactattgtaatcttatggactggctttgtgtttttcagcatagctgaaacaagcgcatgacctacttcatgatatgatactatttctctttctttttctgaaagaatagcatctttcttttctttacctgctattataacctcaacagcttctcttaaatcttcctgaagaacaacttttcttcttcttcttactgctctaagagctgcttcattaattacatttgcaagatcagcaccaactgcacctgcagtacttctagctatttcttctaaatctacatcatcacctaagataatgttctttgcatgaactttaagtatagcttctctacctttgaattcaggtctatctactataactcttctatcaaatctacctggtctaagaagtgctttatcaagtacttctggtctattagttgcaccaagtaaaacaacacccttagatgaatcgaacccatccatttcagataataactgatttaatgtttgttctctttcatcattactctgcatttgattgtctctgctcttaccaatagcatcaatttcatcaataaatactatacaaggagcttttgcaactgcatctttaaataattctcttactcttgatgcaccaacacctacaaacatttcaacaaaacttgaacctgataaagagaagaacggaacttttgcttcaccagcaacagcttttgcaataagagttttacctgttcctggaggtcctacaagaagaacacctttaggaagcttagcacctatttctgtatactttgctggacagtttaagaaatctattacttcttttaaagattctttagcttcttcctgacctgcaacatcatcaaaagtgacttttatttcactttccatataaactttagcattatttttaccaatactcatgacgccgccaccgccgccacctattttagaaaaaaggaatttccacataaagaagaaaaatccaataggaagtatccaactcataagaatatttaaaaatggactttcagtaggattcttacctgtgaaatctacctgtgctgcttgaagtttatcaattagtgtatcatcggtaatatgagctgtatataaagtttttcctttatattcttcattatcttcacttggtgttattaataaattatcactagttataacgactttagaaatttccttattatcaagcatttctatgaatttattatatgtaatttctttcgtcgtgctcttatctttagcaacattaaacgccattacaaatgcaaatgcaatgataaagtaagtgataactacggtatatgacttatttttatttttcttgccattatttttatgattattatcctgcatttaatcaccattcccttccactgtaagttactgccacatatttttaagcatgtgatctatttcttcttttcgctttttagttaaatcactatcaaccttaaagaattcatcttcctttataagaatatctccttctttaaaatcccctttaattaagttttctggtatattaaccattgtttcatcctcagtttcagctacaacaaaaccgctttcaattctgtcaataataaaactttcactcatactttaatttaaccccttttttaattaataaatttactctatatccatttaaggcattataaaaaaataacaagtcaatctgtctgactattttcttttatgcgcctaaatgattaaatttattaatattataattatcatctatctttgctgtatatgcaagcaaaatctaaatttaatccatacttccaaagtctttaagtggataatacttcaaaatagcttttccttttatgtcagcttgatctacataaggatttatccatcttctagagtctttagaaactggtctattatctcctaaaaagaagtattttccttctggaacatcataaataagttcatcgtcactaaaatcattatttttgacataatcctcttgtagatcttctccatttacattaacaattccatcttttattataatatgatctcccggaagtcctataaccctttttataagtgtttcctgaagttcattggaataaaaaacaagtatatctcctctttttagattatcctttgtgtatactctatttaccataagtctatcaccaacatttatagtaggtaccatagatgtactaggtatataaacattaaatattaaaaacctgtttattaataacgcaattccaagagcggcaataacaggtattatccactctgtgaaaaacttatatttatttttgttattagatttattttttatttgatctttcataacactctcccaaagacataccctttatctaagtctatattatataaggttatttttattttaaacttcatataaataatattgtccaaaataaataataataaactctatcttacaagtccaaaatcactaattgggtaatatctcaactgtgcttttccttgaacatcatcttcatcgatataaggattttcccaatatcttgcatcataagaaacagctctattatcccctaaaaataataattttccttctggaacatcaaatatcccattataactttcattatttttaacataactttcatcgatttgttcaccatttactttaactaagccatctgttatttcaacatgatcacctggaagtcctataactctctttattacagtttcattaagttcttctgatttaaatacaattatatctcctcgttttatgctgtctttattccatattcttgtaactataagtttatcatttatatttaatgtaggaatcattgatccacttggtatataaacattaataaatacaaacttattgattgcaacagcaatagcgattgcacaaaatataggaattatccaatccttaaagaaatttcctttcttttcttttgattcaccatcattttctatttccttgttttcaattatatcattttctttcatagacaatttcgtcctttcatgttttttcaaaatattgatatatatatgttgaactattaacgttataattataaattagaaatcaaatactgttttcaacatggattgttaatttaaatatatattctaatttattattgtcaatcatgatttaaatattttcaagacttcttattttacaaatccaaaatcttttacgggatagtatctaatctctgcctttgcctctatctcatccttattaatataaggatacttccaatatctagcatcatcagattctgctctgttgtctcctagaaagaaatactcattttcaggaacttcaaaattaccatcatatttatcattatttttaacataatcttcttgaagttgttctccatttctaaaaacagtacctttaacaatttcaattttatctccaggttttcctattagtctttttataagggtcttatttttatattcatcatttttaaaaagaacaatatcaccgtagtttagattatctacattgtatactcgtgaaacaattaatctgtctttaactgcaagtgtaggaaccattgaaccacttgtaatccaaactccatatcctacaaagcgccatactactaatgcaacaacagcaataattgaaatatctattacacattcttttaaaaatgatcttttattttttttactgttgggattttgaccttgtataatttcttttgctctaatttcactcacaactatccctccccatatattaccattttatattttataaaaatcagatttttcttcaatacataaacatcttaatatgtatattgaactatgaactttacaattgtaatttagaaattacatagtgatttccaaattaattgtcaattattcatagggagtacccacaaagggcatcacatatcaattaaattgaataatatcccactttaaaatacactaaatagtataccataatttataatataaaatatttataacttattaatttttaactcttagtcattataaatttctatatgaaaaagatatgcactaactaaaatagttagtgcatatcagtctttatatatttataatcttgggaaagaatattaataaaaagcgtagttaaaaaatataatcaagtaagtaaattaatcgtatttacttttcatttatagtatattcaaatttaaaattttaattctaaatttttataaaacatcatttctgattatatcttcgtaggattctcttttacaaacgagtctagcctgtccatctcttatcattacaactgctggttttggtattctattatagttgcttgacattgaatagccatatgctccagttgttaaaattgcaagtatatctccacttgtaacttctggaagttcaacattttctaataaaatatcacctgattcacaacattttcctgcgatcgtaacagtttgtccacattcgctattaactctatttgctataacacattcataggctgcattataaagggctggtcttatgttatcagtcattcccccatcaactgctacgtaagttcttacgcctggaatttctttaacactgcctactgtgtaaagggtactaccagcattggctacaatgcttcttcctggttcaattgtaagaataggtctttcctgaccagttcttctacaaacttcatcaactttgttaattattgtttcacaatattctctagttgttctaggtttgtcccctttattatagtatataccaaaaccaccaccaaaatctacttcttttataaaatatccgtgattttcttgtattttttttactaagtcaagcataacttcaacggcatcttcatatggctgtaattcaaagatctgagaacctatgtgacaatggataccagcaaggtttatattttcaagatttattgccttttcaaccgcatcctctattacagttcctactggtgcaaaaccaaacttagaatcaatttgaccagttttaatataatcatgtgtatgtgcttctatacctggagttattcttaaatatatattttgagtttttccatatgactttgcaatatcatttaagacttccatttcataatgattatctacaacaaaatttcctactccaagcttaactccaagttcgatttcatctaatgttttattatttccatggaacattactctttcaagtggaaatcctgctttatacgcagtatataactctcctcctgaaacaacatctagtgacatattttcttcttttaaaagcttacacatttgaactgtaagaaaagcctttcctgcaaaagcaactctgttattattttcttcacatctaaaataatttctataatctctacagtattcccttattaattcttcatcaaaaacatatagaggacttccatattcttttactaaatcgctagccttagcccctccaattgttaattggttatcttcaaccttcatcgtaccaaataatttcatttttgttacccccaaaactttatttaattaacagctatcagttataatcttcaactgtttactgctacttgttaacttgttattgcttattaatatttgttaattaataattacacaattcagttatcttaaatttgattatgaataattataattaaacctttttaaactaaaatattatatatgttccaattaacaattgacattaaaaaatatacaatactagctgaaaaaaaacgtcacagataatttctgtgacgagtgatagcgctagtgctgatttatgttcattgatgcacaacaatttttcagcatcctatccatctactatttattaagtcttaatgtatgtaaatcatcatcaattcctattaataataagctgcatattttgctaattaaaagatatgccttgtagctcaacactttcgtgacagttatccacatattttatgaatacccagaaataagctttggtttaacttattccttcggccgtaatacctttcaatataagtcatagtctaccagactcattatatttactatttatcacagcacctctacctcaggtcatgttatattaccattttattcaactattaaaattatgataccatattttaaagttaattcaatactttttatttgtaaaatattataaattttacctctttctatattcatccatcaattcgcccattatacttgcagaagtaggtggcgtaaatgttattgcatttgctcctgcttctatagtttcttttatagtttcctcacatggaccacctgttgctattacaggaaaatctggatacattttttttatgtttctaacaattttagctgtattttttccaccagatacatttattatagttgcaccactttctatcctctttgagatatcttcatcttctgcaattacggttactataactggtatatctattgtttctcttatatgctttattatttcattgcttgttggtgcgttgactacaacacccattgctcctttaaattcagcatcaagagctaaattaacgactctcttgccttgggtaatcccccaccgactccacaaaatacaggaatatcagctgccataactaacgcctgagttattaatggctgaggggtaaatggatatactgcaattacagcgtctgcatttgtattcttaattattgcaacatcagtactaaatagtaacgattttattctcttaccaaaaatcttaattccactacattctctaattacttttggaacttctacgacatgttttcttaatgttcctttaatctcaggtatatttttaccttgcttttgattactcatgcaagctccctccaattccacaataatatattcttacacaaagtctaataatattatactactttatattttacaattgcactaattattagtgcaacttatccacattatccacaggttttatccacatttttgttaatttattcataaaatcaaatttttaattcagacttttatgttatacctaaacttattctataaaaatataactcgtccaatagtgtgtaaccgttgtatgttacagataattatagatattagctataaaataaacttacaattctatttatataatatacatttaatatttgcaattatttttttcaccgaattacaattatatttttaatctctatatctatgtcataaaaaatttatactttttttagtaataatcatcttatttttcatagttatccacagataagttaattatatacacactaataacacccctaacccccttgttttatcacattccttaaatgtcccataaaagttattaacatttttatccacaattatatttttgtggatttgtacacttgttaattttttcttaacaaagcctaaattttattattaaagaccttaataaatactgaaaatgatataacttctattgttatatagaatctcttagaatatactagaaacgaagataatggtaatttttttaatttacttatatatctttcaataaacactatcaagatatggaggtttaaaaaatgactcgaaatgagttttttaacattctaatggatgaccttaaagaattgcctgaattagatttacaaaagatagtttcattttataaaaataaaatttccatagaagtttcaaaaggaaaaaatgaatctgaaataataaaagattttggtgatccgtatttaatatgtaaaaaatatataaactcttcttcatattctgaaattattgaagaagatcataaaactttatcttctactaatattaacaaaaaccaatcaaataatgaccatattgatgaactttctcaaataaaacgaactgattacatcaacccagttaatgtagcaagtaatgatgaaagtaatcgtaaaaataaagatcaaaatcgtaattataattttaataatgatcaaaatgccaatagatatcatactaaatcttcacctaaagttgataaatttttaaagttatgcattataatccttggtattatagttttttgtcctattcttacaagtatagctggaataattattggaatactaggcgttgccttaagtcttttagctggtagtattggtattttaataggaggaacttttacaaatcttataggatttcctcatatacctcagtttattactgatttcccctatccagcaatagtattgtttactattggatctgtatgtttatctgtatttcttatttgcacattttattattcatgcaaatttttctttagactatgcaaaaagctgcttgacttcttaaagtctaaaggaggtatctttaatgaataagaaattaatctctactaaaatgaaaatttttcttttagttatgtttattttatctattatattttacgcttcaggatgtattattcttattcagagcaattacaatctatcagattattcagatgaatttaatatacacccaagttcactaagatataatctagattttactaataactttttgaatttcactaattcatactcttctcatgactatgatatagataatagtatatctgaattagattttaatcttaattctcagaacattgaagttatcaataataacaatagtatgttaaatataaaaattaaaagtttttcttcatcaaatgctgaactaaatttagtaaacagtaataataagatgacattttctccaactgtagatattcctaacagtgctgatatcatagtaagtatgccctcatacttatcatcaaaagtaacattaaaaatcactacaagtagcggggatataactataaacaatttatccacaaatactttaaatgcatcaagtgcaagtggtgatataaatttaagcagcactaatttaaactatctatatctatcaagttcaagtggtgatatgaatataagttcttcaactactagtaatgaaacaaatttaacctcattatcaggatcaattaatggaaatggaaattttggagcgcttactggaagtacatcatcaggagatataaaacttacttttaaagataatttgaataatacttttttaagtagtatgtctggagatgttaatttgcatattccatccttctgtggatatgaagcaaatttcaatacaatttctggttctttaaataattctgaaaacaatatgactaatggtgataaatctagcaaaattaatgtaaatactacaagtggagattttgatcttcaagtaaaataaaaatttcctctctacacttaatataaatttataatttttctccatatattaaaattaataaaaatgctgatgagtactatataatcatcagcatttttattctttaattggaaactcatatttttattaaccactaaaacaattattctataacaaacttatcaatcatattattaagtttctctgcgtctttcacacccttgtccacagagtatagtgcaagtttcatagctgaagttgcattatttacacgatccttaatattatgtgtattctttactgtttcttctgaatttttagctgtatcagaaatggctatgcttacctgctcaattgatgatgctacagcctctgacatctttgataactcatctgacattttgcttataaattccccatcattattatatgtttcaccaatcttaccatattgattcaaatcttcttttacatcagttttaataaattttaaaatttcactactgttattggaaagatttttaaatgctgcttcaactctttcaattgtactttgaatagttccaactgattctgaagattcttctgcaagttgtcttacttcttctgcaacaactgcaaatccctttccagattctcctgctcttgctgcttcaatagctgcatttaacgctagaagattagtctgttcagctatacctgctattgcttctgccataaccttaatttcttcaactacttttgattcttcaattgctttatttatatatctttctctttcatgatatacatctcttgtattattaatagctaatttactatttttaagtattgattcagctctttcttttatttccatagaattagaagtgccagtttcagctctagctgataattcttgcatgtttgcagttatttcttcaattgaagcatatatttcttcaactgttccactattattttctgcatttttgtctattttctctatatattcttctgcactttcaagtgttgaacataattgatttattgtctctgaaaggtttgtgtttaatgtaagtacatttttagtattatctgagcatagctttattatttctcttaaattatgctgagccttgtttaaagaattggcaatagcaccatattcattatccatagttatgtctatatcttgagaaatatctaatatgctaattctatctgccaattgctttattttttctaaaggctttaacatactgcttatggtagagaatattaatcccccaccaattacaatcgctatagcaattgatattattgttactgtaacacttgtcttaaaccctattcctataattactccatttaatatcattatcatatagataagaaataaccttaccttaacagatttaaaaaagcttatttgtttattttcttccatgaatatgcctccctatttattactgtattgtatatattttttatccctatttatgattttaaagtattaattgtatttttttataaaattatacaactttttcattataagaataacattaataaatatttttttcaacttgggcatattattgcaatgttaattatctatctatatattttttatggttatagtatttatttattgtaaccataaaatctaaaacaaaaataattcctaagaataacagcataggatttattatatttccatacaacatatatgtactagtaattaatggatttaaatatactactccaatatagcttaaaatacaccaatatattgagaaaataagactaatatatccattaatattatgtttcaaatctgaataatcccagtatactttattaaataaatgcttaagtaaatatccacttatatattccacagtagttggaactatcaagcaaaagaatataaaaggtattccccttatttctaaaaattcataatatattattaatatggtaatagctattccatacataggtttcaatggttctttaagaaatccatcctttttaaatctgcctgtagaatactttgaatataattcttctattatccatccagcaaaagaataaattataaatgtaaaaaataaatacataattacattaccaccaatcacttaagataactttattatccctacataattagcaatttatccttacttcatattatgtaatttttaatatataagccacttttatgcatatgctaatttaatatttctacttttcaaaattataataattctaataaaaaggattataataagttaattattttacataattaatcaaaaaaatatccgcattttcacatgaattattaattgaattatttattaaatgctacttttttattaaagtctgatataattatttaataattgctaataaattactaaacattcaggaggcattatttatggaaaaattatattacgatgatccctatttaagagattttacagctgaaatagttaatattgaggaacaccttggaaaatttcgtgtaacattagataaaacagcattctttcctggtgggggtggccaaagctgtgatactggtatgattggtgaccacaaagttatagatgtttatgaagaaaatgatattgtttatcatatagttgaaaagaagcctataaaaatacataatgttaagtgtaaaatagattctgaaagaagaactgatggtatgtgccaacatctaggacagcacgtactttctggatgtttcttcaatcttttcaatgcaaacacatttgcaattcatttaggtgccgatataagtacagtagatatttatggtgttcttacagaagaacaaataagagctgccgaaagacttgctaataaggttattggagatgctttaaaagtagaatcttttattcctactaaatctgaattaaaaaaaataacattaagaagagctcttcctaatacaaaggaagacataagaatagttaaaattggtgatgattttgacattaatgcatgttgtggtcttcatccaaaaagtacacttgatcttagacttataaaaatcaaaaaatttgaaaagcataaagaaggaacaagaattgaattcctttctggaaatcgtgctatagaagattcttataaaaaagatgaattccaaaattcaatatgtaagtatcttaactgtaatgaaaatgaagctgtaaatggaattaaaaatttaaataacaatcttaaagaagctaatgaaataaataaatctttaaatataacacttgcaaattatcaagttaaagagcttattgataatgcagaaactgtaggtgaatttaaaataataaaaagtatatttgataatgaaaatttaaaatatataaataatcttacttcaaagcttgttgaaactccaaatacagttacattaatggctgtaaagtcagaatataaagttaatcttatctttgcatgtacaaaaggaattaaagaaataaaagtcaatgaagttctaaaagatgctatttcacttattgatggaaaaggtggcggaagtccttttatggctcaaggagctggtaagaacaatgcaaatcttgatggcgcacttgactatgcatttaataaaatcaaagaaatgattggataacaaaaatacattaattgttaattactaaattacaattaatgtattttaaataatacaacatatatattaaaagtggctacgcacactttttagttgataaataatagtggaaagttgacagtttccactatcaacttcctaaatgatctgttatttgatttcaactacatcataaccttcatcttctatagcatttcttaattgatcatcagtaacattattagcatttaccaatgcatactttccttctaagtttactactactgataacactccatcaattccgcttaaagcttcctttacgtgtgatacacaatgattacatgacattccttcaattaaaattttcttttccatattacattcctcctattttttaaattaatacttaatagttaatacaaactatctatacctctggattaaattttctaagtcttaatgcatttgtaagaactgaaactgaacttaaactcatagctgctgctgcaatcataggatttaaaagaggtcctccaaatatatgaagaattcccattgctacaggtataccaagaacattatatccaaatgcccagaataaattctgctttatatttttaattgttgctctgcttaattttatagcagtagtaacatccattaaatcacttttcattagaactatatcagcactttcaattgcaacatctgttccagaaccaatggcaattcctacatctgcttgagctaatgctggcgcatcatttattccatcaccaaccattgctacttttaaattatccttttgaagtttttttacttcatttgccttatcttctggaagtacttctgaaagtacaagatcaattccaacttgttttgcgatagcttctgctgttttcttattatctccagtaatcatggcaacctttattcccatattatgaagtgattctattgcctttttgctgcttggcttaacgatatctgcaacagctataatacctacaagattattattaatagctatatacattggtgttttacctttctcagcaagattatttccctgttcaaataaatcactattatttgattttgatatattttcaaatttaatctttttatcatccattaattttctatttccaagtaaaacttctttatcatctatttttacttctatcccatgaccaggaatagcattgaatttatctatatttttaaaattaagcttcttttcttctgcacattttacaattgcttcacctaatggatgctctgatcctttttctgcacttgcagcaataactaaaagttcatcttcagatattcctgagcttattatatctgttactattggttttccttctgttatagttccagtcttatcaaatacaattgtatttataagatgagctgtttctaaggcttctccacctttaattaatactccgttttcagcgcccttacctgttccaaccattattgctgtaggtgttgcaagacctaatgcacatggacacgctattactaaaaccgctataaatattgtaattgcaaataatggcgtttcacctgcaataagccatcctatagatgctatcacagcaagtattattactgttggaacaaaatatgatgatattacatctgccattttagctataggtgctttcgatccttgtgcttcttctacaagcttaactatttgagataatgctgtgtctttccctacctttgtagctctatacttaataaatcctgttttattaatacttgcaccaacaacactgcttcctatagtcttttcaacgggaatactttcacccgtaagcattgattcatctattgaagtgttaccttcaataacctcaccatcaactggaattttttcaccaggctttactattactatatcaccagaaataacttcttctataggaattgtcatttctttattatctcttataatagttgctgttttaggtgctaatcccataagtgcctttatagcttgagatgtctttccttttgagaccgattcaaggtattttcctaaagtaatcagtgtcaatattacagctactgattcaaagtataaatgcatagcatagtgagaatcaccagcttttattttatatataccgaatatcccataaataaatgctgcaagagtacttattgctattaaagaatccatattaggacttaatttaaataagttttttagtcctactttatagaatttataacctataatcattactggcaatgttaaaattatctgtataatggcaaaatttaacgagttattcataggatcaattatatttggaaggggcattccaatcatatgtcccatagttattattagaagtggaattgaaaaacatgcagaaactataaatcttataagaagtaatttactttcatctatttttgattttcccgaatctttttcttcctcttttattaatttatatcctgctttatcaactacttctttaatctttgcataaccaataatatcttcatcaatatttacagtaagattttctgttgcaaaatttacagatgagttttcaacaccatcaagtttttttgttactctctcaactctattagcacaagctgaacatgtcattccttcaatcttaaatgtataagttttaagattcttttttaccttatatccacatttaacaacagtattttctatatcatcacaagtaactttattttcatcaaaatccacatttaatgtttctactgcaaagttcacattagcttcatttattccatctaattttcttacaaatctttcgatcctgtttgcacaggctgaacatgtcatcccttctatgtttaatgattttttcattttaatttataccttccttatatttaatgaacattacttttaaaataaaacttattattttgaaagtaacttttctaatactttattgaattcttcaatcttttcttcaggattattattgaaacaagcctcttttacacaatgtctaagatgtccttgaagtatcattaaatccgctttttttataagagactgtactgccaaaagctgatttgcaacatcaatacagtatctatcatcttctatcatttttattattccttcaatttgtcctttagctgtttttaaagattgaactgctttttttctttcttcactcattttatactcctccccccgtggggtgtcttatttgtatttatcctaatctttttttttacttttgtcaactatatattttaaattacttagtaaattcaacatgaattatatctgtaactcaatatcatcctcatacatattgttagcaaaaattttattttaattctaaatatattactttcaactattaaaatctgtttaattcactgcattcacgtattatattatcattacaaattcatgtaaataaataaagatgcactaaaaaatattatcatattttcagtacatccttactcttttctaaataatttgtaaatacttctactattcttggatcgaattgatgacctgcatttatcttcaactcgcctattgcctcatcctttgttcttgccttcttataaactgtatcagtagtcataatatcatatgcatcagctacagccactattcttgctacaagtggaattgattctccttttagctttaaaggatatccatttccatcccatctttcatgatgagttaaaactccctttgccacactgtctagctgattggaagctttcacgattctatatcccttttctgtatgactcttagctatttcatactcttcatctgtaagattcccagacttaagtaatatagcttcatcaatacctatcttcccaatatcatgtagcttggccaccaaaataagttcatccattgctgacatggataaagaaacacgttttcctatttcaattgaatatttaactactctattagaatgttcttctgtctcataacttttttcttccatacttatcatcaatgaatttaatatggaactactcaaactgtttttctgaagtaatttctgaagatataccttgtcttcagcttcctttaaagccttgttaatatcaaaattattatcatcaataatagaaaatcctaatgaaatactaggattaataaatatatcctcatactttttacatttatccaaaatatctttcattaacttttcacatttattctcatcagaattaggagttaaaattataaactcatctccacctattctaaaaacataatcctcagaattacatgcttcctttaaaatttgagctatatttattagtaatttatccccttctgaatgacctaatgtatcatttactaattttaatccattagcatctgccattattaaacctataggaaaattatcttcattaactatctttttacatattttttcataatagtttctgttatatacttgtgtcattatatctgtaaatgttaatttttttaattctttatatttattttttaaagattccaatttttttatattgtcctcagtgttaaatatattttcattcacattttcaaatatatacattcctccaatagcagatacttcatcataagtattcattattggaacaagctttattttaaaatttttatcatcaacaaaatcatttattaatactatatctttgttttcaattacagtattacacttattcctaatcatatcgtatgtacttttactcaaaatttcagaacaatccatacttaatatatctttatctgtttttccacaaatatttctataggaatcattgatatatgtaatttttaattcacgatccattatccatactggatgctgcatttcatctacaaatgccttaaaaacatcatagttcatgtttaataacttccttttaattttaagttttgcttaataatatatattatatatattatttatatttttttcaatatttttacttttgcaagaaaaccactttatatatgaattatcattctataaatttgcaatattttaatacatatgttgcactatagactttacatttcaatatgtactactaatttgcatgatacaaataacaattatttcacaatttataacataaaagataatttttataaaaattatttatctctttatacttttaaatacattttaatacattatattacatgatatcgttttaacattaaataatgtaataataagttaaattattgtaatacttatatttaataattcaactttaaaaataaactttaaaaagactgaattttctatgttattttataacttcaaaaattcagtctaaaatttttacttttttttgaatataagtattgtaaatccaatttaacaatcagtttttttgtaaatacttcataaaactttcattaaatgaattaacatattttttactaacaggtatttgaatttcgttttctaaagttatgcatttaccatcaaagcttcttatgtaatccatatttacaaaatacgatacatgagtacgtacaaatacatctcttcttaattttgattccacacctgatagtgtgtcgtaataataatagtcctcttttttagttacaattctaacttttcttttattgctctcaaaataataaatatccttatatggtatactaaataaattttttccttgtttaaaatagtagagaatttttttatcagaaatataattaaaacatttttgcaaaactacctccattttgtctctacttaacggctttaaaacatactgaaatgcttgtacatcaaatgcttgaatcatatattcatcataaccagttacaaatactattatagactctttatctaatttcctaattctttttgcaatttctattccatttatatcatatattgaaatatccaatatatatatatcataaaatacatttcttttttctactttatataataactcttctccacttttaaatccacaaacctctgccttatagccatgttcatttataatatcatctatcatgaacatctcttcattcaatattaaatcttggtcatcacaaactgctattaacattatattccccttaattaatattttttctctttagtgttatccttattattaataaattaaacattccacataatagcattaacttcatagctattaattttgtcttcataatttaaaattccactatatttattaacaattttttcaacactttttaaccctaatccatgattttctttatcttctttccaagttttttcagaattgtaataaatactttttgaattctcaatatttattgtcatagcagatttcttataaagtatatttacattaataattctttcaaattcttcaatcatgctacatgcttcaatagaattatccaataaatttcctaaaattattcccatatcagatggatcaacccttatatttgtcggcacttttatatctataacccagtttatattatatggtttactatgattaattttagaattcaacataaagttaatttcaacattttctgtgtaaatacctaatttatcattttgtgtttttgaaatgattctgtccattattatattagcttcttttatatttccattattgacctgactttttaacattataatttcatttttaatattatgtctcagttctttaatttctttttgttttttctcaattctattatagtaatcttctttatatttcatttctttaatttcttcttctaataaaattctttcagcaaagtataccaatgtagtcaaaattgtcattaatcctagtattgtaatagaatctataattaacttaatacttaatatattgggtctattcataactattgattctatagtgtaaataaaaattgtcattaatgataatgcaacattagtttttattgtcatctttatatcaagaaataatgcgactacaattgcaaaatatattgatttatatccaatatttatgtcatactttaaaaatccaatgaaaaagtaatcaataattacagaaatacacattaattttttagtcatctgaaacttctctatgctaagtttattattaatgattataactttaaataaatatataaatatacttatttcaaatgcagctactaaagacataaatagctcatatttaccatattcatttattaaaaaatatcttgctgtggcattgactggaattgtagctatacctacgataaaaattgcaataactacccttactatttttgtatgatatttttcaagtatgcttatttttttatctctcatttattattactccatctgccccctttacaattattctttataactttaattatttttattacccacaatttttctaatttaaattcttccaatcttattttatcagatataagaaaatttaaaaatatagtttctaatatgaaatctatttcacctaaaaattgtttcattaattgcattaattataaaaacctgccatcacaagaaaaaattaatattgaataactttatcctataaagacaggtttttatataattctattaaattattgacgaataatttttatcaactatttttttcaatgcacattcagcaagccttgcaaaatatcttgaacactttattattgctttttcatcaacagtatattctggatgatgatgtgcttctgatatacctgttccaactacaataaaaactcctggtatttccttttgatagtaagcaaaatcttctccttcaagtcccattgtgattctcttaacatcgtatcccatgattctacctagcttagatgcaaagttagtccactcttcatcattcttggttgctggcgatcctgaatgccatattaattcagcatttcctccataggactttgctattccttcaacaagtgctttcattctttcaggaattagctctcttgtatgttcatcaagtgttctgactgtcccttctatatatgctgtttcaggaattacattccatgtattacccgattcaacatgagtcacacttaataatgctttatcagtaggacttatatttctgcttacaatagtctgaagcgcatttattatatttgtagatattataataggatctattgacttttctggctttgcagcatggcttcccacgcctgtaatcttaatctcaaatctatctactgctgctgtcatagcaccttctttaagtcccattactcccacttcaaaatctgatacattatggattccaaatattgcatcaacatcatctaaagcacctgttgaaattattttttctgcaccatccccactttcttctcctggctgaaatataaatttaacagttccaattagtgatccttgatactttttaacaagataagctgctccaaggacaactgccgtgtgaaaatcatgtccacatgcatgcattttaccattacttaatgatttatacgaaaggcttgtttcttcaattattggaagagcatcaatatcacatcttattgcaactacgggtccattaggatttccctttacttgtgcaactaaacctgtcttcaatggtaaatccaatacctctatatcaacttgtcctaataattcttttatcttctttgtagtttcaaattcctcattagacaactctgggtgtctatgaaattcatgaaataggcctataagttcttcctcaagattttctaatattgtaagtagatttgtattaatcattgttttccccctctttgatattgctcaatttaatccttaaactttctatgctatattttttgataatgccttatatatataattaaatatcttaagaattcttagctaccattgttactaatataataaataaataaaacactaaatacattaatgaccatttgttagtaaatgaataaaaaatcttatttcttacttttaaaacttcattcttttccttacatatgtcaatcagctcttttccatacttaaataaaaaatataaaagtgctgaaactccacatatgtaataaatactgctccatattaaaagaatattttgcgagttagtagttgaaattaatgttgtaatcatagccataatattattaaacatatgaacaattatagatggaacaattgattcacttttaactgcaacaaatgctagtattattcccattagaattgggtttacaagctgtacaagattaaagtgaaacattgagaaaaatattgaagttactattattgcagtaaaatccccatacttcctcatattatttaaaatatatcccctaaaaattatctcttcaaacactggtgcaataatacatgtatatgaaaaaaataagataagataaatagtctcttttggaatactaaaatctggtgatggtatttcaattccatgagaatttataataatagaatatattaaaaatataatacttgatattattccaactcctattgatgcaaaggctcctgatacaataaaatctgatggcacctcttttttaaaggatatataattatttattccctttctaaatataaaaaagcaggctataattgctactacatcagctgctatacaaggaaaatatccaacccagaaattatatgcatcatttgaaagtcctgaaatcattccagtagttgaattactgcctaacaatgatgatcttatctttaatattctaattattaaacttccaagaaaatatgttaatacagataaaataagcaatattacagcacactttccagctgtattttttatatctttttttaaaaatttctttccataacatgcattttcatttaaattttctgccatatatttttcctctcccatttcaattaactttttaaatatttatctcaaactgaaatatataatccccttaactaataatattcagcaaaatattgaaaatgtagaatataatataaatatcttaacatatttaatatttatataaaataataagaattgacaagttattatttaactaaaaattacctaatgctatagtttcttcaaaaagtacaaaagttgatacagtatcaggtgcaacgcacagtagtaatggtataattagtactgtttaaaatccaaaaacactctttaatataaaaaatataatagggactaataatgccggaagcatatttaatgtcttacactcctttatttttaaaatacttatacccgaacttgctattaaaacaccaccaataatagaaagttctgtaattaaagcatctgaaaagaaagaacccgataaaaaatgggctattagaaaaatacttccctgccatataaacaaaataggagcagcaaataccattcctataccatatgtagatgcaaatataattgatgtaacaaaatccaaagtagcattagtaaataaatatgtattatcaccataaatagcactcattactggacctaatatagaaagagtacctatacagtaaagtaatactgctgttgaaagtccttgtccaagatttgacttcaaatattttccaatcatattttgaaatttttcatcaatattgattatagaacctattaaactcccaacagcaagacttattataaacaatacaggataactgctttcagacatatggctcacaatagaattaattcctaaagcagtagctgcaaatcccatagcattaaaaagcgctccttgatattcctctttaattcctttctttactaaacatccagcaacagttcccgtaataattgttcctgtgtttacaattgttccaatcatttaaatcactcctataaatttcatttattttatagaaataaaattaaaccatccagtaactagagagtcaatacttttttatatggaacctgtatttctgttacaaatttacctgtatcatttgtcataccataatcaattaatgttatttctatagaatccccacaaatactatagttcttctctttcatataatttaatatcttaatataatattcctttgattctttatgagtgcccttaaatctcaaagttagataatccccctcaggaatatatttaccctttacactagtattatcttcattttcaatgattataataacagaagcaaattcgtcaaatttattcgctgatatattgtctttatcaatagataatgcaacctttcccaaaaaaattgctgtatttaattgatgttttcttccaagttcaacaattggataatcaatatcttctccaacttttatatttttcttaagaatagcaatatttctacgtggaatccatttttcttctatttgatagtattcagaataaattgcatctttaatttgtataatacgatttttaattttatgttctattaattccagctcactctttttttgtgtaatttctttctgctgttcttttaatatagaaactaatgtttctatttctctgttgttaaagaaatcaataattttcgctataggtatatttaaagttcgtaaatatttaatggtattaaggcgttcaaattgtttagttgaataatacctatactttgaatttggatctatgcgttctggctttaacaagttaatttcatcataatatcttaacgttcttatatttatttcaaataaatttgcaatttctcctattgtaaataaatctttcaatcttacacctgctttactttataaacaattattctattatttcttttttatacgtattatagcataactattatgtttacaaggtaagattataattactaactatgtaacatcatgatttttagctatctgtttcttaatttctttatatatgttacaaaaaatatacaaatttttaataaatacaattttatataaagtaaaaaaatattactggaaatgttacttcccagtaatactttagaaatcaatatattaattacgccaaattatctgtggtgttttttatatcaacttactcattgctttatattattgtttttctgcaatctttcttaaaagagattttgcttttattctttttaaaagaactcctaatgctgaaatcacttgatttaacactattaccataaccgaagttgaagcagctatttttactgcactagtttgttctttactatcctttgaagtttcattaacctgagatagagtatctgctaaactgctagattcaatattcccctcttctccaactgttccttcttctattaatatcatagaatcctctaaaaatttaattccgaaattaatattcattctcataggattaatataaatatatgctttaatatcatcatttacattattaataggaaatcttagtgatattaattcattagccatatcatttagcggtacagtatgttctacaacttctccattaacttctattttaaaattacccattgaacctgaactactaaatgtaattgttgcataaagctgtccatcgatatcttcaataatacttgtttgatttaaatattttcttgccatagtacgtcctattgcactatcactaactatttcattagttacagtatactttttaaagtattccttagctaatgatgctaaatcttttgctgcttcttcttctaccactaatttatcttcattattagtcttatttgaagaaaatgcattagttatttttgaaagtacactgcctgatgaattactttctgaaacaactgatgaatttccagctaattctggtaaactttcagcttcttctgtacttattaattctaaagttgactctaagaattcaactccaaatgatatatctctacccattgcagttacattagttgttacagtaacttgagttgaaattgatggtacttcaaatctaatatctaaagtctttttactatcatctttgcttacaacgtcatagtttatctgctttccattaatagaaagtcttatattattcattatatcagtctggctaaaacctaatgttatatattttttatcatctatgatttcatagtaactaactttattaacagctcctcttgctgcttgatatccaaatgaactttcagttattatctcattattaactctataagttgtttttttatattgagagtttgtattaactggtggtgcattcacaatatcattttgtggatctttaattgttccgttatcattaattgatgtatctgttgcagtttcatcctcatcatcttcgtcttcaccatcttcttcgtcatcatagttgtctgcatcatcatcttcctctaaagtactagatcttaataatactctaaatgctaacccatcatgattctctataccaaaatctgataaatcaagatttgttgtaactaaaatttcatcactcaatgatcctattctaaatttaatgtataacttatctgaagtcttcttaacagttgagtaacttgtcttatctccttcaacctttattgaaacaccttttattactgaagcatttttaaattttaaagttaaatatattttattgttttttacagtaacaacactttctttatctacatactctcttgcatgagattcactatctgaatcttcctttaataccttattttttattgtatatgttccactatctaaatcatcatcatcgtcatcactatctgatgatgagccactatcactcccactatttcctgtatccttaatttccactaaagtagcactatcaaaaactacagtaaaactatcatctgtatcttttgtagatttacctgatatatgaattttatcacttaaagatgtaatcataaaactaacatatgttttattatcttgagtttttactgaatatggagttacactagtattttcatttaatgttattgttcttttatccataaaatcagccatattgaacactaacgtagcaaatatgttttcatatttaacttctactgaacttgacgtatctaaatatctagcactttctggtatagttccatttgaacctgctacaaccttattgtttatagaatatatagcatctttctttacattaagtatctcttcttctggagcttctacatcattaccattttcatcttttattgtggatgtatccagtttaacatcaaaacttgtagtgttaacataatttatttcttttatagtaagtgtacatccaactgatatactgctgcttaaagaatttatactaaaagaaatagttcctgtcccatcagggtttttaacaaaattaatatcctttgttgttactccatcaacagtagctgataagtcactaaaagcatctgcatattgactaatatttaaagttaatgtgtaatttccattttcaactgttaatgtacttttactatttaaataatttcctgctgcagaagtactagttgaattatcctttaaaaatgtactttctatagtataagtcccatctgataaagtcttattttcttcctctggataagttcctcctgaaccatcatctggattctctatatcttcatctttatcatctaactcttcaaagtatgtgatattgcttatagcaagatcaaagtcatgctgcttaattcccattgatggtactatagctgcataattacagtctactgttatatttatttcatcttttattgaacctaatttaaattcagctatatagcttgtatcatctatatctgttcttttagtttctactgataccccattcacagatgcacttgtacttactaccatatttgaatcatttattactaattgtactgttatttttccattctttatttttattctgcttttttctgtatctatgtattttgccattgatgaagatgactctgttcctgttttatttgctgcaaaatctgcagtgtacacaccatcttcaaagttttcttcttcctcttcttctggaagctcttctaaatatgtaacatcacttattagcaaatcaaaatcatgctgcttaattcccattgatggtattatagctgcataattacagtctactgttatgtttatttcatcttttattgaacctaatttaaattcagctatatagcttgtatcatctatatctattcttttagtatcaactgatgctccatttacagatgcacttgtacttactaccatatttgaatcatttattactaattgtactgttatttttccattctttatttttattctgcttttttctgtatctatgtattttgccattgatgaagaatctgatgttcctgttttatttgctgcaaaatctgctgtatacataccatcttctaaatcttcttcagataactgttcatctataattaaagaatttaaatattcttccatttcagaatcaatttctaaatccgcattagattcttccttgtttaatgaatttaaatattcttctaagtagttttccatatcaccatcaattgtatatgatggtgtatccaattctttatcttctacttctgtatctgtagattcttcactatgagctttctcatcatctacagttttatctatcccctctagattaacctctgtatccttattaataagctcactagtttcatcttcgttttcttctagttcaatattttctgaatctactatatcttctaagtgtatagtctcttcattttcattattaattaccaatgtttcagtagcctgtacaggtgttataagacctaaaacaatagttaatgataaaatcattgacataatttttttcatgttagttaccccctatattttctgtatattaattagttttctttttacacttatcattagctgtttttaatgtatagtgtgttcctccaataaataagcccataatagatgcatattctactattacttgtaccttagttgatttattacgtgcatctgtttctttattcattttcaacatggtttttactattgaattattgcttaaagcaaataatccaagtaacatgattattattgaaagagttcttaatatatatattcttattgaattaattccctttatattaaataatctcctaaatccatacattatcattttccaatgtaatcctatatgtattgaaatacatatgaatattaataatgctgaatttttatgtatactagcccacagttgtctattctctgctgctatgcccttaaatatagtaactgaaatcaatatcccacttattattactaatgcagttaatactgccaataatatattaagtaccacagaaaatttagtggcaaaattaagttttgtatcgaagattctagatgccattccctttatccatctataattaagagtaagatgaagtataactaatccaccaattattaatcctaatttttcatgccaacctattcctgttatcataattttcattatgcatataaaacatatagtcattatgatatctaaacaatatttaatatgctgtttattcatttctttatctcctaaattaattaaattctcttatcaatggaatttctgatttattccatagtttttactctaaacataaaatagtaaaatttgaataccattactaaagctattaatatttttactatccatttatcaacaaaaattaatggaaacatcataataaaatatgcaaataataaaattctccatttctgtgcttttgtcattgctctgtttacaacaaaactctctaaatttttcttatacaatgatgtccctttaaaccatttatcgagtttttctgaacttctaaaaaaacatatggatgctaataataaaaacggtgtagttggtaaaacaggaaatattattcctataaatccaaatgctaaagctaaaaaaccagcaaatatatataggccttttttaatcttattcatctgtcatctccttaaaatatctcttgaaattcattatcatctatttttcataaatttggaggactagtaactactcctccaaatttattttttattttcttttaaaatatcagtttaatacaagttttttcttttcaagcttataaaccttgttacatactgaagttgtagattttctgtgagatataagtattattgttttttcttcacagttttccttaatagatcttaatatttcactttcattcaatgtatctaaattacttgtaggttcatctaagataagtacatcaccgttacttataaatgctcttgcaagccctattctctgcttttctccagatgaaagcattcctccaagttcaccagcctttgtatcatatccctttggaagcttttctataaaatcatgtatagatgcctttttagcagcttctataacatcttcccttgatgcatttagatttcctatttttatattatcttctattgattcattaaataagtatgtttcctggctgactagtgtctggcttgctcttaaagattttgtaggaatatctttaatatttatgccgtctatatctattcgtccagaattaacatcccagaatctcataataagctttataaatgtactttttcctattccactttcaccaataagagctatcttatcacccttatttatattaatagaaatatcatctaatattttttcttgtctgcctggatatgaaaactctacgtctttaaactttatagaatttccttctacttttttgtctccagctacttcttccacattaggttcttcatctaataatgcaaaaagtctttctgcacatgcaaatgtatgaagaagattatttgataaattgcttaatgcaactactggtccaaatgaagacgctactataactacagcaataacaatttctataaatgaaatactgtcagcaatcaataatccaaaacccgttcctacaaaagttaatattgctaacattattgtaagatctgttacacctcttattacaccttcatgatcttttatcttagataaacttttattaagttctcttgatttttcatttatgctatttaatcttctctgtccaccattaaacagtaaaatttcttttaatcctcttaatgaatcaagtatataggaattgctttgaccaaaattatttctatattcaactccagcttcttttgccatctttgaagataaatatggtattgcaaaaccaacgattaaaaagaatacagctcctaatataccaaaccatggattaattctaaataatatgatagatattatggcatttgttattatagctattgttattggcgctatagtatgtgcataaaatacttctaataattctatatcagatgttataagtgaaattaagtttcctttttcttttccttcaagcttagccggtgctaatcttcttaatactgtaaaaattttatctcttaaaatcactaatattttaaatgctatataatgtcctgacagctgttcacaatatctaagtaatcctctaagtactgcgcaaacaatcataactattactgctgacttaaatgtaaatgaggttacttcaccaattaaaactccaagggcaacagctccaaatgttgctattgctattgctgctaaaaatcctaagactcccattcctattgtaattaacataactggtgctaggggttttaactcaactataagccttgccattatctgaaagcctgatcttctcttcatatctagcatacctcccttgtactttctaactggttctgcttattaaccatagaaaaatattcaccttttatatcagtcaattcatcatgattcccattctcaactattcttccgtctttcattacgtatatgttgtctgcatccactacattagctaatctatgagaaataactaatattgtcttatctttagaaagttcataaattgattcccatatagcttcttcgctttctatatctatgtttgatgtggcttcatcaaatataatcatttcacgatttcctaagatagctcttgccagtgctaacctctgcttttgacctcctgataatgagcttccaccttcacctacatttgtattcaatccatctcttaatgattgtacaaaatcatataatctagctttctttaatgcatcattaatttcagatttagttgcatcatatttacccataagtaggttgtctattatgcttccattgaatatatagctgtttgtagatactaatgaaatcttattataaatatcatctaatgatatattttcaacatttattccatttaattttatagctccatcatttacgctatttgtattcattataagtgatgctatagtactcttaccacttccgctttcacctacaatagctactaaacctttgtttggtatatccatatttacattatctacaactgttctttctccatcgtaactgaatttaacattttctaagctaactgaaagattattaagctttgatgctgaatcattacatatatctttttctttttcttctgcatctaataagtaaaatattttatcacatgctgccataccattcatagcaatatggaaatatgaacctaataatcttaatggtataaagaattctgatgaaagtaaaataataaccaataaatttccaactgaaagatttccatttttaaattctattaatgccactatagttccaagtgctgctcctccaaatgctattaaatccataatatttatagaattaagctgcatacttaaaactttcatagttatttttctaaagccttcagcttcttcattcatttttctatgtctttcttcatcaatatcaaaaacttttaatgtagtcagcccttgtaaattttctaagaatgtatctccaagatttgcgtaactgttccaatactcctttaatatctttttagcaattttcattattgcaataatcgataatggaattaacggtacacatactataaatactactgctgatttaattgatataaatgaaataaaaacaaataaagttattggtgcaagcattgaatagaaaaattgtggcaagtatctaccaaagtaaatttctaacgcttctactccttcaacagtcatttgtacaattgttgatgtgctttgaaccttattgtatccaacacctaattttaataactttttataaataagttctctaagattaactcttacgctagccgatgctaaataagataattttccgtacattatattactaaaatatcttattatcaataacactgctattattgcaattgtaccggctaatgataaattttcatttactttaaatttaagaagagtgcttaacttatctatttctagattaactaataatcctcttactgtgtaaaccttgtttataaactgaccaaccataagaataatcaatatattacaaatgattgatatccagcttgttaatactgttaatgcaatatacttttttgactcactgcatattcctatgagtcttttgttaatcatcatatgtttaactatctccttctcaattattatctatcataaaaaacacataaaacgagagcatatactactatatactcattggaatctcttatcgataatgattatcattaatatagcatataaatttattattgtaaatgtcaaagactgtatttaggcttaaaacctaaatacagtctttatcaataaattctatatagtttttctcttctatccttctttaagctaaaagatttccttatatttaacactttttctttacatatatctgcttttataattccttcattagaagtgatttcatttaaaatatttccttcaggatcaataatcattgaagctccattataataaattccatcaccagtaccaactctgtttattcctgcaatatagcactgattttctattgcccttgctgtaagtaatgttatccagtgattttctctttcctttggccagtttgctgctacacatattaactctgacttctttgaagcaatctgaaatatctctggaaatcttaaatcataacatataaatggagttatatttatatcctctaaaacacatgatattatctcattacctttatggtatttcttatcttcaccaccataactaaaaggatgtattttactataatctgcaataacattgccttcatttgatactatcatatatttatttaaacctttttcatctacaataacaccaaacccaatccctatattcatactgtattttacagctattttgattatccagttactgatttctttttctgaaaaagtatgtttatctatatccattgtaaaacctgttaaagacatctcaggaaacaataacagttctatttttttctcacaagcttcttttacaaagttttcaattttattcatattcctatatatatcttcccattcaatatccatttgtacaattccaataatcatgttcatacccccaatataaaaagccgcttcaagattataaaaaatcttaaaacagcttcattgcttcatattaattaaaaattttttccgttccagccccaattttcaacttcttcatattttatataaattttattttgaggtattccaagttcttcttcataaatcttgcatacttcacttgtaactttatcaaaggcttctttcgatgctctaccaaatacttttatttcaacaaatgcgcctttttcaagcttttctcctgctaaatataatttatattcgtcttcaaatccaaccattaaaaatgtttcactttttcctggtataagttcaattgcttttcctaatctcttttttattatctcttctttttctggtgaaatcttcactgttacttttgatcctataaatggcatacaaaacgcctccaatccgtatatttatatttaatgatattagaagcctgaatatttgtcaataaaagtaattaatgctttatttttattttacttaatcatctgcaaatctatatccaattcctacttcagtcaatataaaacgtggctttgcagtattcttttcaatttttcttctaagactcgccataaatactcttattgattttgaatccccattttcaccatatccccaaacttcttttaatatgtaattatgagtaagaaccttgcctttgtttgcaaccattaaagtcaataatttatattctattggtgtaagatgtatttcattatcatcaacaagaactttacgcttttcatagtctattgttaaataatcacatttaaaaagttcatcttttacaggtattttatcacgattcatctttctttcaacaacacgtatccttgcaagcagctctcccatatgaaatggctttgtaacataatcatcagcccctgaatcaagtgctgatattttgtctatttcttgccctcttgctgatactactattattggacattctgatatctctcttattgattttataatttctattccatcactatctggaagacctaagtcaagtagaactatatcaggtttattagaataaaataatgataatccctctaatcctgtacttgcacattgaaaattatatccacttgtttttaatgaaagagaaatgaaatttaatatgtatttatcatcttcaataattaatattctcgaataattcattctaaatcctccattacagcaattatttttattataaagggagtgtaaagctaaaaagtgctcctccttctggtgactttcctgctgtaatttcccctccatgggcattaataatcgccttacatattgcaagaccaagccccatacctctttttccatcaactatctttcctgaatatgaaacaaaactatcaaatatcttatcgattattgattcatttataccttctccattatcagcaatttcaaatacaacaaaatcattcttttgaaaaaccctcaaatatattgtacatttctcatctgtatatttaactgcattatcaagaagatttattaatacctgaacaataagctttccatccacaggtattgatataacttctttaggaaggctcacttgaacatctctattacttaataaacctgatatatgtcttaatgattcatctacaatgtcatctacaacttcatcctgtttttttataacaagctttccttcgccaatccttgtcatatttaaaatgttttcaactaaattattaagccataaagcttcttcatttatatcttttacaagatcctttatagtctcttgtggaagtttgttaatattatccattaccacaccactagctcccacaattgctgttaatggtgttcttaagtcatgagaaatacctctaataagattacttctaagatgctctctttccatctctatccttatgttttctcgttcataatatataagctctctatctaaggatattccaatctgagtagcaaccatctttattaaaagttcattttctaaagataaattatcttctgaaaagaatatttctatttcacctaattttttattaattccatgtatatctaaatttaatttattcatgttacattttgattcatctatactttcatccttataaaaaatctcatttgtatcagataaagttactttacttttacaaccagtatgattataaatatatgatattccttgaataacaatattctttttacctgtaatattagaaaaattatctgttatctcacatagtaatctagctgtacattcatttttttctgcaatttcagcttgtttttgaattcttgatgtaagagaactagatataattgaagatataaagaaaaataacaataacgttatgtcacttgtactatatatctcaaaagtatgtactggtactgtaaatatataattaaaaattaatacgcttaatattgatgcaactgctccataaaaatagcctttagtaataacagttacaagaagtaccccaacaagaaataccatcattatgctgtctttttctattcctacttttctcattatcatagatattagtgttgataataacaccaccgaaataagtttaatactataaccaatactagatttattcatgttactttattcacctcaacccaattatagcataatattacttatttatggactattttcaattgacctgtaaggcgtcttctaggtactccttgtcagtaataaacaatttgcgttattacataactactttatttatacattaaagatattagctcaagtataaccgattttttataaactataattcttaattgcagtatagctgctttcttaataggtttatatctttttaattagcttaactaagtcattttttttagcagctacaattaggtgctcttcttctctaaatacatggtcagctttaggtagaggtagaatttctccattttcctttattgctaatatactcatctgatacttaccccttactgatatttcagctattgtttttccaatccatccacttactggtggaatttcagctatagaatattcaggtgtaagctctatataatcaaaaacgtgatcagcactatatcttattgctgctttttcagctatatctttttctggatatacaacatcatctgctccatttcttaaaaggaattttgcatgtatttctctatttgctttagatacaacatgttttgctcccaattccttaagtaatgatgtaatttctagtgatgcctgaaaattatctcctatacagacaaaacatatatcaaaatttcttactccaagtgattttaatacatctacattggtacagtctcctatttgagctgttgtgacaatagatacaatttcactcatcttttcttcttctatatcaactatcataacttcatttccaagttcaacaaattttctagctaaatgtctcccaaaacgtccgattccaataattaatactgatttcattttaattctcctctatcctctgattctttattcttcacatcattgtgattttgtattttagaaaataaaattttatttatttatgttacacatgaaccttaaaattataatctagaaatcgcatagtgatttccacatcaattatcaattacttacaatgagtgcccgcaacagtcatcaaatgttaattttcaattgatatataattaacctatagatattttttcaacaggttttcttataggtatatattctttcttttcagagaaaaccaatgctactgataaacttcctactcgtccaaagaacattaacaatgtaattataactcttgacaatgaatttaattctggtgttattcccgttgacattccaactgtgcttaaggcagatacaacctcaaaaaatacttctttaagtccaaaaggctgaagtgcacatattaacaatacagctaaggcacagcacataaaataaatagtaataacatcatatgcctttttaattacatcacgttctaatcttcggttaaaaacattaatgtcttctgtatgtcttattgaagccattaatgatagtattattactgcaaagcttgttgttttaactcctcctgctgtagaacctggacttcctccaataaccataagtataattgtaagaagtattgatccttctgataactctgctatattaactgtattaaatccagctgttctaggtgttatagattgaaaaaatgatgctagccatgattcagtagttcccatgcctgcaaaagaatttgttctttcaatactataaaaaataatagctggtactataattaatgtagctgtaactactagtactatttttgtatgtaatctatatttgcaaaactttaatttattagtgaaaatatcttcccagactaaaaatccaaccccacctactacaattaaactcattattactaaatttacaactatgtctccgctatataaagtaagtgatgaacttggttcaaatcttcccattaaatcaaagccagcattgcagaatgctgagattgagtgaaagactccattataaagtccttgttttaatcccatatctggataaaatcttaaagctaaaattattgctcctattgcttcaaatattacagttccaaataatatatgttttgtaagcctaactattcctccaatgtgaatagtactaacagattcttgaagcattcctctttcctttaaacctatctttctttttagcattaaagaaaataaggttgctataatcataaatcctagaccaccaatttggataagacttaatattactatctgtccaaataaagaaaaatgagtatacgtatcataaactacaagacctgttacacatgtagcagatgctgatgtaaataatgcatctataaatggtgtagcttctcctgaccttgatgatattggtaaagttaacaataatgctccaattaaaataatactcataaaactaattgcacttatttgactataagtaaaattaggttttttcaatttatgcatttttaattttctcctttatagctgaaagacattgtttattacaaatattgcttatgcttattctcataacaccatattcatcaaatattctttcattttcaaaatcattacacacggatattacactttctatgttataccactttctacttaatgcacatgccattaaattatctaaatcatcattaaacaaaattatcaagcatttataactattatttaatctttgcatattattgtcatagataatgtcatattgtatattatttgtgtcaaggtaactttctatgcttttagttacttgtttatttcccattataagaactttttcttcatttctttcaactgttgagctttgattaatttctataaatctgtccactttttttgttccataaattccaaaaaacaaaataaatagaatagatactatcactacaatatatcccatgcttttcatctcctatgagatagtgtatcagcttggatataaattttgtgttaatattttattattggcgttaatattttataaatattattggtaaatttatttctccttaaaacaaaaacacctataaagttcagcgaaatacaaaacattcctgccctctataagtgtattttattatatattataaatttaatttatttcttaaaatatcatatagaaatccttaattgttacattgtctgaagaataattagtaataacagcatagtaataatcacttgatggtgtaacatatgtatcatcataagtcttataacttaaagttttattatatctaccaacatgatctgaatatggacttatgataacattaattttagctgctctatcaagtttatatataattgtcatctctgttcctttacttgcatataaaccataacttgaatttttaggcttcaacattactgattgtccattttttaacgttatataatcatcaactaaatccaccctaggcatcattttattttctacatttggtgaaaatataccttctgattgaattcccccatctgaatcatatataacataatcccatgcatctacattaactttatcctcttcactcctttcttcatttacataattttcttcacttttaactgtatcctttgatgttgcagcatatgctggtaatgagcaaattgacattgtagctaaaaacaaacttagtaatttgtacccctccccaaaaattatattataattatctctccatttttaaatgaaagataatctgaactagcattaactatgtaaatgtaatattctccatcttcatctattgttaaattatattccccatataaattcttaaattcttcacctttaatcatttctccattttttatatatcctataatagcagtttgattttcaactacttgagacttatacttttcgaaattaaattttatattttgcccttttttcaaattccatccacaatcattttccttagtgaatatacctatacttccatttgtttgtataatttctggtgtaatatatattgaattcttttctattgtccgaaatgcattgattgatgcacaatctaaatttatttccggttgcattttttttattattttattagattttaatgtatctgtaacattcttaaattcaccatactttgtttctgtttcaattaattttttattttcttctgttatatatgcagaaccatttattgagatattattacacccagccaataaaaatatatataaattatcactactgtttaaacattgattaaaatttccattgacaaattgtacatggttataatttcatatgtcaccataaatttatacgtgaaaatagccagtaacctttgatttaatgtaattaccacaaaacaataaaaccaaaggaggttactgactacgtggttgattatatcaaattattcgataaaattatagaatttattaattgggatactttgaaacatacagcatttaagttaaatactggtaataaagtttcaaaatttttcactaaagatcatctaaaatcaatgatttatcaccatatctctcaaaaagatagtttaagagatttaagctttggtatatctatgtctagcaaattaaaagaaaccgtagcaagcgttagcttgagtactttatcataccataataataaaagaaattatgaagtgtttttaccagttttatatgaactcattaataaagttttaagtacaggttcagtaaatgagtccttaaagcgctttggttcaattaaactaatagattctactaccataagtatgagcttaaatctttaccaatgggcactgtttaggtctaccaaagcgggagtaaaaatccatacaagatttgatttgaataaaggtattcccgatgcatttgttgttacaaatgctgtcgaacatgataaaactgctatggattccttaattgatagtagacattgtatctatgtatttgataagggttatttagattatgaaaaatttgatcaatacactaaagacgaaaaatattttgtaactagattaaagcataatgcagtagttaccgaagtcgaagacttaaaaataagttatagttatgaacgccttttagatgtaggaactaaaataatctgtgacaaaatagtaaagcttggatctaaatatacttatcaaacaaaacaagaataccgacttataaaaattgtagataaaacaggtaaagagcttacatttataacaaatattgatgatcttcttagtgaagaaatcgcgtttctatacaaaaagcgttgggaaatagaactttttttcaagtggataaaacaaaatttaaaatttaaaacttttgtagggcgatcattaaactcagtgatgattcagataatcactgggattatgaccttcgcagtatttaaacttatagaaccatttattcaaacaaaaactacactaattgaaataaaaagagctataaaagctaatctctttgagatttacgaagctgataaattcaattggtcttatattttcaatagttcctaattctaaagtgaagatatagcattaataagaaaaaatatccacccaaaattctgttttcatattcaattttattggatatatattccacataggatattacacaatttttgagaaagtcaatggtaatgttaactattaattaaacagtagtgataactaattatagtttgaataatttagctatacatggaatatatattcaactttactataattgcagaaatacaaccatctccaattgctgaagttccagaacaacaaatattccctatttcaaccacttataaacaaggtatctattcactttctttgttcaattgatatgaggttcctgcgaaattataactcaaaatgccactgctgccttaataacagctgatagtatcggtaagcttatgcaatttatacacttagatgaaacggatgaaattgtaaaactaggcactcttcatgagggagatattgggatagtgctcggcactggagaagtagttgtttctccctttaaataactacttaatgtagcgattgtaatcactccacacattacattaagattatcctttcaaattttttacatgattaacttatactatctacaatttgttcaattttagaattgcgtaaaaaaatatttttttatcttaatttatttaataataaaattttggaattcctcttttattatccaagccaggtataattggaggtataaacatattttgtctcactattcgacttgattcagtagtagtaagttctgcaattcttgttactccaacataaacatctgatatcttataccacgttgcataatcaactactcctgtttgtggtaatccaaatatttgttggaatgtctttactgcctctgcagtctttggtccatatattccatcctcagcaactctcggaattaatgggtagtttcttgctattctatttaattgactttgaatagtccttacagcagaaccagatgaaccaatagttaatggtctacctggatatgattgagggcttccagcaactttttcagctgtaactaattcaatgttatttccataataatatctcaaaatctcatatggtaccttaccttgtactcctaatttctgactaccccattgactcaaccattcgggacagctaacccgctttccatcacagtattgtgttaaaagtggctgcttccttccaatccttcgtacgtatgtggaaaaaatctcatcgacaatttgacttatattatcatagaaatttctaccataagcgaatgcatgatcataagctgtagagcttgtaatatcaaagttttttcctttacctctataccactcagtatatattctatttaatgtaaaagatataatacaaaaaatatttgctcttattgctgaatttgtccaagttgaatatatttcgcatgaagcaacatttttaatgtaatctttaaaaggtactttataatttggtgctgatggatcatcaggaactccttgatgaacaataatatattctggtactataggttgaggtaatacaactcctgaggttggcggtggcagtggtttctctggatcctctggtatcttaggaggataatccccgttcaaagtattgggtggtatatttataacttcttgtctcatacctcctcttcctaaattgttttctaaattaactacttgataagcaatttgagtaggaaatacttgacatccccttattattactgtatcgaatccatctctttctacagttagatcatataaactatatggaatctgattaatattcggatctaaagaatattctacaggtggtgttggcagctctactatttgagttagtccaactacatctgtaactaactcaatattattaacattttcaaaacctgttgttccactaacagttatcctagcaccatcaatgggaatataatcatcacctctgaagcattgaatctttaatccaccaacgtctgctctaaaatttccattacttctattattcataaatttcctctttatatttttttcataatattatattctataaaagtattatttgttactatcacttctttctgttttacatatcgcctagataaaatagcatttaagtcagcttgaagtaaattgaaactattaagtgcacatacttcgccatagccccataatggattgggatacgttacatctgtacgtcttctctgagcaccttttaataaataatacttcaatctttgtccaaagagatataaatcatttcctttgattatcccccattgcatcattaatgcgcatattcctgcaacttgaggtgctgccattgaagtacctgttttactgtcatatcctccatttggtactggtccaactatctcttctcctggtgcgactaaatcaggttttactaaattccctctattttgtgctccccgtccgctaaacgacgatagattgttagttctataattatagctccctactgcaataatattgtctactgttgctggtatccctaaagtattatattggtttggttctaaaaattttgtcgctggattaagcccttcaagtactgggagccatattgaatattcgcctaaatattcattcaaaacatttatttccaatgcccatacaccttcagcaagaaatccagttctagcagaaagtattatttttatttcactatttagttcaaaaggttttggacctgatacatatatatcatatctattacttcctatagttccttgaatgtatccttcccgtatagtaatatttccactactttgactcattgggtttattacattaattgatatatcaggtaaaatcggcttatataaattcataacaattgacttctcttcacttgcaatattaaaaattttcctttgagtttttgttagttcgcctccaacatggtgtccagcatctccttcattaccagctgcaataacaatagctactctctctaggctttgaaccgttctaatatattgctctaatagactactcccatcgtgagctccatcatttgtacttaagctaatattaataactaaaggcatatttagttctttgcttctatctagtagaaacttaattccctgcataatctgtgaacttaaaactgcagttcctcttgctgctttaaccatcgctattgatgcattaggcgctgcacctctatacatagggtttatgttaccaccagcacatgcaattcctgcaacatgtgttccatgtcccgtattatcaatagacggaactatcgaatatggattagaagactttattgcttcctctatcatttgcttattataaatatttccaccagtacttaaatcatagatatattctatccttgtcgtaccagcagtattcataaatgctggatgtgtataatctattcctgaatctacaaacccaactaatactccttcacctgaaacatcaaagttaggagctaattgggcaatacaagagactctattactttcctgatcttgttcatacagactctttggcagttctatatactgaattgcattacttaatgataattgctctaacttttctctaggtatattaactacagcaaaattaaatcctagatcttgaaattttccacctaatccttcaatgaatgcttttgtttgttctggagtacccctatataagatagtaagttctagattattatcttgactttgatatttatatccaagctcatccaatatttcttttggtacattagttaataatcctattaatacgtcagctttagaagaaacttctctttgtatctcagccataacaaccacgctctaaattaatatatataaacatactatgctgacaactatctagtgaaacaattaagtatgtaaccctcaaaaatatttttcctagttcctttttctcataaactcatacacatgaatctctcccatacgacttttaataaattcaaagtactcatagtgacgatacaaaactaaaatttttgccttttagaatggttcaacacaaaaaaatgtaacactcagttcttgacagtgtaaaactgaacttatttgggtattgatcctttagaattttgtaaaaaataatgctaacctggatattatatggaatgtatattttaatcaaaaacacaaaaaatagactgaagtgaggtgttagtatgaaaatcaataaatttttagcaatttttttaatatcaataattgcatttacagaaaccccaaaagctcttgttaaatcagatgtttataaacaaggtatttatgacatttctgaagcaaacccatttcgtgctacagctaaacttgttaaagcaaatggtggcattacaagtttaagtatagttgactcaactggtaatcaaaaattttataacagattcgatactgaaaatgaatctataaatttaggttttattaataatgctgatcttatagcaatagttggtaaggggaaatagccattactttttctaaataaatagaaatttaacatatagtccattcttttgaataagaaaatccttttttattattgagattgttgcgtacattagccaaacttttctgcgaaactcttctaatccttaatttatcttatagtgatcagaaaagaataaaacctagtaatttcaatggtttataggcttataataggaaagttggcttaagtaagattcaagttaaatacaataaaaatataaaaaaacaagagaatataaaatggatcctgtgtcaaggacactataaaaaaagtgttatgaagctaataaaagatgatttctatattgtttaggagtcatcttttttagattccactgatatctgtaattattataatagttgatgtagtcatcaatcatatcaataagttcttcaagtgtattacatgattgaaagtctatttcatctttcatatgcccgaagaaggattcttgaggcgcattgtcccaacagttgccacgacgagacattgattgaccaagattattatcctttagaagtttttggaattttggactagtataatggaatccttgatctgaatgaacaaatgcactttcatgtaagtcatctttatggtgcgttattaatttatttatagtagttatagcaatatcaagttttatagaatctgaaacatgataagctagaatatcgttgctactaccatctttgatggtagacaaataagccatatgattatttccatatggcaagtatgtaatatccgtcaataatacctttcccggcactccttgcttaaaattacgttctaataagtttggaactactgtatgttctttggttgcttttgccattcggcggtacgggttggcttttctaataggacatttaatattatattttctcataatacgttgaattttctttctactataaattatagaaagctcattttctaaaaccatttttatagaacgggatcctttgctataacctttgtaattataagccataagaatattgtctctagcttccaaatctttattttccattaatatttgattatcaagtgtatttagataattatacatatcccgagcgtgaaacatttaaaagatcacagaaatatgaaaccatatttttatagctattattagtgatagtttcatatattaacttaaatatctccttaccttctagatttacgctgctgtttaccagcctcctttctgtcacgtctaatttttttaacagttctaattgctcctctaataacttaattttagcttcttgtttttgaataatatcatctttagataattgcttttcacttggtcgtccagagttttctttcctagtatctcttaatcctacaataccctcttttctataagatcttatccatctagctgccgcttgttcgtatcttctttgtccaaggatttgtgtatcaaaaccagcgtcattaaaaataattttaggtgtttttccttttaaatattcttctataaataatcgcttaaactcgtcagagtaagttatagatttttcacttactttaactacataaggattttcattcagtaattcaatagtttctttatcaaatgttatcttactcatgtttttcctccaatatagatattattattatacaaaaaagtacctataaacgagacactttttttcaaagtgtcctgttcataggtaccattttattgacgcctttgtctttttttattaattattatctttttattactatatcacacttttaatatattaaatatgacatgtagcataaaattatttgtactccagcacacttttattagaactattgttaatcaataaaaataagtaataacctaagctattacttatatatatgaatgtgtagctatgaatatttataaataactctatttcttaaccaaaagagctacattttccacatgctttgtcataggaaacatatctactggctgtacttctacagttttatatccctgctcctctaaatattttaaatctcttgcaagagtacttggatcacatgacacataaacaattttcttaggttttgcttttcctaaagcatctaaaagttttgaatcgcatccttttcttggaggatctacaactattacatctggtataatcccatcatcaattaattttggtattatttcttctgacttacctacaaaaaactctgcattattaatattgttaatttctgcattaaccttagcattatctatagcttgaggtattatttcaactccatagactttttttgctttttgagataaaaataaacttattgttcctgttccgcagtatgcatcaaagacaatttcatcaccatttaaatctgcatattctaatgctttattatacaaaacctctgtctgtacaggatttacttggaagaacgacaatggtgaaatattaaatttatattcacctatatagtcacatatatagtctgacccccaaagagttatgcacttttctcccattactaaatttgtgtctttatcatttatattttgaactatactctttatagaattattattactatttaagctgtctataagttcatttacataaggaatcttcttattagttgtaactaatataaccattacctcatctgttttaaatgcttttctaattacaatatgccttacaagtccatttttaaataattttccatcttttttagccggcattatagaatactcattcatccaatttcttattatacttactattctttctgactcctcatcttgaagtaaacaagtatccatatctataatttcatgactcttttcactaaaaaatcctatagataactttccattaacaagcccaacagggaattgaactttatttctatatctatatacactatccatacctattggatagttaacaatactttcatcaagaccaccaatttttctaatacagtcttttactcttgaaaacttataatcaagctgtccttcataacttaagtgttgtaatgtacatcccccacacatattgtaactactacattttggttctcttctctctggtgattcttctaatatttcaataagcttaccataagcaaaattctttttaacctttattatgttaacttttactttctctccaattaaagctccagatataaatacaggatatccatctatctttgctatcccttcaccttcataacctagcccttcaatatttaatatgtattccttatctttttctaccacttgtacacgtcctttttattatttatgttaactttaattcttttctttagtaattctctcaagatcacttaatataaataatatctgacctctcttattttcataaaataatttaatatcttcaacagtaggctgtttatatctatgacatgcagaacttctatacttattcaaaattataaaaaatgtgtcttctacattagtaaaatatccattttttctgcactgatttatcatatccatattgttttgaaaattatttactgataatccagaactctttaatatactagttatagctgaaaaaatctcttctctaatttgtacaaaactcattcttatactatttcctataattgattccatgttactatcatattttaatttatcatagaccgcaaatgcattatccaaatcatttaagctctcttttatatttgcatttatcgcctttattcttccataattataatataccatagaaaatcctccctacatcattgcaattaaatcttgagcaatatacattatttcatcaatatttctatcaaaccactcacaaaattcctctgataattttcctataggtcttcctgctaatacttcatttaaaaatagtattctatttttattaggtataacaagatctacttctcttcctattttttgttctaattcatactctaataagactctttgttcatctgttacatttttgcaaaaccatccaatatcaatatctgaatcttcatcaaaaaactcagtattataacttccaaatatataaataccttctgttttatcttgtggtaaagtttctaatataattttttcaattttttctttatcaatcactttaatcacaatccttacttacttacttctatgtcttatattatatcctacaaacaaatctaataaaacaaattagtcaaaataaaaaatccagactattttgataccataaatgttatcttattataatttcacataaaaaaagagcacccgaaggtgccaatacagaatcagttgccatttaattccatatataataagtattccgcattcaacgcgataatatacattatataataactataacataaataattgttaattttctgttaactttttttattttaaataaatttaacagtatacatttcaattaatgattaaaagagttaaattttaatcattataaaacatcttattgaataaatataaatagagacataattatttattcaataattatgtctctatcattcctgtttaattatataaatattagtttacgcaaaatcttaagaataactcttattttttattgttttaaaatatctatttattaaaactatttaacttcagtaacctttaataagttagtagcaccaacttgatctactggtacaccagctgctaatacaactgtatctccagctgcaacgaattcgctgttcttagcgatttctactgatttttctaacatttcatcagttgaagccattttgtcagcaactactggatatacaccccatgagaatgataattgtctagcaactattacgtctggagtaacagctataattggacattctggtctgcattgagaaattctcttagcagtagctcctgtttgagttgaagttataacagctgaagcatttaattcattagctgcattagctgctgctcttgagataactcctgaaatagctggagtatgagatttagccttagatacagctactttgtattctaaagttttttcagtttcttcagcaattttagccattgtgcttactgcttctactgggtaatctccgttagcactttcacctgataacatgatacaatcagttccatctaagatagcgttagctacgtctgaaacttctgctcttgttggtcttgggtttctgatcattgagtctaacatttgtgtagcagttactactggcttaccagcttcgttacacttcttgatgatcattttttgtactgcaggtacgttttgtactgggatttcaacaccaaggtctcctctagcaaccatgattaaatctgattctgctaagatttcatcgatgttatcaacaccttcttggttttcgatcttagaacatattaatattctttctccaccattttcgtttaataattttctgatagctctaacgtcatcagcttttctgatgaatgaagcagcgatcatgtttacgcccatttcacatccaaatattaaatcacctttatctttttcagttaaagctggtaatttaatagatactccaggaacgttaactcctttatgagttccaactaaaccagtgttttgaacttcacacttaacagcgtttccttcgatagatttaacagttaatcctactaaaccatcatctattaagattgtgtttcctggaacaacgtcgtttgctaaaccttcgtatgtaacagcacatttagtagtatcaccaactactgacatatctccagcatatactgtaaattcagtacctttttgtaattcaactttgtttggttcgaatttaccagttcttatttctggtcctttagtatcaagaataactgcaacttctcttccaagttctttagctatttctcttacctttactattctacctttgtgctcttcatggtcaccatgtgaaaagttatgtcttgaagcattcatacctgctaacattactttttttaatgtttctctgtcttcactagctggacctatagtacaaatcattttagtctttctcatttaactaacactcctctttcttggattaattataaatttatataaataaactataagctgattaagttaataactttatcataaatcttatttttttacgcaaacatgtagtaaaaagtgtgaatactttaattatgtaataactccatgcctctaatattcaaactttctctttcaataaaattaacaggaattcttgttaactttgaaattacgctaatacttgagcaatattatataattctttgtcgaatttgctttccatatctaaagcttcatctatatcttgatctatgatttcattatttctaattcctattactctagaagttttaccttctaatagaacttctattgcttttgctcccattcttgaagctaaaactctgtctgttgcacttgggcttccacctctttggatatgacctaaaatagttgctcttgtttcaattcctgtaacttcttcaacttccttagctagttcaaatgctcccccaattccttctgcaagaattattaagttatgcattttacctttatttttaccttctaagattgttttacaaagttcatctttatcaaatcctaattcaggcactatgattgattctgctcctcctgctataccagcatataaagctaaatcaccacaatttctacccattacttctacaatagaaactctttcatgagatgttgatgtatctcttattttgtttatagcatcaacaacagtatttaaagctgtatcaaaacctaaagtaaaatcagtgtaagctaagtcattatctattgttcctggaagaccaatagtctttattccaagctttgataataatttcgctcctgtaaatgatccatctccacctataactactaaagcttcaaccccataggcttgtaaaattttagcagctttttttcttacttcttcgtttttaaattcaggacatctagctgttcttaagattgttccacctctttgaattatatcagatacagaagttttatccatgctgaataattctccatttataagtccactatatcctctttgtacacccataacttcaattccgttattaagtgctgttcttacaactgctctgattgcagcattcattcctggtgcatctccaccacttgttaacacagctatctttttcattatatttcctccttaaataccttcggggacattaatcgtcccttatgtacatattataaccataatttattaatcaagaattattgtacataaaaatctattaattatcaatgatatttgggtaacttttaatattattctaaaataaatctcttaattttataaaaatttctttactagaatacataattatataaatactctatgcaactgtgtttaatgttatatactttatctttttcccacacataattccatgtgtactcttttattataaccatttaatattaaatttatataatttcttattaattttataacattcatttatgtaacaattttcatttaagtattcattaatttatgtatataatttctgaaataaattcataatttttatacataaaatggaatatgaataaaaggacttatagttaaatatatctataaatccttttatttcaaatttttaattacattttacttttataaaaattatataaataaatataattaactgtatatttcacattaattatcttcaacttttacattttcttctccaagttgatctcttaatacagatacagcatcactttctaatgaaatccacctatctctaggaactctaaatttctgtctttctctcattgcaacgagataaataggtgtatcgcccttatgctcatcttttaatatttcctttaagttcatattgagtttttttgcttcaatttcattatctgctctcaaataaactttagagctatttattttttctagtggttcaatagactcacaaagaagctttggctgttcatcttctttaatacttattcttccctttataatcacaaggctatctgtaatacaaaggcttttaaagttatcaagtgtctttggaaagacaattacttcaatggaacccgtcaaatcttcaagtgttaaaaatgccattatagtattatttcttgttactttctgattaacacttgcaagtatccctccaagtactactctatcattatctttaagaatgttctttccttcaaagatattaacatctgaaatattttcttcaagtccttcatctaaagtttcatgtactgaaaatattttagcaatttcaatagtagtctgcatttttaaactttttgcataatcatccaatggatgtcctgtaatatataatccagtcatttctttttccatagcaagaagatttcgtttgtcgaattctttaatattaggataacttacttctggattttttaattcctctgttgcgccaaatagacttatctgcccatcaatatttctctttttgtcacttgaaatactgtcaatcaatttttcgtgaacagcaagcattttagatctgtaaacattaaaattatctagtgctcccgcctttatcaagcattcaacagcacgtttatttattgttgaaacatccattttattaataaaatcaactaaagattcaaattttcctttattttctcttgcttttacaatactatctactacattagcgcctacattttttattgctgccatcccaaagcgtatagtatctcctttaacagtaaatcttgaataactttcgtttatatcaggtggtaaaacctgaattccaagactttctgcaaaatttatataatgagcaactttttcacttgtacccataattgaattaagcattgctgcaatcatttctactggataatacctcattaaataagctgtttgataacctacaactgcataggcagctgcatgactcttgttgacatcaatgttattttaaagacatttaatctttaaactttatatttctataaagatcggactatatcattatcctaaattataggatatgaggcactcgtggatatttcatcatatgatatgtgataatcacttagattactttatctagtctctgaacctttaacctgtttccaggtcacttggctgcggattaaccaatccctaaactttttactttatcctagttaattactctaggcccttaataatatttctatattaagttagtattcaaggctctaaggtctttcccgcaattcacctcatttgctttacagctcctgctgcaaaggcactctttatttcataccatttattatattttctttctaattttatagttgaatctaaatataaatagttaaatatataatcaaactccttttttgcacatatatttaaactttttatctgttctgtttttgtatttctaatctttgcatatttaaactctgcattacttattatctgtttcaaaaagtttttagttcctaatatagtgaaattatatgtcggatatacatattttataatcccatcataacttttataatagctagagttatgtgataataatatacttccatctccatcaaaatatcctcttataaaatgccttactagctcttctcttattataggaatactatcaattgttagtgatttattaggatataaccctatattccttaatctatcagccattattctcgaagaaaaatttaatgaatacccacatttagaattagtaaatccaccttttttagtttttctaatttctcctgtaaactcaatttcttttactataaattctaatatttctaaatcattaacagcaattacgatattattaaaattctcatttccaacaaatccatctgcataaataaaacctaaaatataagctttagcctctgtattaatttcattaaagtaattttcatttaatacatatctatttttcaatctagtgttaacgctcttttcttgtaatactctacttatactacgtcttgatacattcaaatttctagctatattattcatatttacttttttattcaaataataatattcaactatattttctttatctttactagttaattgattataatttttagtcatataacatacctcgaatttataatgccttattctagtaataattatttataataaattaatattttccaaatgcataacttgcaaagtccatcatgttatcaaaaattttatttgctacgttttcgcttattccatttctaatacatcctggaacgacaacttcatcattttcaataattccatggataaagttctttcgctcttcttccattactttatgtttcttctttgacatggctcttctaaccatatcactacgtcccatggaatatccggctaattttctaactatttccattacttgttcctgatacaccattactccatatgtgacattaagtatactctcaagttctggagtttcatactcaaccttatctggatttcttttacactctatatatctaggaatctctgccataggacctggtctataaagagatattcctgcaattatatcttccaggttatctggctttaattccttcatgaatgatgtcattcctggcgattccaactggaacacacctgctgttcttccttcaccaatcatcttatagacttctttatcatcaaaatcaattttatctaagtctatatctacgcctctatttacctttaccatttttattgcatcactcattacagtcagagttctcaaccctaagaagtccatcttaagaagtccaagctcttcaagtgtattcatcccaaattgggttactatactttcatcatttttttgtagtggtacatactcaactaaaggctttgatgcaataacaacacctgctgcatgagtagatgaatgtcttggcagtccctctaaatccattgatacatcaataagattctttactctctcatcactgtcataagctattttaagctctggattaaggtctaatgccttttctattgttatccctaacattgtaggaatcatctttgctatcttatcaacttcagaatagctataattcatagctcttccaacatctcttatacataatcttgccgccatagtaccaaaggtaattatctgtgatacacaatccttaccgtatttgcgtacaacataatcaattacctcttgacgtctttcgtaacaaaagtcagaatcaacctattaataccctttctttcgaaatactttaacactgaataatgtttcagtgggtatagactatatcttctcccaccgacctttacggtttgggatgccccgcttcgcaaatgtaagaaacataagctacgtgcctttgcactagtcgttggacctttttctattcgaaacttggctgctggttatccaattcctttaatttttatggttaaaccaccgtaacatttaagcttatttcatccttctgctttggtttaaaggactctaaggactttccagcaattcgaggctctttaagcatattatttctaatatgcacgactattaattggctattataattacatgctctttaacaatataaactttttatattttctgtctaaatagacttcagatttatcatataaataattcattacagatagtgttttatatcttccaccaaaacttaaatagtaattatttttgttgtctttttttctcttaaataaaacattcttaaaagaatattttgaacagctattaaatacttctattaacttttctaaaaactcttttgttccgcaaattttaaaattaatagaattttttgacaacaccaaactaccatctccatcaaaatatcctataataaagtgtctatagtatatttcatctaacatatctttattaggatattttataattagtgatttattgtacactactccctttaatttgatatctctaacaagtttaggactatttatcaatattctgcaatactctatagatttgtaatttgaatttgacatatatgtatttattggatatgttgctttaatgcacttcttaaatttttctagatgttctatatctctcatagccaatgcaataccaagcttatttgctgtaatatatccatccgcatatataaatccaagccaataagctttttcttctgaatctatattataaaaaaatgtttcgtcacactcatatattatatgactttctcttaaatttcttgttttaacattccatcttcttaaagaatcatatattccacataaactatatcccaatttcttagaaatatcattacatgacatttttttgtttatatataaatctattattttatctttgtttttatcaagttcatatcttttagccattaattttctcctaaaaaaatatatatttttaggataaccaatttttaatctggcatacttactctttccggatttaggaatctttcaaatataagactatattttataggatctatctttgtaattcccaaagtataagctacaattgacccagccgcactccctcttccaggtccagtaggtattccgttatcatatgaaaactttataaagtcccaaacgataaggaaataatcaatgtaccccatctgctttataacacctagttcgtattcaagtctatccacaaattcctgtgcttcagatgagttttccacaattttattcacttcatcataatcaagttctttttctcttagatccttaaacacatcatacctgtcaataagacctgtataacacgtttcttttaagtactcatatggatcatccttgccttcaggaagtggaaatttaggcaatttagactcatggaacttatatttgaagttacactcatctgctatcttaaccgtgttctcaagcgcttctggcatatatgaaaacatatcccacatttcctctggagattttaagtaaaactgatctgacggatatctccttctattaggatcatccaccgtttttgctgtctgaatacacattaaaatatcatgagattttgaatcttctttttttatgtaatgaacatcattggttgcaactaatggaattcctgtttcttctgcaagctttatgtttaattcatttactttcttttgctcttccattccatgattttgtatttctaaatagaacccatctttaaagatatctttatacattagagcatctttctttgctttttcataattatcattaagaagatcagactgaacctctcctcctaaacatgcacttaatgcaataataccctcactatgattttttaaatactcatgatcaattctaggcttataataaaatccttcaattgaagccattgatacaatcttcataaggttctgatatcctatttcattctttacaagcaaaacaagatgatgagttgaattttccttatctggctgttttatatgcattgactttgcagcaacatatacttcacatccaagtatagcttttattccatactcttctgctgctttaaagaaatctacaagtccatacataacaccatggtctgttatagctatgctgtccatgccaagttctttagcctgtttcataagtttcttaatctttccagaaccatctaaaaggctatactccgtatgtaaatggaggtgtacaaactttttttcattctccattaagctcctcctctcttaatcactatttatattaaattttaatatatatgttgaactatgaaatttgcaattgtaattataaattatgtagtaatttccacattaatttttattgtcaaatgtcaattgcaatgtatattcatcttaattataacaatcatgaataaatttttatatagctaaaattacactgaacaaactataaaaaaagacttatcaaataaaataagtccctatatgctttattatcatttttcagttcattaacaaattttgcttcatccaatattatcaccacactcttttatattatatcctactttcaaatgttctaaaacacaatattctaaccatcatatctaattatactttaatataaaaaataaattttcttgtcataatcaatatcttttaacatacatatttgcttctctcccatttatctacaatagttttttttgtatgttattctattataccaaaattcctttttttaatattttaataaaaatttgtaattaagccttttttatatattataatacttatagctgtatagcattgttatgagtgattgaatactttaaattaggagatatctacatatgccaattataataaaatttattacattctttctattcctaaactattatctaagtagaaaaaatttacaattattaatgctattattattttttttcattgatttttgtagagttctttttttagataaaatgctaaatcccaatttattatcttttatatctataatacaattaatattaatttcagttgctattgtattatatatactatcacttattaaaagaaaaaaagatggccataattgattaattatttaaatacaactcagatcttaactcacaaataaaaataatttatatagaaggagaaatatagtgaataaaaaatatcataatttaataaacgaattacaaaaaacactagatgatcctaaagttaaaagtaaccaagaattaactaaggttttaatatcatataagtataaattagaaaatggtgaagaatatagactagtttgtacaaaattaactcgtattatctcatcatacgttcgagaacataattttaaagctccagaatcagttttaaaattatataactatttagcaaatggtgatgcacaatatagaggtttagcttcatttattacatggttctaagtttttaactcaatattctatttcagctttttactattttttaagaataatttaaacacaaaaaaacttggagtacccttctccaagtttcttttctcataaattctcttttccttatatactagaattgattgttcatcaattccttatgtatttattatactataaggttttcgttttgtaaaccttttcttgaataataaaaaaataatagttatatattaaggatcttaccttcatggacaattgtcaattgaaacatataactattattatatttaatttagaaatctaatgtcttactacattcaacatatggtcctataaccttcttaaccttctccacatggaactcattaacatcgtaagccaaatactcatctttagaatcaaatcttgttataatgcctatattgtagcttctatcacttcctacaacatcaacaccaacttcaagctctttcaattcagcaatattgcctttcattgataaaaatgttttctttaaaaattctaaattttctgttgttggttctttaactttgaataatacaatatgtgtgaacataaaatctcccccattcttcagttaagaattaacagttgtcaattaacagttttggttaacattcttacaaaatatctttgatttaattttttcatcataaatatataatataaaaaatctcttagagattttatccttaaactgctaactgttacttgttaactgtaatctaacttctaagctcttcagctattttttcaatttttctaagtctatgatttatacctgattttccaactggaggatcaagcatttctccaagttcttttaaagattcatctggatagtttaatctaagttctgctacttctctaagattttcaggaagtctctgaagtcctatctgtgattgtataagcttaatgctttcaacctgtcttactgctgcatttacagtctttgaaagatttgctgtttcacagttaacaagcctatttacattgtttctcatttccttcattattcttatattctctacttctaataatgatgaatgagcacctattatattaagaaggtcaacaatctgctcgccttcctttatatacacaataaagctgttttttctctgaataacctttgaattaagcttaaaggaatttaccagattacataaatctcttgcatattcctcactatgagttacaaattcaagatgataagtcttttctggattacttatacttcctccacctataaaagcacctcttatataagctctcttcatactatcatcatcaaaaatatgacgttctattctatagtcaagactcattatcccatcaatctcttttaaaattcctgtctcgctaagcagatcccttacgcccatttcttctgtaataactaccatgtatatgttattcttcttaagtgaattgcttttcttaaccattagtcttgaatgaatatcaaagtgatcctttaacagggtaaatataagcctggcactagctggattctccgtagtcatcttaaagcttaatccacttccactaaaagctaatgtcccactaactttcattattgctgatatttcagaaagagcttcttcctttgaaatatcaacatatctgcatatttctcctttaacttttgatgaaaatgacatgttttttccttccttatcctaattaaatttcgccttgtttacctttttcttctctatctctagcttttactctttgagataaatacatatattcaataatcttcttcttatcgtatagaagtttcttttccataatagtatcagctaaaacttctgcaagcttatctgaatcatgtttaactgttccattttgtattttaaccagattttcacctactatttttattcccatactcttgatatcttcttcatcaagtttaacaagttcagcgccttcctgattatatttttcctttagttcttctgttatttcacctgtgtttacaattgcataatctacaatatctttcccaccatatttacgtaatactttcaaatggtcagatactttaaaaccagttgtttctcctggctgtgtcatgatattagatatatatatcttaattgcattactttttctcactgccttagatatatcctttacaagtaaattagaagttatactagtataaaggcttcctggtcccattacaattgcatctgcttcttttagagcatccaaagcttcttttaaaggttttgcattttcaggtttgattctaagttcatcaattcttgaattttgctttattgcttcttctggtatctgtgattcaccttcaactatatttccattttgaagctttgcaataagctgcatattatctaaagtaacaggtataactttacctgttacagcaagtacagaactcattttctgaacagcttcttcaaaattatctgaaattcctgccattgcagcaagaaacagattaccaaaactctgatttttaagtcttccatctttaaatctatattgaagtaaatcttccattaatggttctgtatcagcaagtgcaagaatacagtttcttatatctcctggaggaagcatcccaaggtcttctcttaaatctccagaacctcccccatcatctccaactgtaactattgctgttatattagaagtatagtacttaagacctctaagcattgtagaaagtccagtaccccctcctataacaactatcttaggccctttaactaaaagtctcttttcataaatcaaactttcaattttttcactatctaatgatacctttaaatatcctttattaataagagcaataactgatttcatagtttcagtaactgaaacatacaatacaaataatcccgttagattcaagaaaatataaaataccttgtaataaaaatcatataatctatgtgttactaattcagtaaatccaaatgctattaataatactccaaatactccaaatgctaaccaacgcttaactttaatccctggtttaagccaatctcgtattctcatagtttcttttcccctttatgaagatcttctgtcacatctctatgttctatttttgaattataactttcagaatttaatctttcatataattcatttgcaattgcaacggaacgatgtcttccgcctgtacatcctatagaaattattaactgtctctttccttctttaatataattaggaattaaatatctaagcatatccattaacttttctataaacgtctttgtttcaacctgctttagaacataatccttaactggttcatcattacctgaatactgctttaattcaggaatataaaaagggtttggtataaatctaacatcaaaaaccaagtcagaatcaactggaataccatatttaaatccaaagcttaaaactgttacggtaagttgtttttctggataagtattatctccataagactcattaattttttctcttaaatgccttatttcatattttgtagtatctattatcatgtctgcagcatttttgatttctcgaagtttatctctttcaagtgttattcctgttagaactcttccatcaggtgataggggatgacttcttcttgtttccttaaatctctttattaaaacctcatcggttgcttctaaaaataatatttcatattcaaattcattatctttaaggtatttgattgatccaaagaaatcatcaaaaaatactccgccacgaatatctataactaacgccactttttctatatttccattgctttgcatacatgcttctgcaaactttggaattaatttaggtggaagattatctacacaaaaatatcctaaatcttctaaagctcttgtagcttgtgttttcccagctcctgataatcctgtaactataacaaatctcattattacacactccccttttgctaaagatactttttcaatattaaaattataacataatattatagtcaattgataaaatactttactatcttaatttttaatttgtatttacataatatatattttatactaaattttccgtattaaactcaaaagaattctatatggattttcaacttaattttccattgtcatatgtcaattgtcaactgcaatatatacctatattaataattattaatagtttttcctaaatataaatggaactctcaagtttataaacttttgagttccattaactaatcttattaatattaatcttcgcctaaaattcttacttctggatgaagctcaacaccaaattgtctcttaacttcttcttgaacatgatgaattacatctaatacatcttttgcagttccattagctttattaattacaaaacctgcatgcttttctgaaacacatgcaccaccaactgtatatccttttaatccagcatcttcaataagctttcctgcaaaatgaccttctggtcttttaaatgtacttccagctgaaggatattctaatggctgtctgtcttctcttcttgtagttaattcattaactcttgactctattttatcatgatcatcaggagttaatttaaatgtagcacttaaaactacatatcctttttgcataactacagattgtctgtatcctaaatttaattcttcctttgataaaactcttatttcttgattatcatcaagaacttcagcactttcaattacaaatgatatttctccatcataagctccagcattcatatatacagcgccacccacactgcctggaatgccacatgcaaattggaaacctgctaaagctgcttctgttgcttcctttgaaacatctttaagtaaagcaccagttccagctttaatcttatttcccatacgttctattttattaagatcacatactttaataacaacgcctctaattcctccatccttaactaaaaggttagatccatttccaataacataaaacggaatattattatctttacaaaccgtaatagtttcttttaattgctctatattatttggagtcaaaagtatatctacaggccctccaactttaaagtatatatgttcactcatttttgcatccaattgaatttgtgactcattatatattttactaaacaagtctttatattttccatactgattcatgataaaaactcctcaaacgctaatattaatctattttttcatattgaatataacaacttatatttaatatgtattaactgactaaagtattttttgtcagtttcactttatttacatcatatagaataatctatatattaaagtaatacaagtaaatttttattcaatatcctttaatttaagtaaatatttattccgtattattatagcatagtttaattattttgttcatggtttttaaaatacgccataatgcttgttgcggccttattatctatagattctgtttctagcagttcctctacagttgctttctttatattatctatacttccaaatttcattaaaagagccatacgtcttttttgaccaatattaggtatatcatccagtattgaatgaagtgtctttttatctctcagacttctatgatatgttattgcaaatctatgtacttcatcctgaactcgtcttatcatctgcataagattagaagttctatttattataagttctttattattataaataatccctcttgttgcatggtgatcgtctttaacaagaccacaaactggtatatttattccaagcttctgtaatacttcaagggccacattaacctgaccttttcctccatccatcataattaaatctggaaaattagagaacttaccacttgaaaatttaagctgcctttcctggatttctttaatttcttttaaaccatggctaaatcttctttctaatatttctctcatactatcataatcattagcattttttacagtttttatacgaaatcttctgtaatcactatttttagcttttccatcttcaaaaacaatcatagacccaacagaatcaactccctgaatatttgaaatatcataagcttctattcttattggcatagaatcaagttctaataattcttgaatttcttcaaggcagagtctatttatttccttatctcttaaaatcttatctttaaactgatccaaggttacctttgcattgctcttaacaagctcaagcatttccttcttttcacctttaataggtaccttaacaaatacttttgatccacgtttaattgttagaaattcttcaagtgcatcattgtcatcatcattgcttaatggtatatatatattctttggaaccttaggtgttccaccataaaatgatactataaactgagatattataactgaatcatcttcataagcactgttttcaagaatgaaattttctcttcctgtaacttttccatctcttaaaaagaacacttgaactgcacagtctttttcatctttatatatatttataaagtcttcatcattatcttgtgatttaaataccttttgtttttcagctatactttcaattgctaaaatcttatctctaaatgatgcggctttttcaaattctaggttcattgatgcttcttgcatatcatttttaagcttattaataagacttttatctcttccactcaatacatctataatctcatctatcatacgtttatattcatcttttgaaatatgcccttcacaaggtgcattacacttttttatatgataattcaaacaaggtcttgtatgtttaccattttcaaagattaactttttgcatgttctaagtggaaatatttttcttatgagttttatagtttcatgaacagctcctgcatttggataaggtccaaaatacttatttccatccttagcaaagtttcttgttataaatactcttggaaaatcctcatttgtcgttatttttataaaaggataaaatttatcatcctttagggaaatattatatttagggctatgtttttttattaaattacattcaagaattaatgcttccatttctgaatctgtaactatgtactcaaattctgcaatgttttttaccattgcttttactttttcagaatgattttttgaattctgaaaatattgtcttactctattttttaaaacttttgctttacctacataaataatttcacccaggctgtttttcattaaatagacacctggcttgtcaggtaaaatcttaagttgagctttaaaatcaaacattatatacctccccttttcctcagtttacagttaacagttaacagttaacaattttcagttagcttatctttattaataaattttatttttaaaaaatatgtttctattaaggaacttatctttaattttatattaggcagatactcgtttagaatatctgcctaatattataactataaaatttttcaaaaattttcacttaaactttttagttcttccttgataactgctaactatctaagtgctgtatttattacatttcctgcaacttgtgctgctgctgtagaaccataacctccattttcaacaattactgctaaagctatctttggattatctgctggtgcaaatcctataaaccatgaatgtggttttgcaggtgttccatttggaaggttataatctgctgttcctgtcttaccagctgcattagtaccttggaaataactccatgatccacttactttagaatcaacaagattcttcatataatcttttattatacctgcatcagtactattcataatctgtttacgaactttaggttcaacagttttaactacatttccatctttgtctattactttactaactaatgtaggtaccatcatctttccatcatttgcaatagtacttgatactaatgccatttgaattggtgtcgcaagtatactactttgacctattcctgtctgagcaatacttcctttttcacttgcagttaacgttgggaatctactgttttcaattgtaattccctctgcttctattgaattattgaaaccataatcttctgcagtagcttttagtttatcattaccaagctccattgcgagtgtaccaaaaactacattacttgatactttaaatgcttctcttaaatcaatagtaccatatacagcattattagcattacttaacgactgtttatcattaaatactatctttccttcatcattaaaggttctatttgttataccgcctatattttctagagcacttgttaatgtaattgtcttaaaggttgatccaggtggatataacccagctgttgctctatttataagtggtgaattatctgcacttcctgcattagctgcatccattgatgcctttaaatcattaggattatatgttggtttagaaaccatagctaatacttctcctgttttaggatttaatgcaacaacagctcctttattacttccaagagcattatatgcagcctgttgtattactggatctaaagttgtaaccactccatttccaattttctcttcatcttcttttctttcttcaaacatactttttaatttatcaatactaaaatcattaataagacttgaaaaattattttgaagtttgctataagttgatagttctttattatattttgcttcaagtccaacagctccatatattgaactattgtatcctaatgcatgaacatataaatcaccttttgtgtatgttcttttttgagttaatgcatctattctttcgcttgtagttaatgcattaccatttctatcataaatagttcctcttaaaacttcatttgatgctgcataaattcttttatttcctggctgttccgctatacctggcgctgaaaatgtttgaaaatatgcaatataagatataagagctacaaagcaaaatagaaaaactatcattacttgttttatactatttgaattatccttcattttagccctcctccgatatcttctgaagtatagctagagcaaaaaacattgtcagcattgaagaaccaccataacttataagtggcaatgtaatacctgttaatggaattacagcaaaaacccctccaataataactagtacctgacatgcaatcattgcacttatacctattgtgttcagttgtgaaaatttatcttttactctaaatgccgctctcattcctctatagaaaaataagaagtatattatcattattccaagtccaaataccattccaagttcttcacatattactgcaaaaattaagtcagaagtattaactgggacaaatcctggatatccctggcctaaaccgctcccaaacattcctcctgaagaaattgcataaagaccttgaataatctgatatccggcattattcggatcactccaaggatctctccatatatctattcttgcctgtacatgagaaaataaatgatatgctgcaaaagcacctataactgataaaactactgttactgctacatattttttcttacctgtagagacgtaaagcattgtaagcgctataccaaagaatattaaagctgatcctaaatccttctgcataacaagacatcctaaagagaacattgaaactaaagcaggttgccataactgcttaaaatcctctaacatatcctttttatcttcataattcattaatgctgaagataaataaagcacaaaggttatctttccaagttcagatggttgaaagctaaatcccccaattataatccagttagttgctccatacacattagttcctgcaataagtgccattggcattattactattgttgaaattaaaaatacatttttgtattttgaaaaattccgtatatctggaattgcaactacaagacctataaaaacaataatccctgctgtaaaccacataaattgctttattgccacacttgtatctagtctatacattactgctattcctataacagaaagtatgcaagcaaatgtaataagaaatttatcaccctgtggataaaacttacgtattaatacttgtgttgctgttacaaatgcacatactattaatcccatttttatggcaccagtatccattggatcttttaaaattgctaaattaataaaaagagccatgcaaagtatgtatgtaagaatcagcaatacaatttcatctttttttattttcaatatatctcacctcattttcaattgacaattgaaaattgacaattgacagttactaacgaaaatcacagctttccttatgtgttagcaaaaatagtaattctattttctctagtatcaactgctaatttttatttttaaaataacacatttttctaagactcagctaaatacctaaggcaatacctgctgagccttaattaattatgttaaaatcttaaatactccgcttcctattcttatttcatccttattagacagcttagctcttccttttaatttatttccatttaaataagttccattagtactatttaaatcttctaaaaataaaccattatttctaactaaaatctgagcatgattacctgaaacatgttgatctgccataactatggaattactgtcttttcttccaatacttaagtctgaccttattggaattattgacccttccttaagtccattggcatctccactttttattatttctaagccataattaccgttagttcttggtggccttctctttttaccgccattcttaacgtccttatacattattttcaaagcatagtatattattacgtataatatgatgataaaaataagtccaaagactaatcctaccatttttgaaaaactcatattttcacctcaatatctatttgctatatcacatattgattatacaacaaaaaatttaatatgacataagaaatgccacttttgtaataatgaattcataaattataatatatttcttaaatattttccagtgtatgatttttcctctttgcatatttcttctggagttccacacttaataatagtaccacctttgtctccaccttctgggcctaaatcaattaaataatctgcacatttaatcatatcaaggttatgttcaattacaacaacagtattaccagcatcaacaagtctttgaagtatttctactaatctatttacatcatctatatgtaatcctgttgtaggctcatctaaaatatataatgtttttcctgtacttctctttgataattcggatgcaagctttattctttgtgcttcaccaccagaaagttgtgttgatggctgacctaatcttatatatcctaatccaacatcatttaaagtcttaagcttattttctattctaggtatattttcaaagaacttaagtgcttcttcaacggtcatatctaatacatctgaaatacttttacctttatattttacttctaaagtttctctattgtatcttttgcccttacaaacttcacaaggcacgtagacatcagacaagaactgcatttctattttaattattccatctccagaacaagcttcacatcttccacctttaacattaaagctaaatcttcctggtttatatcctctcattttagcttcatttgtttgtgagaaaagttctcttataatatcaaaagttcctgtgtatgttgcagggttagaacgtggagttcttcctattggactttgatttatatctattatcttatcaatattttcatatccttgtatctctttatgtttaccaactggattcttacttttatttattattttatttaatcctttgtataatatttcattaacaagagtactctttcctgatccagatacacctgtaacaatacttaaagttcctagtggtatagaaatatttatattttttaagttattttcttttgctccaataacttttattagattaccatttcccttacgtctctcttctggggccttaatttctttctttcctattaaatattgaccagttaatgatctttcacaatcctttatttcttctaaggatcccgcagctacaatttcaccaccatgttcaccagctccaggaccaatatctactatatagtctgcttcttttatagtatcttcatcatgttcaacaactattactgtatttccaacatctcttaaatttttaagagtctgaatcagtctatcgttgtctctttgatgaagtccaatacttggttcatcaagtatgtataatacccccataagagatgatcctatttgtgttgcaagccttattctttgagattctccacctgataatgtccctgagtttcttgcaagacttagataatcaagaccaacatctaataagaactgtaatctatttttaatttctcttataatctgttcacttattattttatctttttctgaaaactcaacacaatttataaaatctaattcatcctttatagacattattgtaaattcataaatattttttcctccaacagtaacagcaagagcatcttttttaagtcttgcacctttacatttaggacagtgagcatcactcatgtattgttcaatatcaccttttataacatcagaattagtctcattgtatcttctcttaagagaatttatttcaccttcataagaataattatatgtagccttaacaccatcttttacataatcaactttaattctttttccatcagttccatataacaataattcaacttgatttttatcaaggtcttttataggtttatcaagctcaagaccatattctctacttaaagcctgtagtatagcatatgtccatgaatcatcttttaatcttccagcaccccatgttgcaacagcgccttccattatgcttaaattagaatctggaataacaagcttttcatctatttctataagagttccaagaccatcacaatgatcacatttaccaaatggagaattaaatgaaaataatcttggagcaagttcaccaatacttattccacaatcaggacatgcaaagttttcactaaataaagtttcttcgccatcaataatacttgcaattactaaaccttctcccatttttaaagctgtttctattgattcagtaagcctaccttcaattccttctttaataacaattctatctacaactgcttctatattatgctttttatttttatcaagagtaacttcttcctcagttagatcataaatttctccatctattcttgctcttataaatccatttttctttatgttttctaataatttttcatgagttccttttcttcctcttaccattggagataatatctgaagtttagttctatccccataactcattattttatcaacaatttgatccacagattgtttagttatttcctttccacacttaggacaatgtggaataccaactctagcataaagcaatctcaaatagtcgtatatttctgttattgttccaactgtagatctaggattcttacttgttgtcttttgatctatagatatagcaggtgataaaccctcaatatgctcaacatctggtttatccatttgccctaagaacattcttgcataagaagataatgattccacatatcttctttgtccttctgcatataaagtatcaaatgcaagagatgacttacctgacccagataaccctgtgaaaacaactaacttatctcttgggatttctaaacttacattttttaaattattaacttttgcacctttgattactattttatcgttcactaattacaccccttttttcagttaacagttaacagttatcagttaactgtttttaatgaaatcccttaagggatttctatattttatttagtaattagattgctttttcaatctattttaatccatcattataattaaaaagccgaaagcttttctatataactgctacttgttaactgttacttgttaactgtttaattatgtctctaagttctgccgctctctcaaattgtaagttctttgctgcaagcatcatttcatttgtatattctttaataagcttatctctttgtttcttagtaagcttcttattttcatcagttttatattctgcagtatcttctgcaacttttgtagcttctataacatctcttacatccttaattattgtagtaggagttattccatgttcttcattatatttcgtttgaatttctcttcttctttccgtttctttaattgccttattcattgatttagttatattatctgcatacattataactctactctctgaatttctcgctgctcttcctattgtctggattaatgatgtttcagatcttaaaaatccttctttatctgcatctaaaattgcaacaagagcaacttctggtatatcaagtccttctcttaaaagattgattccaacaagtacgtcaaattctccagttcttaagtcttttattattttcattctttctatagtgtcaatctcagagtgcatataagtagtctttactccaagctctgtaagatacttagtaaggtcttctgccatacgttttgtaagtgttgttacaagagttctgaatccacgttctgttgttttatttatttcaccatataaatcatcaatttgtcctgttactggtcttattacaatttctggatcaaggagtccagttggtcttattatctgttcagctatttcttcagaattatcaagttcatactgagaaggagttgcactgacaaatacaacctgctttatcttcttttcaaattcttcaaactttaaaggcctattatcatatgcacaaggaagtctgaatccataatcaactaatgtattttttcttgatctatcacctgcatacatagctctaacctgtggaagtgttacatgactttcatctatgaacattaagaaatcttctgggaagtaatctaagagagtttttggtggtgttcctgaatctctgccatctagtattcttgaataattttcaattccactacagtatcccatttcttttatcatttcaatatcataatttgttctctgtcttagtctttgtgcttccaaaagcttatcttgagaattaagttctcttaatctttcttcaagttcatcttcaattttccctattgctctgtctacggtttctttagatgtagcaaagtgggaagctggagttattgcaacatgatttctatctccaattatacttcctgtaagtacatcaaattctcttatcctgtctatttcatctccaaaaaattcaattcttatgcctttatttgaatatgatgctggaataatatctaaagaatctcctcttactctaaatgtacctcttgaaaaatcaatatcatttctctcgtactgtatttctactagtttctttattatctcattacgttctttttccattccagtccttaaactcaacgtaagctttttatattcatctggattaccaagtccgtatatacatgaaactgatgccactattattacatcacgtctttcaaacaatgccgatgttgcagagtgacgaagtttatctatttcatcatttatagatgcatccttttcaataaaagtatcagtctgtggtacatatgcttctggttgataataatcataataagatacgaaatactcaactatattatctggaaaaaactctttaaattccgaacataactgtgctgcaagagtcttattgtgtgcaagtactatggttggcctctgaagcctctctataatgttagccatagtaaaagtctttccagatccagttactccaagaagtgtctggcctctatgatcatggtttattgaatctataagtttttctatagcctgtggctgatcacctgtaggcttaaatttcgaatgaattttaaactctcccactttaattcctcctatccataatttttctcgaacaaacattcgtaatatatttactattgtacttttccttattcagtaagtcaacaagttattatataaataaaacttaatatatttcgggtttcgatttataattaatccagttcttatattcttattatgtacaaaaaattcaagcaatttcacataactgcttgaattttataaatacttttaattattgtttttatttacgttattcaaaatatccttaaagcttttttctcttatctctgaatcatcagttttttgagattcactcttattaaacggtacaaatagagctccaattctactattatcatgtacataatttacctcttttataacaccgttacaatcttcaaacttaattaccgctctcgataaatttttcttaagtatagaataaatatccctttcactgtttaaagattcattattaacagaaattattttgctatttatgtccatattgaaatcttttaatttaaaattattacctatctctaaaattacaagcccattttcatcacttataaatttaggttgccttttcatttccttatttctctgaatcttaagcataaattcatgggcaactggtgcaaaaataaccacaaatatttctcccaataatcctattcttgctgcttgagccacaagaattaataatactccataaatagaaatatgtattcctgatgatactgctttttctcgttttgttcttgtatatgtaactgatgaatatccaacaactgcataaaaagacaacaatgatataaatattgaccttaataaatcaatctgatcttgagatttaaatagagtccaataagctggtatatcatttaaagatacattattaaatccaccatacaactcacttatattagccataatcattatagctaaaggaagtatccagtatctttttaatgaatatccacctagaatttcattttccttcttaataagtataggaactgctcccctatgaccatctaataagaccaatattccttcaacaacatgcataactccaacaaatatcattatataaagtatgtccaaattaaaataatttgtataatttatatcagaagatatcattccatatatcttcaatataatgcttattgctcctaaaactgaagctgaatatgaaaaacatactaaagatggttttatagccattaatattattgatgtaaaaaataatatctctattctgcagttttcattaaaaacaactccacataaatttaaaattacacttcctataatcccccaaatactccaaaaacaaattgagatagtgtaagttcaattgccgattctacactacctccaactatcattttctgcattgctgctctttttttatttttaaaataaaaaacgacaagcagtgctaacaatataaatactgatgggggaataagattgcactacatatacttcttaaagtagaaataactatatccatacaataattcccctttttatttaattcatttttttatttaattcatctattgcggttttcaattgcttatcttgatctttattatatccttgagaatcaagcttattatctgttgaaacttcaacatcaggaacaattcctatcttgtgaatattttctccatttggtgtgtagtattttgaaattgttactttcagtcctccaataccattgttaaaccttactgtctgctgaacaattcccttaccgaaagttgtgtttccaacaattgttgctgctttataatcccttagagcacctgtaacaacttctgatgcacttgcactatcttcatttacaagtataactaatggcattccttctgcaattcctccaactgataaggattcatttctattttcatatttgtctacagtataagttataattttatccttaggaataaattgcgatgcaacaccaactgcttcacttaaaagacctcctggattttctcttaaatcaactataagacctttcatcccctgtcctttaagttcttcaattttgtttttaaaatcttctgttgtgttctcattcataaatgagtgaattcttatatatcccattgaggaatcaagcatttcaccatcaattacacttaattttacttcttgaggctttattacaacatcaaatggattagttccttctctgtcaattgtaaacttaatttcgcttcctacagaatttgagataacacttacagcttcgctaagctgatcccctgtatatgcaacatcatttattttttctataacatcattgctttttataccagctttttctgctggtgaatctttaattggtgatacaataactattttattatctaaatttgcaatattaacaccaatacctgtcattgaaccattactctgttttattaatttttcaaattcatcattattcataaacactgtgtatggatcatttagtgcacttgtcatacctttaatagcaccttcaagtaatacatcatcatttatttctccatcatacttttcaatcaatgtatctcttactgtaaataatgctgaatatttactggcatcattaatttgagatgctgtactcttaacgttttctgatgttttcacaaaaaatatgcctttagtagctatatagtttccaatcattaaagaagatacacttaaaattatcatcaatgatgcaatcaatattattgacttttttgaagtttttgtattattccttgcaaacgttccttttttcgacttcctcatgtataaaacttccttccccatgtataaaactatacataaaaatcataataaattagtctaattactatgtaaacccctataagaaaagtaatcttttctcatagaggcattaacactaattattttatgctttttttcaaaaattatactattaagaattttcttaaagcaattacgctggcaattccaccaaccacaattccaccaattgcaaactgccataataaattacttataatatatataggatttactatgcttacaaatgataacatggaagcaatccaaacaaatactcctttatatgcaaagaataatgctacacatgcaaacactgctccaacaagaccaattaccataccttcaatgacaaacggccatcttataaaccagtcagtagcccctacaaatttcattattccaacttctcttcttcttgaataaacagtaagttttgttgtattcattattaagaatatagaaacaccaactaatactgcaaacaatcctatacctacagtttttacacctttaactataccaacaaccttatcaactaattcctgttgatcttgaattgaatctacgccttcaaaatcttttattccttcacctacatttgaagcatattcaggcgattctaatttaacagtaaatgctgcctggaatggattattatcaaatgtgtaaccttttaataatccttcattttcattagtagtttcttggaaatttctgtattcatcttcttttgaagaatatgtaacatctttaacaccatctatttctcttagctttatttcaatttccctttgatcaataagctttatatcatcttttaagaatatctttatttcaactttgttttgaacattttctattcctttattgatattagttgcaacaagcataaatattccaagaacaaaaaacgttataagaacagttattattgatgcaatactaatagttttgtttctctttaaacttacaaaagcatctttaatataataggttatagtattaattttcatcttcgtacttacctctcttctcgtctctaactatttctcctttttcaatagctataactctctttttcatgtaatcaacaatctctttagcatgagtagccattaaaatagtagtcccagatttatttatatcatcaagtaactccattatttccattgctgtatctggatcaaggttacctgtaggttcgtccgcaattaacactgatggattgttaactaaagctcttgcaagggaaactctttgctgttctcctcctgataattcatttgggaacattttatatttatgtgataatccaactaatgataaaaccattggaactcttcttcttatttcttttggagatgcttctacaactctcattgcaaacgcaacattttcatatacattaaggtttggtattaatctaaagtcctgaaacaccatcccaatttttcttctataataaggaacctgttttctagtaatctttgataaatctttatctgcaacaattactttaccattagtaggttctacttcttttaataacatctttataaacgtagactttcctgatccactaggaccaactaagaatacgaattcacctgcttctatttcaacattaacatctgatagcgcttttacatttttatcatatatcttagatacacctctaaattcaatcatactcgaacactcctttttaatctgtatatcttgcaaatttattgcaaaatctacaaaattaattataacataagaatagttttatatgttatacaattttattaaatatatatttcttatcgtaatttttttacaattatcttaataaaatttctcatttttcgtgctctaattgtataaaattatacataaaaatctatttttaacatttaatcctgttttatgtccttaaatccctctcctagtacttcatgtacctctcctactgcaataaaagcatcgctatcaatttgttttatataattcttaagttttataaactgatttctgcttacaactgcataaagcacattgttttctgcatttgtataaccgccttctgcttttagaaaagtacatcctctgtctaattccttcattataaattgactgatttctttatttttctgactgattatgaaaatacttttacatgcattaaatccttcgataaatctatctacaagtattccaagtaaaataacacctaatatagcatatagtcctaaatctattccaaaaacaagtgcacttgcaaatgttattacaaaatcaacaactaaaagagatttaccaatatctaaatgaaaaaatttatttagcatcttagctaatatatctgtacctcctgttgatgcattttcgttaaatacaatagccattcctatagcagaaataatagtaccaaatatagtagccataagaacgtcatttgttatagctacaggattaaagaatttttcaataatccataatattactgataaacctaagctagcatatattgttttaaccccaaaatttccatcaataaacataaatgccaccacaaataatgcagcattcataataaaggtcaatactccaactgataaattaggaattaaagcattcactacaatagcagctcctgttactcctcctgctgctaaattattaggtgcaaaaaaatactctactgaaatagcaactaatataattccaaatgtaattattgaataacttttaaaatcttttttattcattattttattcccctttatgcatattgttacttatcctatagctaacatcagtaacgctacctctcaccatgtatagctactgaaaactttaggataagtttaactaaatttatctatagcaaaaactctatctaaaaagtttcactttatattgttgttaaatttatctatcttatgcaaaggaaatttattatttaaacgtactagagaaaatagcaagtccaaatatgataaaaaattggcatagggattaacttttttattttttgataatgccttaataatgcaaaaaactacagagtagaattaatacaattctatactctgtagttatctctataatcgaagcatataccttaatatattatctttttaatgatatagctctctttgcactattaacaattgattcaacagttaagccatatttttctaataattgatctggctttccgctttcaccaaatgtatctttaattccaactttaacaactggaactgggaattcctctgttacgacctctgaaacagctgatccaagtccaccaactatgctgtgttcttcagcagtaacaatagctcctgtttcctttgcagctttaactaataattcacaatctattggctttattgtgtggatattaattattttagcatttattccttattttgacaactcttctttagcttttaatgctaattgaaccatcatcccagtagctactattgttacgtcattaccttctgataatgtgattccttttccgatttcaaacttataattattttcatcatttacagtttcaacagctaatcttcctaatctaacatagcaaggaccttcatattcagcaattgctaaaatagcagcttctgtttctactgcatcaactggatttataattgtcatgttaggtatagctctcattaatgcaatatcttcaactgattgatgagttgctccatcttctccaacagttaatcctgcatgtgttgcacatacttttacatttaatcttggataacatattgaatttcttatttgttcaaaagctcttcctgctgcaaacattgcaaaagaacttgcaaatggtatttttccacatgttgcaagacctgctgcaacacccatcatattaccttctgctattcccatatttataaatctttctggtgcagctgttttaaaatctgctgttttagttgactttgaaagatccgcatctaatacaacaactctatcatttaaatttgaaagttttactaacgcttttccataagcctctctagttgctactttatttcccattagttttcccctccaatttccttaagcgcttgttcacattgttctttgttaggagcatttccgtgccatcctgcttcattttccataaatgaaacacctttaccttttatagtcttacatactataactgtaggctgaccttttgcttctttagccttacttatagcgtctcttatttgatcaaaatcatgtccatcaatttttaaaacattccaaccaaatgcttcaaactttttatctataggacctgggttcattacatcttcaatatttccatctatttgtaatccattattatctacaaaggcagttaaattatctaatttataatgtgctgctgccatagatgcttcccaaacttgaccctcttcaagttctccatcacctaatattgtaaatactctgtaatcttttttatctaattttccagctaaagccatccccactgctgctgatataccttgacctaatgaacctgtggacatatcaatccctggtaaatcattcatattaggatgtccttgtaatctagaatctatttttcttaatgtatttaactcttctacttctaaatagcctcttcttgctaaagcgctgtataatgctggtgcagcatgtccctttgataaaacaaatctatctctgtttggatttttagaatcctttggatctatgttcatttcttcaaaaaataaaactgacattatatctgctattgataatgatccgcctggatgacctgatgctgattctgtaagcatagttactatgtcttttctaattagcttagaaatattttctagctcttgtttattcttcattgctgaaccccctggtaaaaagtttaattattttgtttttcgctttttacattgtaacataatatttttattttgtatacactatttaaatttatgatatacttttatttttattattgtttttagaataacacaaagggttatatagtatactatataacccttaaaattctttttatttttaactcaagatagattcaaactgatagcaagagctttattaactttcttcatatcagcttcagtcatatgtcctattttttctttaagtcttctcttatctaaagtccttatttgttctaataaaactactgaatctctattgagtccatattcttctgaagatatctccacatgtataggtagcttggctttatttatttgagatgttattgccgcaacaataacagtaggactgtatctattcccaatatcattttgaattataattacaggtcttattccaccctgttctgaacctattaccggacttaaatccgcataaaaaatttcccctctttttaccacaatgtttgccatttctaattatcacactccgcaaatccatgcctcatactcattaacatcgtctaacatatattcagagcctatcatagagtactctagatttatttcagccatttcaatgtaaccccttttcatcatttcttcaaaatctgctgaaatatcttcatcaatacattgtattaatgatttacccttaactctactactttttataatttttttattatttatttttaagttctttattctatttaaatcaattattgacatctttgcctccatagaagtaaatattttacctaactatgattatattacaatttatgtcaatttgtcaaaaattcatatattctatacaattttaatgtacaattttattgaattttgtaagtaccctccaaaaaacgtgcatatattatgtattaaacactcttataaatatcacaatgttaataatttaagacattcctatatttattttaaacatcttttgtttttaatgattccttaatctatatgtaacccactcatttttcttagtaaatcattaattatatttctaaaataaactttcatcactctctttgcttgatttgaactctttgtatgatataagtattctctccttaccctcatcatcaaatatttttaataatactggagattttgtttttttatctacataaaattcacctttatcaatatgtttattgccgtctggatagtctatatttacttttatatattcattatctgaccattccgtatctaccgtttctagctctccacttacactcttatctaaaatattgtttataaacgccaaaggatatatttcatctatgtttttatcaactacataatccttgccattttccccttgcatctgaatctctgatcctttatatacttttactcgtccatcggcatcttgaaattctatgcgcattccattatctccactatagtattgcatagtattttctttatactcatctttagaattaataaaagtatattcaactttacaactataattttttgtattatatagcttatcaataatttcttcatttgatggtgtcaccattttcctgctaaaaatgataactgcaaaaatgcatataggcacaaaaatcaataaccaaagtaattttttaaatttattttttttattatccgaatccattagtcctccaagatttattattactttattactattatgaaacttaaaggacttttattcttctattttaaacaaatatcattaataactctcggcatttcattaataatatctctagcatttaatatgtaaacttccttgcttaacttatctgctatatatccatgtatatatgctcctattagagcagcatctaaaatattaaccttttgagaaataaatgcattaattattccagtcaatgcatcccccattcctccagatgccattttactattgcctgtagggtttatataagtattatttccatctgtaattattgtattgtaacctttcaacaaaacaattattccatattttttcgcaaattctgaggctattcttattctatctgattcaacttcacttacagttaaccctaaaagccttgccatctctcctggatgaggagtgattatagctctatcttttaattcttctaacatccctttattttttgctaaaattgtaatgccgtctgcatcaattactattggacatttgcttttatctatcacttcatgtaataattcttcttcatatttatcagttccaattcccggtccaaatgcaattgaatctgatttttctatgattgacccaaacttagaagactcacatgaaactgtcatggcttcaattaacttttcagccaatatatcttgtatttcctctttacatgctaaagttacaagaccagcaccagcccttattgtacattctgttgtaatatatgcagcacctgaaaaccctttactaccagcaacaattaaagctcttccgtaatcacctttatgaccatataactttcgtgatggaattatattcttgtattcttcattttcaagaatatataaattatcactattattttttcttaccacttgtggaatacctatttttataattttaacttttcctataaatttaaatgcgttgtagtttaaaaaacccctttttatgacttcaaatgtatatgttatttttgctttaactgcaatatctaactctacccctaaattgcagtctaaacctgaaggaacatctaatgaaactatatattttccatatttattgatacaacatataagattctgaatccaaaaatctaattttctatttaacccaactccaaaaatcccatctataataacatcataatatgttaaatctttgataaactcttctgtgatatcattttcatttttgatgtacgttatcttatcattatcaagaattcttcttataatatcaaaattagttttaaaatcctgactataattttcatccttgcttataatgactacttttacgttttttccctcaatagcaagatgtctagctaatgctaatccgtctcctccattatttccctttccacataatataagaaacgaatcccacttataatatatatcttcaaaaatacctcttgccgcattttccattaaaacaatgcttggaattccatactggtttatagcttcttgatccatttttctgcatttatctctatgaaaaacttctatcattctactacctccataacagcataagctattgcacttgttctattatgagaaatgctaagatgtatattaacatcttttctttttaaaatttcatatacattgctatttaaattaactactggctttcccaattcatctcttaatatctcaatatcttttactccaaaacccctaaatccagttcctaatgccttgcttacagcttcctttgccgcaaaatttccagcaataacttcacttttgaaccctcttgattcaaatatatttatttcattttcagtaaataatttatttataaacccctttgttcttttaacagcaatttcgattctctcaatttcaattatgtctgttcctatccctataatcatatttatcgcctcacttttagtaatatcttaccacatagaagcgaaaaaaataattctaagtatcaatgtttagttaattttttcactataatttctataatccgcttcatatgaaaattcgtcagcataacatcctattatgtcaactaaatgtatgggcgatagttgattttgataaagttttttaagtatatcttctgctttatccttttcaaatgaaatcatagtcaccttatctctttcgatattaatattttttatccctatataatcctttctctctatttcgattccatatactggtgttcctctataatctgacttaattagtctgtaactgtaattgaattccatgttatcctcttttctattacatacatattcatctgcaatattcataatacttcaacccctcaaacaatattacaataaaatattagcacattattaaattataaattgtcaaagcatgtacacaatattaaagaatcgtatattttttattgacaataaaatctcaacatttgttttttccaacataatacctttaaattttgtcgattattttattatatttgtcgaattatagatttttataactacttataacgtgtgtatttttaatatgtttacaaataaaaaaagagttcaacagaactctttttttatctcataatctctttttttgttaaaccataattgaaaaacgcttagatatcgtttacatttttattatatcatatttttcaatttttgcaagtttttttatatttaatgttatttttctttatattccaataaatgtaatagacaaaatatatcttttacatttattgaatatatttttatttttaaaatggttttactatgttttttttaaaacatttaaaatttattttcaataaattttctttattacaactagcattttagctaacagctttcttcaacttcattttgtacttcttttttagtacttataaatttaaaatcttctgcaactacttctgctatatatcttttgattccatccttatcttcataacttcctgttcttagtcttccacttacagttataaggcttcctttttgcgtatgcttacatataatttcagcctttttaccccatacgacaactgttataaaatcagcttctcttgtaccatcaggtaatttaaagtttctttgaacagctattacaaaacgggtatataatttatctccattttcattctgtttcaactctggatcctttattaagcgtcctaataatattattttgttcataaatatacctccacagtaattttccttttaatttatatccataaaacaaaataatatacaaaatttaaaatattttttatatttctctttatataatactaggttgtataacatcattatcaaaatatataatataacttctgatataatacaataaatttcgtagaaattctaacatacattgttacatattacctaatattcgttatttacagatttatattttatttgactcataacacaatttatttctactcctagaataaatatcattgatattaaaaataaccatgtcattaaaataaaaacagctccaaggcttccataaaatctagaataattcccaaaattattgatataaaaagaaaatccaaaagatactccaatccatcccatagtactaaacactgaacctggaaccacttctttcaactttaatctttttgccggtgcaaacatgtacatcaatgcaaatataaatatcattacaataaatacaaaagcatatctaaacatattccacaaaaatattattattttataaaaaggtattctgcttattatataagctcctattacatttccaaaaacaagcattgctaatgcaagcaatattattactgcaagtaatattattcctatcatagaaattattgaccttttaataaaggatctgttttctttaaagccatatgccttattaacacctttaattacagctctaaatgctgaagaagaagtccatatcattaacaaaactgatactcctaataatcctgtatgctgattatcaacaacctcagcaataattgatttagttaaatcaacaatacttgtaggaagaattgcatttaaattatctaatacctctacagaacttaagtgactaaagcctataagtgttatcaaaaatatcatgaatggaaaaaatgataatattaaataatatgcaagctgagatgataatgcaaaaacgtcatccttctttatcttcacaataagatgtattaataagtttatttgacgtcttatactaaatttaaaattgctcatttaatcaccaaatttcctttccataaatttttctaatatattcttccctgtagattatatcatatactatatgctactctactttcaaatataatattcttatgttcaccattctttttacaaatacattaaaacattatactttcttataaataaaaagaagtatcatagtctaaatatactttcaaactatgatactctaatctatttaccaaacaaatatcctgagaaaattaataatccaaaacatactacattaaaggttattactatctgcatatattgaaaccatttttcttttttatattttttataaaacttcgatcttctctcatatatatctgttaatatcaacgctactccctgatataaaccataaataatataatatggagttaatccatgccaaactcccattataaacattgtaattaattgtccagcatgtgaagcatatattctacttttaaatcttttttttctcatactatttaaaacaaacctagaataaatgtaatctccaaaccactttgacaatgaaatatgccatctattccaaaattctttcatacttttacttaaaaacggcatattaaaattctctggtgtctttattcctagaaaataactcgtaccaattgcaaaggcactatatcctgcaaaatcaaaaaataagaataaactataagcatacatataatttatggaatttaatagatttacatcctttggtatcttattcatccataaagtacttatcaatgccgctatacagaatttatatagaatcccttttaaaatatgttctattcctttagaaatatattcattaatataattgtctctgccaataacatattttgaatcctgagtaaatctcctgtatctatctattggaccacaactcaatgtaggaacaaaaactatgaaatatactaaatcaataatcttaagatctgttatacttccatcatatatttcaataatcatctgtattgccttaaaattaacatatgaaagtcctataaatccaatagcaccaatatcagttaatggtgatatttttaaaagtattacagggaacatacacattattaaagctgaaaaatatatatacttgttttctgtaacctttcttatttcaaaatatacctttattaatatagtttctcctaataaaaatataagaaataagaatatttgtatttgagaagattttaatgcattaataaaatctccctttataagataaccaaaggcagtatcaactttccatcccataattattactatcattactgctgaaaagaatatcccataaggtcttattaatttacctctaatacctaaaataactgctggtattaaaagtattaataatatatataaataaaaataacttccatattgttctaacgacattttaacctctccataaccttattatattaattcttcaatactcagaattgactataaacaaatgggatatcacatgctgaatagaaaaaatacactactaatgctaatgaaattgttactgacaacaatactgttcttttaaattccttatttttcattaaaatgattatatattccttcacttactttaagccacccttcttctccaagatgcataacatcaattaaaaaatcttgcttgtactcataatttcttaaatctaaaacatcaagtccttgttccttagataaattatctattttattataatattgatctctttcttctttacttagtcctaaataatcatagtaccatccatttactggtggcattattatatatggctttatgtctaaatccttgcatacacttaagaaaaatttaaaatcattcatttctactgatgataaagcatcatttccctttaaacatccatcaagataatccatatgatcttttatatttttattataataatcatctcttagatgaaattgatttgtagaaacctcatcactgtgttccttatttatttgcttttcttcttcatcccagtttatgtcttccaattcttcttctggttttttttcaggtaatttattcatttccttatagattaatgccttatctttaattccagaaagataattacttattttataatacggactcataataaacataagtgatttttttaatacattaggatttgaatataatcttgcatataatgcttctgctggatatttatcagccttctctaaaagcgaataaaccctttttgcatagtattgcttgttttcatcacttattttgggattatttaaaaaattataaaactgtatttccgaaaaatttgttgcaaaattatctgcctttacgccatctgcattatcaaaccattgaatcgacagtatatatgccaccttttgagtaggttttaagtcacttcctccaatgtatgttgcctgctgtaaattctgaacatatcctcttccaaagcagcttatattataatctgcaccttttatcggaaataggtttatactattctgttcaacattaatagacatttctgatgaaccgaataaaaataaatcgttgctatcatctaaaatatcttttgcaattatactgctgtccttaatatggtccccatactgttttccaaatgccgaaaggtccttaatattttttagaattcctatttgaacatttaaaaactgattaattccaactataactgcaataactacagatgctgcaatgaaaaaacttgtttttatcttcatctcagaatattcccttcataattattactaacgttatataaaaataaatcctttttacaataactattatgcacttttcatatgtcaaaaaggtgacagattaaccaaataattcttagttattaaagtttattttcatattccttataaaatacaaaaagcagaaaaattgttgtagtaacaatttttctgctctttacttattattataatttataaatcttttctctattgttaacaacgttcttagtagcatttcttgtatcatatactactttagctcttgcaaccattgattcataatcatagcaactgtgattagtagttacaattactatatcagcatcatctataacttctgtccaatctactgaatgatatgttttatccttatacttagatactggacaatatggatcattaaccataaggtctgcaccattcttttctaataattctattactttaaatgctggtgattctctgtaatcatctatatcattcttataagcaactcccattattagaacctttgctccgtttaatgctttcttatgtttatttaaaatcttcataacattatctaatacaaattcaggcattgaatcattaatttcacctgaagtttctattaatcttgtatgataatcatattctttagctttccattctaaatagaaaggatcaagtggtatacaatgtccgcctaagcctgggcctggataaaatggcataaatccatatggtttagttttagcagcatctataacttcccatacatctatacccattctattacaaagtattgccatttcattagctaaacctatattgatatttctaaatgtattttctaatattttttccatttcagctacagctggtgatgatactgtatgtatatctccttctaatatatttctatataatgctgctgcaacttctgtacaatcttcactacatccaccaacaacttttggtgtattctttgtgttaaattgtttattacctggatctactctttcaggtgaaaatgctaagaagaaatcttctccacattttaatccgctttcttctaatataggtttaagaacttcttcagtagttcctggataagtagtactttcaagtattactaacatacctttatgaagatactgtgcaacgctctttgttgatgaaaccacatatgataaatctggttgtttatacaaatctaatggtgttggaacacatatacagattgtatctacatcttttacgaaactaaaatctgtagttgcttttaaagaaccgtcttctactaacttctttaaagtttcatctactacatctcctatatagtttttaccttcattaaccatattaacttttttatcttgaacatcaaaacctatagtttgatatcctgcatgagctttttctactgctaatggtaatcctacatatccaagaccaactaccccaactttagcagttttattatttattttatctaataattgttgctttaacactgacatgttatacctcctataatcaatacaaatgatcatattactatttatgttataaatttaattgaattatcctaaaattactcgttacattcaactttttcatcagctttagtataatttaatccacatacagtacatgttgctttatcattttcaaatgataatttttcaccacatttacatacatatccttttattctagctggatttcccataaccaaagcataatctggtatgtttttagtaactaccgcacccgctccaattaatgcaaactttcctatattgtgtccacatacaattgttacattagctccaattgatgcaccttttccaattatagtttctctatattcagcttttctctctataaagcttctaggatttatcacgtttgtaaatacacacgatggacctaaaaatacatcatcctcacaaataacacctgtataaacagatacattattttggattttaactccatttccaagctttactcctggagatatgactacattctgacctatattacacttttcacccatttcagaattactcattacatgagaaaaatgccatatttttgttccatctccaattttgacattatcatctacataacttgattcatgtacaaaatactttttttccataattaactcccctttttcagttaacaagtaacagttagcagttttatataatctttaactgttaactattttatcgcatcaactatatattgtatttgttcttgtgttaattctggataaactggtattgcaaaagttctatgtgatagatattctgcaacaggcatatcgccttctttataacctaaatctgcatacaccttttgtaaatgtaaaggtactggatagtacactccagttgcaacacctttttcttttagtttatttaacatagtttctctatcgtcacattgtaatacatattgatgatatataacttcattttcttctctgtttattggtgtaacaacatctgcatctttaaatttttcattatatatttctgctatttctcttcttttaccattccaactgtctaggtgtggtaatttaactcttaatatagcaccttgaatagcgtctaatcttgaattaaaaccgattagataattataatattttaatggattatatactgtatcatcaccatcttttgatgttttaatgtcttctgtaatattatttaataggttatatgctttttgacctgtttccccacttccatgagttcttaatgcttttgcaatagtagcaatgtcatcattatctgtaactatcattccaccatcaccagcacatgaaagattctttgttgggaagaatgagaaacatgctgcatctcctaatgttccaatcatcttgcctttatatttagcacctacagcttgacatgcatcttctataacctttaagttatgctttttagctatttcatttatttcatccatctctgcactctgtccgaaaatatgtacaggaataatcgcttttgttttatcagttattttttcttctatctttgatgggtcaagattgaatgtatctttttctacatcaacaaaaactggtgtagctccaactgccgaaatacattctgctgaggcaaaataagtaaatgttgaagttattacttcatcaccatggcctattcctaaagattttaatgcaataaccaaagcatcagttccatttccaactgatatcgcatgtttaactcctatatattctgcaaattccttttcgaactctgttacgttcttacccattatgtaagctgcagaagataaaacttctttagttactctatctaaatcttcagaaatagatttatattgagcttttaagtcaattaatggaatattcattttcctcgctccttaatgttaacttttaatatatttattattaattatttttatttataaactaacatgaatattttaacatacttaaatagataaataaactttttgtttttcagtataatactatttttttaatatattttttaattaaaatttttttataggataccactctgaaggcaacagtatattatattgaggagtaatgtatctatcatcaatcaatagaactcttccctcatcattttctgttcttattacccttcctgctgcctgttgtactttatttattcctggatacacataagcatagtcatatccattttctccaaagaactctctgcttatttcattttccattgctattttaggatatccaacccctattataacactccctataagttgttctcctggaaggtctattccttctgaaaacattccacctaatacacaaaatacaagaagattattattttccttaaactgttttagaaaatcactcttttctttttcatccatattagattcttgctttataagtttaaacatatctaaaccatcacattttaaaatatcttcccaaagcgattccatatatgcataagatggagcaaatactatataattaccaatctctttattaacaaaactgcatatcttatcaatcacatttggcagagttctcattctatatttatatcttatattaactggacttacatatacattgagattttcttttttaaaaggtgatggtaattttaatctatagctttcattctctccaccaagcatctctatataatattttattggtgacagagttgctgaaaaaaatactgttgagtaattttttttcaaacacttctttaaattttcagatggatttacgcaatatagcgtcaatacaacttcttgagagtctttttctacacatgtaacgtaattctcatcatataactgcataatagtattaaatgaattaatatcgaaatacagctgaagtatttcatcatatccctcaaatttatttcctttcacaagtatttcttcactttcctttaaataaagatttaaatacttagataaatcttttggtccatcattctcataaaaccaagttacatttttatgagtacattcatttcttaattctataaaataactatttaatttatctagaactgaatgaagttttctcaatttacctttagcaatttttttacattttaaaatttgatccttatttagtgatgcagaatacattttttttgatctatctattaagttatgtgattcatcaataagaactatattgtctttttgctcaatcattcttgtaagtgaaacacgaggatcaaacatataattataatcacatataatcccatcacaatacatacttatgtctaaagacaattcaaatggacatactttatatttttgtgcataatcctgtaatatttccacggaaatacactcattctcttcaagaaccattaatactacatttttaaccttattataatactccttagcataaacacacttttcaggattgcaatcaaattgatcattaatacacgatttctcttttgcagttaatactatactcctaaatttcaaaccagtattacgtagcttgtcaaaagtatgctttgctacttctctgtttattgttttaggggtaagataaattatcttatctccaattccttcacctaaagccttaaccgctggaaatattgttgatattgtttttcctattcctgtaggagcctgtgcaaaaagtttttctttttccttaatagtgctgtaaacaacatttattagctttctctgcccttccctataagagtcaaatggaaaaactacattttttatagattcatttctttcttttttttcattatatataaaaacattgaatttttcatactcttcaagtatttcaaatgcaaaatgccttaattcttcaatgttaaaagcatattcaaaactcttaacttcatcagtttcaagctgtacataagataatcttataaatattttactcaagttgttttctaaacaataaattaaagcatataattttgcctgtgcccaatgaacttcattagaatcatcaatgtgtacaaaacttttatatgtagattttatttcttcaattattattttgccatcatcaaatattataccgtctgctcttccttcaacttttataatactattcttcaattcaaattctcgtgttaaaaaaacctctttttcatactcagaatatatacctgcattatctttttgaagtttttgatgtgcccttgttccctctaatgctcttgcatttcctgaaaagcgattatctatatcaccttttaaaagacagaattccaccaaatttctaacagattctcttataataattttctccataaaatacctcttgtaatatatagaacaaaatatagaaaacacttatttaatgaacatttaataaatattcattaaataagtgctacaactaagtttctaatttacccgaataaatattcatatattattcagcgtgatattcatttactattttttgaactaattttttaataacgcttgcctctgctattaatgacaatactaataaaaatatctttattctctcttcatctttgtcttctagattaaattccttaactagttgttctaatttctcctcatgtgttaatgaatttattaagtaatcatctaaactctcttcttgaatctgaacaaatgtcttatatgcttcttcccatgataatatatcatcatttctatcatttatctcattaaacgctaaattaaataccttttttatttcttctgttgttaagacaggtctcatatagctaagaagcactaattgaataagatgcatcttagtataacctctcttttttccgtcttcaggttttgtaataacttcactcttagtataattttgaactatattatttgtgaatttttcattatcaaatttatcatttaaataatctataacttgtgatagaaacaaatcatattttggtagatcatcatatgaaattgaactgttttttgacatttcttctgctaattcttttatatagttagaatcaaattttcttttcatagtgtccacctacactttctcatacttcttttattatattatatagtatacatgaacttattacaagttatttttaacattataactcatttaatcctattccatttttttatgataattatagcatattttttatcttcccctacagaagtatattcttaaattctaattagcagtcaatagttagaaatgaaattatatgaatatttattttaattagataattctatttttaatatgcatatttaactattaactttataattataatccaaaaatcatatagtaatttcagcattaattgtcacatgtcaattacaatatgtgtatcttttacttaacatttaatagctttacacataaaaatataaaatattgctttcactcctcacttagaaatttcttatgatcttgtaaagttttattattggaacttaatatatattattcttaattttattaattatattagtctatattttattttgtggtttactaaaaaatatctattttttgtaatctatcgacattatcacttatagtttctgttttttctgctaaagagttgattaattacttttatccttgtatttgtaaattttttattacattttttcattaaccatactttagtacaaactatcactatgcttaaagctactatttaagccacaatacaaatttaagaatttttattatttaagctcattcacatgaaaaaccctattgacatttctaaaatatggtagtatattttaactataatgttttttaaagttgaaatttgtaatttcttataacaaaaaataaaatatttattgactttatattacattcttggtaatatagcattgtagaatgtcgaattgtgtaattaggaggaatttttttattatgaaatcaacaggtgtagttagaagagtagacgaattaggaagaatagtaattccaatagaattaagaagaactttagatatcgctgaaaaggatgctttagaaatatatgtagatggtgaacaaataatcttaaagaaatatgaaccagcatgtatcttctgtggtgatgctagagacgttataaactacaaaggtaagaatatctgtcaaaaatgtttcgaagaaatgaagaacagataataagatagtacataatgaatttaaataataaaaagtaatacatgccctagtgcacgtattacttttattattttgcaaacataaaatcgacaaattttatatattagtcgaaaatttatacacttcacttttaggtaattctctatcttttgcgacaagttttattgcctctttcttatttattccatcttttatatatttcaaaatatggtcttcaatagataaattaatccattcttgtttcttttcttcttttatatcttcaattttttttccttctaaaacaagaacaaattctcctcttggtttattattaacaaaattctgaatcgcatcacttaaatttcctctaaaaatttcctcatataattttgtaagttctctacacacagctatttttctatcaccaaatacgtccataagatatgataacgtatcgagcaatctgtgaggtgcttcataaaaaatcaaagtttcctgactatttaaaagttcatctgttattactcttctatctttattttctcttggaagaaatcctctaaacaaaaatttagtagtatcaagtcctgaataaacaagagctgtcgttattgctgttgcccctggtagtacttcaaaatcaatattttcatttatacattttccgacgattacactacctggatctgatattcctggtgttcctgcatctgatacaagggctatatttttaccttcaagaagcagttctattatttcattccctttggactgctcattaaatttgtgataactaataaggggcttttttatttcaaagtgatttagaagctttaaagtctgccttgtatcttctgctgcaataatatcactttcttttaatacttctaatgctcttaatgtaatgtcttttaaatttcctataggcgtaggtactaaatataattttccattttccacgtcttacttcctcccatatattcgatcaatgtcttctgtatattttccatcttcattataaacatatagtggttcatcccacttaagatatgctccaccatctctctgaccttcaacaagcactatattaggtgctttatttactttaggatgtatcatttttactcttttaggttctattttgtattttctcattagcgtaaaaatatctgcaagtctttcaggtctatgaactatgaacatccttccattatcttttaatagcactctggctgcatatattacatcttcaagattacacattatctcatgtcttgcaatagccaacttgtctaaagggttaattatcccagaattattaagtttgtatggaggatttactgtaagaacatcaaatcgtccaagttccttaaggccatctatatcctttaaatctaaatttatgaaagataccttgctttctagggaattcaacttaacacttctttcagccatttctaccatatcactttgaatttctactcctacaacttcttgaggactatattttccatacagtaaaaatggaactatacctgttcctgtacataaatcaatggctctatgccttgtctttacgttagcaaaatccgataaaagtactgcatctattccaaatttgaatccatcttttttttgaattaaacttaatccattcaattgtaagtcatcaatattctcatcttcattaataagttgtatatttttatcacccatataatcttcctttttcttaatttatctatataattatcagtttgttcaatatgcaaaaatatataattaaaatatctttcaatatcaaaacttttacttttcttaatttcaatcacaataacattgcagttgcaagtttgcatatataaaaaactaaaaactttcatttgttacctgaaaagtatatcacctaaatacattgcagtatatatgctactatataattatacatcataaagtaacattctatatttttttcaaaagaaatgtataagatatttcttttgtgaaataatattaattaagaactgataataaaaacattataaaaagcctcctgccaaaggcatagaggctgtgtttatccatataactcaaaatttattatgttaaattaaagtactcttctagctgcgtagaatttgtatacaggtgaaacttttacaacatctcctgtttgtggagcatgtatcatttgaccattaccaacatatattccaacatgacctgtatgtgggaatactaaatcacctggttgaagttgatcttgacttactggaactccaacattaatttgtgagtatgttgttctacttatatcaattcctgctgcatttttaaatacatattgagtaaatccagaacaatcgaagttgcttggacctgttgcaccataaacataagctttacctaaatgtttatatgcttcatttaaaacagctgatgcatttcctgatgctggaggtggagttgctgaagaactgttagaagatcctctatttggcgtacttgtactagttgctgccgcagctgctgcagctcttgcttgagcttcttcttgttcttttttactactatacgctgttttacctttttctatcatatcattaacttctgatttaactatttcactcttaagctgattatctctaatatttcttaattgagtaatagccgattgaaggtctgaagatgtactgcttgaactatttataacagcatattgtgattgtacaacttctctctctaactctgataagtattcagaatcaaatttacttttttcttgttgtgcttcatttacaagaacttcttgttcttttttctttccatctaattcacttaaactcgtttgtacctctttgttaagtgtatcgatttcatttttcttatcttctaacgagcttattttaccatctaattcttcttttttatctgttaattcctcaatagcttttttatctttgcttataatttgagaaacagcttgaagtctagtaaagaaatctcctgttgattcagattctaataaaaagttcacataactgaactctaaatcaccagacatgtacattgcgcttactctttctcctaacgccttgtctagttcattaacttctaccttacattgatctatttctttagtagtattatcaattacattattaatgttacttatttcttttttatttttttctacagttacctgtaatggttctatctgaccatttaattcataaattttatcttgaatatttgctattttagtttctatttcagcatatttacttctactctcattaagcttgctattatctggtgtcgcatatgctggtatattaatacccgtaactacaactgttgctagcataagtgccagaattctttttttcattcatattcggtcccccttgaaccttccctcctttattttcgtaatttcttacattattataacactttccataaatatggacaatactctcattatccgagaaattaagttattttaaagatatctaaaattcttcccatttccccctgtatactaacttattctcgcaaatggtcatttcatctcgtttatactagtaaatcaccgatttttactcgaatttgttatataatacagcacacttgcccttgacatgtcctaaagttcactatataatgttatatgtcgtcggggtgtggcgcagatgggagcgcgcgtgctttgggagcatgaggtcgcaggttcgatccctgtcaccccgaccatataacttaaggatttttccttaagtttttttattatattgtattttttagatataaatacaaaggtataaaggagaatattatgcttgaaaatataaaaggtgctattttcgatttagatggtactcttgttgattctatgtgggtttggagcaaaatagatatagattatttagaatctaagggacatgcactacctgaaaatttaaattcagaaatatgccacttgagcttcacacaaactgcaaattacttcaaggaaagattaagcctatctgactctatagatactattcttaaagattggaacaacatggcatataatcactattctgaaaatgtaaaattaaaagatggtgttaaagaatttttagataaattaaaacaaaataatataaaaatagccttagccacaagcaattcagtccctcttcttgaagcttgcttgaaaaataatggtatatatgattattttgactctataacaactacagatgaagtatctaatggaaaaaactgtcctgatgtttatcttttagcagcaaaaaagttgaatgtaaatcctaaaaactgcatagtttttgaagatatacttcctgcaataaaaggtgctaaagctgctgatatgactgtaattgcagtaagcgataaacattcattaaatgatttagatgaaataattaatcattcagataaatatatcaattcatattttgaattaatataaaacccaaatagtcctgctgaaaaatcagcaggactatttttatctgtatatgtatcttattaattacaaaacagattttttatagaaaaaactattttctttccactccatatttttcttgtaattgattcattaaatcatcatattttttatgttgatttctctttaataattcatttacaacactatctttaacttcttcaaaactcttaacagcaccttcatttttagaatctactattattaagtgatatccaaattgagtttttactggttcagtaagaacccctatttctgcttcaaaagaagccttttcaaattcaggaaccatcattccttttgagaattctcctaaatttccgccttgttcttttgatgggcagctagaatatttcattgctgcatctgcaaatgataatccaccattgatttcttctttaactttatttgcttcttcttcagtcttaactaagatatgtcttgctgaaactgttggaggtacagaaaatgcatccttgttttcatcatagtattttttagcatcttcatctgtaacagtaacatcagctaaagctttattcatagccatagaagttaaaacttctttagttatgcttgcaactgcatccttatactcttgagttttatctaattctaattcttgaccaaatttattgaataattcaaatgaaatcaattgttcaagtaagttcttctttgcttcttctgagttaaaagcagctctttgttgttctgggtatctagcaattaatgcatttaaatcattttctgttatttcatgtcctgctgcaatagctaatactttattttccatgtgtgctctccttttaatataaaatttattcataccattttattttaacagtatatggcgatagtaacaataaaatttaatttattcttattctttctctaattaatacataatattcctctatagtgctataataaaccgaggtgattttatgtctgaaatactaaaaaatgattggaaagattatctatcttcagaatttgagaaggattattacaaaaatctaagaaatttcttaaaaaccgaatataattctaacgtaatatatcctaatatgtatgatattttcaacgctctgcactttacttcatatgcagacacaaaggttgtaattttaggtcaggatccatatcacggaccaaaacaagctcacggattaagcttttctgtaaaccctggcgtaaaaactcccccatcattagttaatatctataaagaattacatagcgatttaaactgctacatacctaataacggctatttaaaaaaatgggctgatcaaggtgtcctattattgaatacagtacttacagtgcgtgctggagaagcaaactctcataaaaataaaggttgggaatcatttactacccaagtaataaaaactttaaacgaaaaagaaactcctattgtattcatattatggggtaacaatgcaatatcaaaggaaagcttaattacaaatccaaagcatttgataattaaatcagttcatccaagtccactttcagcttcaagaggtttctttggtagtaaaccattttctaaaacaaatgagtttttaatatcaactaaccaaaaaccaatagactggcaaatagagaacatataaaaataaagctatctcaatctattatttcataaaacatcaattctgttttatatttctattgagatagctctttctgtagttttcttacattttaattttttcagaatttatcaatccataattttttaaaatcataagcgtatctgtatctatatatctctcatagtccccaatatgtttatttttatctcccacaaatccctcaattttatcagcaacggcacatcctatagtcataattatgaatgaaaaggctataaattttaacatgctcttttccaatctaaatttatatctcaattcaatatatgttttattaattcaaaaaacactctttttatatattttctaaatttaaaaacccattcaccagctttatagaatattatccagtttttttatataatagtagtatatttatactagaaattcataaattactaatattataaattctagacactatattaatacataactatatattataaatttaggaggtaattttatatggagtacaaatttacatacaacagtaaggaatacacgctaaactcaaagaactgcgaaggtatcttttttgaaaatgatgaggaaattaaaggactgtctctagaaacaattttagaagccttaaattctaatgaagaagtttctttttcaaaagaatactatgctggtaaatgcgcttgtgatcttcaagagaaaatagaaaagtattattgctaccttgaatatcatttctatatttatacaaaagagcaagagtacgttataaatacaatctgcaaagaatatgaagatacatctttcaataaattatttagagcagggaaaattgataaaagtcacatcgtgaatataacagtttgtccagaatgtggaacatattcaatagaaatagaggattgcgaagtctaaactcatctttaaattaacaataacactataaaagacgactaaatttatattaaatattattttcaaagttttaatttataaactcacataatattttctataattagtcgtctttattaatcaataaataaattaactacataaaggcctttttactttattatttaactattatcgaataaaaaaaacactaacatatgttagtgttttgtggtggctcgaactggaatcgaaccagtgacacgaggattttcagtcctctgctctaccgactgagctatcgagccatgctcacctggcgacgtcctactcttccacacagtctcccgtgcagtaccatcggcgctgtagaccttaactttcctgttcggaatgggaaggagtgttacctctacgccgtcatcaccagatcacaaatagaattatatcgagatatgactaatatgtcaacacttttttcaaactttttttaaattttatcattttttatcaaaataaacaaagaaaaacctgtctaaaccctttatttccaaagattaagacagttttctataaattattatttttcttttcctacacatatattcctatacaattagatatataaaattaccttttttcttcaaactcctttaccaacctataaaaagtagcctttgttaaccctaaattgttatatgtatcaaccgcactctgctttttatttttccaaagcttatattgaactttaaattcttttgttatttcagttttaggtctgcctatacccttaccattgtttctgctttttaatttatttatcccatcagcctgttttattctatttctcttcttttccttatcacctaaataaccaagaagttcaacaataatttcatttatttttatcttatcttcttcattcttattgaaggtactaagaacagggctatctactataactatatcaatcttattttcatataatctttcccattcacttttaatactttcagagcttcttccaagcctatctaattcagttattataatcacatcaccacttctaaccatatattctacaagggccttgtaaccatctctgtttaaattgtcggaagatattgcatcaacaacaatctccctttcatttatatcaaatccattatctgcacaatatttctttatagtttcaatctgctcttccttaccttttccttttatagttgttctcacatatccaaacatttttctctgcatgtctcttctccttagtttaactctttcttattctcaaaaggtatcatttatttttgatacgttccaaaaataaacgataccttttgatattataatacaaacagcatacattatgcaaaaattatttatagatttgtttgaatgcaactcaattaaaaatattgttagaatagctaatactataattattaaaattatcttgttatactttatctttaataatttttatttactccaaaagtatatatttagattaatatatagataataattgattttaataatgttgatacttatatattttttatatccgtataaattaatatctaaaaataaattccttttaatctaaagtctcaaaaaaatcatttattaactagagcttaccaactataaatatctaatgtatatattctaaaaaaatatacataaattttactttgtatttttaattaataattagaacatatatatctttctctctttttatatatctaatgacttttttcttccttttattttttctccataaattgtaaataatatatattatatcacataattaattacataaaatatatttttttacataaaaaactgttaatctgaattgaagattaacagtttttcactcttgtacttaatttatatttttaattttcatattaccatgatatcattatcaaaatctcacttgtaattcttatcttaacttatatttaccaatataattatttcctcttttatctttatgagtatttctgtattatatttcctataaattttttaaactctaaccttgttttttccggctctagaatttcaagatcatcaccatatcctaaaagatagctgtaaatccatggtttttggggcatatcatattctacaataagataatcaccatcaatcttaataataccttttctaaactcatcataaacacgtgatgctgaagccatatttattttaagtttaatttttatacactcactctgctctatatcatagttccaatttataggtatattagctattctcttaaaagtatcacctaatacttctaatgcctcaattctagttaatttaaaaaatctaaagtcatttttatttgtacaaaatccatatacataccatttattccctttaaatataagcttgtatggctgaactactcttttagatacctctcctttattgttataataagaaaatctaacacattttaaattcattatactctcttttaataatgcaaaattatttttctcttcttcgctctgctcccaccctgaaaagtcaatttcaatccagtctgtatcattttttctaaaaatattttttaattttataagagaatcattaacatcaatttgtcctgtagcatttacactctgaagagccataataatcttattttgctcgtcatcagatacaatagtcttatctatagaataattttctaaaatagatatacctccaccttttccctgagtcgcataaataggtataccattcgctgataaaatttcaatatctctataaattgttcttactgaaacattaaaatagtctgcaagttcctttgcagtaactgattttctatttactaacatctgtactattgaaaataatctatcaatcttcacttttgtacctccatctaaaaataacccaaccagactttatattaaaaaaacttatttaatgctttcaagaaaatctttaacctcaagcaaagaattcaattttttataaagttgtttttctatttcttttgttggctgaacaatatctggcaccattatagcattcattccagctctaattgcagctgtaacaccattaatagaatcttctatagctatacattcttcaggctttctattaaacttgctacacgctttaaggtatatgtccggttctggttttcccttttcaaccatatcccctgtagtaaggtgtgtaaaatactcacgtataccaacctcttttaaatgactaacaactaatggctcatgagttgatgaagcaagtccaatttcataatgattcctttttaaataagaaagcagttcatgtactccattttttataggaactcctcttttttctattatttcattaaatttatccataagatcgttcaaacattcttttcctgaaagtcttcctttaaaattggcatctataaatttctcactatcttctgatgtaagtcctcgacatcctgataaaacataatctatattttcaacgtttctttcttttaaaataatcttccaagcttcatcataaatcttttctgtatcaaataacactccatccatatcaaaaataattgttctaatcatatgaaattcccccttaagtctatttatttttattatttgcctccttatattttttcatttctttaagaattctctatattaaatatttacttattaatatattattggttatattttctaattcgagtgtaattatataaatttgaattgtcaatgtattttatagtaaaaattaataacactaaccttacaactgtatacttctgattttattatttaacacatccataaatttacttgtacctctcttatctattgcttcatataatatattaattgttaagtaaataagaaaactttggaggattaatatgagtcctaattttaaattcgctgtattaggcgattcaagaggtacaaaagctcaatcaattcaaataaataaaccagttctaggtaaacttctgcatgatataaaaaagtatcataatcccgacttcatattatttggtggagacatgattctgggtagagctactttaaatgtagatgcaaatactagttttattttttctaatcttttagagtgggaaatgttcgtaaaaaaagcactaggtgttaatagcctcaaagactatgtatttcccgcaataggcaatcatgattatagtaattcggataattttaaggaaagtattaaggctttcaataaagcattttattatctgccttcaaattcatgtaatgaagatatgctagatgggtatggcaaaacagtatattattttgattattataattctaggtttattgtactaaatactgtatttaaaagttcatcaagtggtgatcctgaagataaacaacagcttattggtattactccagagcaattaaattggcttgagaatacattaagtagtagcaatagtacaaataactttatattacttcattgtcctattattgggacttatcaagattattattcacttccttttgaccaacaggaagctttatttagaatttttaacaactatagaattgcaggagtatacgctggacacgagcacagctataatcgccgttttatcaccaatgtattttttaaagctgactatgcattaaacaaatcaataattcaaataacaagcggtggtggtggtgctccctttgaaatacctggcgataatagacttaacctcgttacaggtcctgcctgtatctatgaatatggtattattgaagtatttgatacactagtaaaatcagcattctatgatactaatggaacatgtttagatagctttatttattcttaatagctttatttttttcaattcaaaaaagtgtcctcaaaagggcactttaaatatttaatccgcatatacaacatcgttgcataaatcaattccattacttcatataagattcaagtttaaagatgactgtttaattttatttttcacttttttatgtcataatattaatataaaatattgacggagatgattttatgaataatgaaatagaaaagttaactctaatcctaaaagaaagtaataacattgttttctttggtggtgcaggtgtatcaacagaaagtaacattcctgacttcagaagttcaaatggtttatggaatgaaaagttaagaataaacttcacaccagaacaattagtttctcatactttctttatgaaatatccagaagaattttttagattttataaagataaacttatctacccagattcaaaaccaaatgcagcacatatagctttagctaaacttgaagagatgggtaaattaaaagctgtagttacacaaaatattgatggattgcatcaagctgctggttctaaaaatgttttcgaacttcatggatcagttttaagaaactattgcatggactgtaatgctttctatgacgaaaaattcatattagcttcagaaggaatacctacatgtccaaagtgtggcggaaaagttaagcctgatgttgttctttatgaagaaggattagacgaatccactatacaaggttcaattgcagctatttctcaagctgatactttaataattggaggcacttctcttattgtttatccggctgctggacttataaattattttaaaggcaagaatcttattcttataaataagagcactacatctgctgatagcaaggctgatttagttatacatgaggctattggtaaagttttaggggaagcagttaatagtctataaaaatacaggtaactatatttttatatagttacctgtatttatatatattactcttcagactctttttccgttgattcttcagctttttgtactcttttcttatataataatgatgaaatacttagtattatcattgttaatgcaaatgtaaaaataaatagaattaaccctgtagcaatagatcctaaaagtttttcatactgaataaatgattttacaaaaaatattaatccagttactaatccacctatagtgcttaaaataaaatttgtctttaaatttggttttagttttctatcccatatattattcctcatgcaatcaataaaaatatatatgcaaagacacataaaaactatccactcacctgcaatatttctaaatgtatctccttctcctataaataattgtactataatagctataagtaatccccagaatgcaaaccacattccattatgctcaatttttaataacttttgttcctgcatttcatcaagattatttttcaatcttttcattatcatcatcctcccaaaataaatcatcaagttttttccctaataccttacatatagatctgcataatttaatagttggattgtattctcctttttctatcgcattcattgtctgacgagaaacacctactctttctgcaagttccttttgtgtcatatcaagctgggctctggccacttttattgcaatattttttcccattttttcacttcctttaaatttatattataataaattttaccaaaagtcaaatatatattacttttggtattctttattttactattaaccatataatctcaaatatataacttttcctttcttcgtatcatatagtaaataagagttatctgaatttaatatttcaattcagatagctcttaaagtatttttaaataattcatttttaaaatatatttctcttagaaaacttcataataaaaccccatctataatatatagcagaccttctatatattatagatgggggaaatttttatactattctaataaaattcttctcctgattgtctattaaatacttgagatgcctctaaacctaaatcttcgcatgcctgttcaaagctacatcccatttcatccatgtactttgcaacatatgaattaacatcgattggtgaattagtaaaatccatcatcattcctccttaaattttatatattaataattagtcttttcatcctttgaagattatattcatatattatgattaactatgaatattaattccaaatttttgttagcgtttacttttttacttgaaaaattcttaatataaatcttacgcaaacaagctgatgaatttcttactaatctattctatgattgctatttagaaatattctttatggtgagattttcttcttatgaattattaactactttacaaaatatatttaaattagaactgtattaaggagaagagttatggtattcatttttttattacttattattcttttattaggaggcgggggcttttttttcttaaaaagctacgatgataagtatattgctcttcaaaaaaacaatatgctattaaaatcccagctttcaaaaattaaagagaagtacgatttactagattcatcaacacaaaactgtaatcttgaatttttaactgtagataatcactacggcttattacctaaaaatactatagttagaataagtccttcaaataattcatgcattgtaaaaaaaatagatatgggtatgcaggtaggaattttagaaaaagttaatacaaatgattctacatggtattatgttgcccttcctctggataataacattaattcaagaggctgggtagaagaacctgctttttctgaaatatctaattctccaatagaaatttcttaaaaatattttatatgcaaagtatataataaaaatctttctagcgattccttataatgaagcatttatcttcattattttatgctcaaactatttttattttaaaattttcttatatttatatacttttttaagtaaatatcaattatatatatttatcaatcacttttatataaaaaaataacatatatcaattttgatatatgttatttttttataatctatcaattacttgatatctaactaaatattatatatcttcaatataaaatgttaatgttaattttttgttgaaaatatgtcaatagctttctttaaataatcccttagataattcttcccttcatcaggtaccatcattgctgttaaaagtatccccctattctcaagctctaagaaattttcaagatcatcattggttatactaactgatctttttatctgaatagtaccttttctagatgccatgttcccaacattaacctcttttatctctagtcctaaatcaattaaatctaatatatccttaggattcttaacaattatcattactctttgacctaggtatttctcatttaaaatattctttactgccgtttctttactcaatatggacgttcttatattggctggagccaccattcttaaaaatgttttttgaagttcatcattagctacttcatcatttattaccattactcttgatatttgcaatgaattactccaaaatgctactacttgaccatgtagtaatctatcatctattcttatatgaactataccctgcataatcgtctctcctttatacgcctatatttgacttcagaaaattatatacattataaataacattgtaattttctgttttaaattataatatatttttttaacttaaagcaaaaggaaattagcatgaaatttatttaatttatgctaacttcctttcttcagtttattttacaatgaatctttaagatacactttaggagctcctggtgtcattatagctgtcacttctactcctctttctataagttctttaaatgcttctttctcttctttagtaacactaattgtagtttttataacctctgtatttgattttgctgacatatttcctacatttatttcttttatatctaatccattattaagtaaatacaatatatccaatggtgatttaacaacaataaatactttctgtcctttatacttaccatctgatatattttttactgctgtttctttggtaataatagatgtgcttacattaggtggcgctgccattctaagtagtgatttttgcatatcattatttgcaacttcatcatttataaccattattcgtgtagcccctaattcatttgtccacattgtagctacctgtccatgaataagacgatcatctattcttatatgtgtaattccctccataactaatcaactcctattttaatatttttaatacatgtgcaagtactgcaattaccataaccaatagtattaaataaactggctttacttttttacccaaaagataataaactaaaaacacaagtgctgctggaattattccaggcataatttgatttaaaatatcttgtcctttcatggttacatcaccttgtgcaaattcaaaagctatattggctttaataacagatggaattaatgcacctacaaccattagacctagtattgcaacacattctgaaattgtttttaattttttacctaaagaatttaccaaacttgttccagacttatatcccatttcaaaaagaggaaaactcaacatttttaatgtaattccaactacgagccataaaactattccaatagcactaccttgaagtgccatattagcagcaattgctccaaatattgtccaaggtataacaacaaacatactatcaccaagcccagcaagaggtcccataagtcctgtttttagagatgctattgcttcagctgcattatttttttctttttcttcaatacctatatttaccccaagtacatatggtgcaatccatggatttgtattgaaaaactgtaaatgattttttactgctgtctgtagaccatccggatcatctttgtgaataaattttaggaaaggcataatagcataacaataagcaagtgcctgcattttttcatagtttgatgatacactacttgtaaatatccatctccataaaactttataacgtgtttttttatctaaaattgtttcttgttgttttacttcattactcatcttcatccatacctcctacagtttgagtttgcgcttctaattgagtattctttctatagttaagtaatgctattgcccctcctaatagagctactcccaatattggtacatttaaataaacagcaagtacaaaacctataataagataactaatataactttttactggtaaataacgtaatagtaatccaatacctactgctggaagcaatccaccagctactgataatccacctattagccattctggagtataatttaaaatagtgtttacaagatctggtccaaatactacagctaagaacactggtatccctgtagttaacattgtcacagctactcctaccatctgcattaactgaattttgttatattctcttgattccgcatatttttccgctttgtgttgtaaaaatatcccaaaagtatttcttaatacatctaattgaaccataaataatgctactggaatacctatagtaataccaacttctggcttttgaccagtagatatagttataaatgtaccaacaatagttgctgtttgataatcaggaactgatgctccaccaaagttactaataccaagtgacattaattgtaacgttcctccaacatacaaacctgttttcatatcacctaatatcaatccaactataaacccacacattacaggttgatatgttccaaacattgtgctgtttttttcatagttaataaataaaccatataaaataacaagtgccatttgccaaaattgtaattccatcgattcattcctcctttttattcgtcatcatcattcatattatttaaattaaatttttcactaaatataacggggttattagcttctataattgaaggtaatgcctcttttaggggcatatctttttgtttaagtactgcttccaatattccaggcatgttaactcccgcaataatttcatataatttattaaatttattaatcttagatgaaaatacattaaacgggcttccataaaacaaatctgtaaaaataagtacttcattatccctaatttcctgaattaccttgtccgcccttttttcaaattctgatattcctttgtcatctaagcatatagaatatatttccttatcttcaccaacaaaaaggctaagcgtatcatttatactttgtgctaaacttccatgtgtagcaataataattttatacatttctattctcctttcaatatatctttaaacataggaagcttaacagcttcattatttattttataaaataccggaattgaatcaatatcagctccaatcgtatagtaattaccaccactatattcctcacctgtatttgcatctatccaatcacagccttttggaagataaacttctctttctctttctttataatttataataggagcaactaaaacattaggtccaaacataaatgtattttctatatcccaagttgttttttcattaggaaaatcataaaataatggtctcattattggagtacctttttcatgtgcttctttcattaattccttaatataaggttttaaagcttcacgaattttaatatacttagtaaatattttttcattttcttctccataggaccaaatttcattaggagctccactagaacattgtcctccaccatctatacctaaaggctctgagtgtggttgcctatctccatgcattcttaacactggagtaaatgttccatattggaaccaacgtatcattaattctctaaattcttcatcattaggatttccgccatgaaaaccacctatatcagtagtccaccaaggtattcctgctattcccatattcaatccgctatttacttgatttctaaatgctttaaaacttgaatcaatatctcctgaccatgctagtgcaccatatctttgacttccagcccatgcacatcttactaagctaactatattttcttcaccttcttcttttaatccatcataaatcatctttgtatattctaatgggtataagttagcaacttgaagactcggcccattataatatctataattatcaaagtcatataccatgtatcctggctctgctacatctaaccaaaataatttaaaacctttacttacatagctttctttaagcttaccccaaacatatttttgagcatttggattcgttgtatcaatgaatactgtattaccaagctgctgcattgtcatttttacgcctctatccacatgaattaaatatccattttctaaaaattcttgatatgtcgtagcatttgttgaaactgttggccatacagaaatcattgcctttattcccatttcatcaagttccttaatcattttagctggatctggccaatatcgttcatcaaaatcaaaatgtccttgctctgtccaatgaaaaaaatcaattactataacagatggtgttattcctttttccttatatcttctagcaattttcaaaacctcatcttgtgtttggtatctcatcttgctttgccataaacctaatgcataatctggcatcataggtactttacctgatacatctgcatatttttcttcaatctcagctggtgtatcacctgctgtaatccaataatctaagattttggttgaatataactgccactctgtaatatttttagcgaagttaacctttccaatacctgggttattccatagaaaaccatatcctttactcgaaatataaaatggaacagatgactgtgagtttctttgtgctaactctatagaacaattctttagatttaaaaatgtttgttgatattgtcccataccaaatattttttcctctggatcagattcaaatcttactgtaagattataatcccctccaagtataggcttaaattcacgtggatttaattttaaagttgatgaaaatgcttttatagtttttacattaacatcttcattccctgtatcatttaaaactgctctttgacgtatatattcttcaagaataacttcatctttctgatttctaaatattattgttccccttgatgtaaatgttgctgatatattaccattttttattaaagcctcattatcttttattttaatttctaagttatcgttttctttttcttgtctgtcaatcaatgcccatttattatcaggcatttctggtaaaaatgttgccctaattctaaggctattatctccccatggttctatccatacggtttcattatcaaactttctaatcagcttatctctttcttttaaaaacataaactcattcctttcttaatttagctctatataatttttgcatatctttcttttatacttttatataaagcaagaagcgtgccacttttgtgtaacgcttctttaaattattaaaattttatattctgttttttataatgcccactattactgctgtttcataagctggaatttttattgaatattcttttaattcgttgtctaatatattctgtactaattctaaatcctttgtgtcacaatttatatgtatttcatcatcatcatcaaactttgtgtccctatttaatactaccctttctatcattattgctgtatgaataaataatgttaatcttaagtcactatttaatttaacttctaattcagtttccaatatatttattattctttctacatcatttattactctttctgggttcagtataatcattctacttataatattttgaagtgataatagctttattaagtctttaattaaagtatctgcacttctgttttttaaaatcttgcaaaatgcttttctaagtctttcttcaccatcttttctaaagcagtcacttaataaaatcacatcaaatccctttattttcaaatctagtgtacttattattaattcaacttcgtaatcatcaaataccatatcatttaatccattattctttagcttaaagtaatcataagctagcacttctatattttcatcttctatacaactctttattatatcttttattttagttgctactccaataccagtagcacagcatgtaataatagcctttttcttctctttgctctcaaaatatttataacttatatttgtatctcttattgctgtatctattatttcttttatggtcttttctttgagtatcatatctccaacacttaaggctagctgagtagttatattattaataacagcaacttcatcatccatactatcctttatgcttggatatatttcaaataaagaacccatatctactaaaaatatcgttcctttacttttggaaaaatttttaatatatttttttattattcctgttacttcctgaggattcatatctattggcatatcaaatggttcaaatataaattctccaagaagtttatttacaacacttgctatgctgcttgcagttgaatctccatgagcaactattataccatttatatcatttatatctttactttttgtaagcatataaataaatagtgtaatatacatctccccatttattccaagattaaattctctattgttttctatatcatttaatatttttactgaaatataattatatttgaaattcttattcttcaatatattaattatgtctttttgcatattaattatttctggattattaagttctttggcattttcaaataatagtaatgctgatgttattattctagaactattattgtagtattttattccataattattttctaatttgcttagtgctttctctactacatttaaagataatttgaaattgatattgtcattttcatgaatatcactagatattatcaagtcattaatattattaagtttgcttactaatatttttctatattcatcaacttttattaagttctcattatacttttctgtaatttcataaatttcttctatcatatttatatactgttcaattattatagtagtctcttttttacatactatctcagatattttttctccacattttatatgaaaatttgtatcaaaatacactttttttatattgccagcattaataaatgactctggtaaattatctaagccaataaccatttcacccgaatggctatttctaaagctacttgcacagctatatttaatagcatttttaagagctcctacattaccaaccttattcatgaataataaattattcataacttcactatttaccacaatatcattctttaatatatcactttcatctttataaaatctatatataagctctaccctttcatcaattggtctttcatcaatactaggtaagttagttataataggtattcttcttataaatgtatctattaaaaattcatctagtttttctgtagttgcacatattaaccttatatttacttttcttggattaccactttcacctattctctcaaaaactcctttatccaataataagaataacttttcttggccttctggtgataatctatgcacctcatcaagaaataaatacccatctttcgcttcatcaattacaccctttgattctttatcagctccagtaaatgcacccttaacatagccaaataactttgatgataatagctctttgttatctgaatactctgcacagttaaatgtaataaattttgcgtcttcctttattacctttttttctttagcatattcataaatcaattttgccataaagctctttccaaccccactacttcctgtcaaaaggataggtagtccatttctaggatacaatgtagccgatttacactctttaacagcattagctaagctaccgtttacccctataaccttactaaaaatatcatcttcttgatttaattgttcattattaaattgatcgattacttctttatataaaaaatatacaggacgagtctttgttttaattactaatccatcatcaaccatcctattcaaataatgacttattacatttctctttattccgagaacctcactaatctcttgcgctgttatcccttgttcccctttttttagggcattactacttagtgtagctataaccatttttatcttttcttcgtttttcaagtaaaccacctcacattttacttgttctatatgaatatatataatgtctttaccaagttttaatttattaacttagtagtaaacctcatattaaaaacgtttactaaatcttatttacagagcctatgatgaataatagtatcacatattaactattttttattaagatattaatgaattttaagtacaatcttttcaacacaatctcttttgatgatcatatatttatatcatataattaacagcataatatcatatctttgcattattttctacacttattataaggttactattatattttttatatccttactttttaacaaatctatttttacatcatagttgtaaactataaactaaatgttaaacaattttttatagtttatgtataataaaaatctttctggtaatactttataatgaagtatttaacttcaatatttaatcgcctctcccccatttttatttatatacaattagaaatcaccataattatttagcatgaaataattatggtgattttgcttttaactcttaatttaaatagtgaaacaatattaaaaacccatctgataatttattaaataaaatgtaccctttgtcaaggacagtttaaaaaaagtctaagcaacattaagaagatgatttctgtaatcaacaggagtcatcttttttaaattccattgagccctataattattatgataggcaatataatcatctatttctttaattaaatcttcaaaagtttcacattctttaatggttgtttcatcctttaagtgtccaaaaaacgattcctgcggggcgttgtcccaacagttgccacgtctagacatagattgtccaattcctttctctttaagtttcttttgaaaaattggacttgtatagtgagccccttgatctgaatgaataaatgcatctttatgtagagttaaaggggtattaaacaagttatcaattgtttgtgtaactatatttatttttaagcttttagataagttgtgagataatatttcattagtagatgcatctagaatagtcgacaaataagccttttgaccatctttataaaatagatatgttatatctgttaataacacttttgcaggtataccttgcttaaagtctctatttaataggtttggtaagactgtatgctctttagtagctttcatcattcttctatatggatttgcttttctgtgcggacaaataatgttatattttttcattatccttctaatgcgttttaaattatagttgataccaaagaatttttgcaaagtcatttttatttgtctagcacctttttttcggtttttaaactcgaaagcagcaactacatttttataactttcttggtccttagattcttgagcatttcgtttactcattgatttaagcgaaaaataattataatatccggagcgtgaaacgccagacaatccacatagataactaattttattttttattttatatttttcaacaattgattttattacgataaatttttcagaaactaataagtttacttctttattttcacgcccctttccatcatttctaacttttttaacaattcattctcagcttgtaagagttttatctttgcttgaagtttttcatatttttcttcaatagataattccttctcactaggccttccagtattaaattttctagtatcttgtaattgtgatactccatttctacgaaatgcggagcgccatctcttaccagatgattcaacacgtttcatacctaaaatttctatattaaaatcatgttcttcaaatatttgccttggaaatttaccattattattttcaactataaatattcttttaaattcatcagtatatgtaattcctttattactaactttttttacatacttatttttagatagtattgctatttcttcttctgtaaatatcttattgctcattttatcttctcctagttctatttatttaattatacataaaagtaccctacagaatagactttttttatattgtctatcctatagggtacattttaaaataccagataggctttatttaaaaagataataattttttaatattgctatccttaatatatcattaaggatagctttttatatgaacaattttttcatctcaatttacttctaaggaaatactcacaaaaaactagaaaaccattaagtacttacctaaaattaaatcaatctatgtatgtatgagaagaaaaaattagatgcaaggagagcttccataatagtattttatgttaatcacattatttttattcataactaaatagaaaagtaaattattaaacttatttttctatttagtcattttcatttgtttctgttagcattaatatagtaatttccatttgaatcatactctgtataatttataataaacttattatcttggagcattgaatttattacatctatatctttcctgtttcttttatttatctttattataaaattatcatctttgtctattatttttaaatagtcaaatatattgctgtaatcttctaaaccaatattgccgctaatattcatactataatttgacactggtttgttcatcctccttagctataagctatgtatatttctatccacagatagtatggctttattcgtataataatattcctattctactaaaaatgattatatttttaaatttttatatacaaaaaggtagcctaatttttctattataagctacctttttacatatacagataaatttttatttaataatctataaatcttctattattagaattaatttttatttttggcttcttttacactatttataaccttgtccacttctacctctggtacttcttcatatcttgcaaattcctttctgaacataccacgaccttgagttaatgatcgtaattcagtagcatattttctcatttcagccataggtacttcagcaataaccttttgtttttcaccttctggttccattccaataactcttcccctctttttatttatatcagccattacatctcccatatactcgtctggtattactacctcaacttgcattataggttctaataaaataggtttagcctgttctaatcctttcttataagctattgaagcagccattttaaatgccatttcagatgaatcaactgaatggtatgaaccatcatgaagtgttgctctaaggcctataacaggacaacctgctaatactccatgtgaaatacattctcttaaacctttttctactgctggaataaagtttctaggaacagcacctcctacaactttatctacaaattctaaatcctcttctccatcatctctaggttcaaatttaattacaacatctccatattgtccatgcccaccagactgtttcttatgcttcccttgaacatcagcaaagccttttatagtttctttgtatggtactttaggaagttctaactctatatcaactccatatttactcttaattttacttgcaattatattaatgtgagtttctcctaatccagaaataatagtctctgcattttcaatatccctagaaacctcaaatactgggtcttcatctttcaatttagctaaagactgagatatcttatcttcatcccccttagctttaggtattactgacattgagcaaacaacacttggaaaattcattttatcatatattatcttaaactctgaactacataaagtatctcctgtattggtgtactgaagctttgatatagcacctatatctcctgcttttatactctttgtaggaatttgattttttcctcgtaaaaaacagatatgtgataacttttcagatttgtccttgtttgtattgataacagtcatatcatcttgagcttcaccagttattactctaaaaaacgatattttacctacaaatggatccgcaatagttttgaatactattgctgaaaatggcttatcttctgcaagatttataaatacttcttcatttgtatcaacctttacagccttctgtggtattgcatattctggtgatgggaagcattcaacaatatcctcaattaatgtatccatccctataacttttaatgcacttccacacataactggtgcaatgtcaccacttgcacaaccttttattaaacctttatatatttcatcatcactcaatgttccttcactaaaatatttttcaagtaaagcttcatcggtttccgcaacagactccataatcattattttacatgcatgtactttttcttttaattcctctggaatatcaataggctttatttctttagtcttcatatcataaattcttgcctcttcagaaataacattaattactcctttaaaattatcctcagcacctataggatactgaattggaactacgcttattccaaatttctgattaagttcatcaagtactttatcaaaattcgaattttctctatctaatttatttataaatatagttcttggtaattttattttattgcaatactcccatgccttttctgtaccagcttttacacctgatacaccacttacaacaatcatacctacatcaacggctctcataccctgtatcaattccccttgaaaatctgcataccctggaatatcaactatatttatctttacattatctaactctactggtgctactgataatgaaatagaaaactgtcttttcttttcttccgaatcaaagtccattactgttgtaccatcttctatttttcctaatctgtcaatcacctttgaataatataaaatactttctgctaaagcagtctttcctgtaccattatgtcctataagtccaacatttctcaaattgttgatagtataatctttcataaattctgccaagtcctaaaattttattagaaattggctctcacctgcctttcatgtacaataatgttgaatgtcctgcttttaaaaataaatttatttaagaatacattattcttttatttagaattatttacattcagtatattatatgtatcctttttacctataattaataattctacgcttatttatgaaaacctttttatttttctaaattttctgaaaattaaatcttgattttgtattgtccctttctttgtattataattaaatttgatttgaaaaaattatttattattattttttattaaggagtttaatatttatgaagagtaattcactaaataaacaaaatgggcctaccataaataaattcagtatatactttactaattttgtagtttactcattatttatactgtttctaatagtattttttacagccttttcctctgtgtatattaattttaaaaatatcaattatgtaaatatcactttaataggaatctacttgatattaactggtggctttatttatggaatacgaaaaaagatctcaaaaaagaaaatgttttacgctattcttatttcaggatttattttaagacttgcatgggcacttgtaactaaaagtactcctatttctgactttaaaacaatatatgattctgctactaaccttttagcaggagataatagctcttttgtgggacttggatactttgcaagatttcctcatatgacaccatatgttttattattttcacttattataaaattctttggaagcaatgcactttttgttatgaaaatgatcaatgtaatattttctacaggagcaattgctttagtatatcttatatgtaataaaatatttaaagactacaaaaaagtattacttggaacattctttatttctatacttccgtctgcaattttatacgttcctgtatattgctctgaaaatatagctattccattttatttagcaagtatatacctattcatcttagttgttgagaaaaaaaataactgcttattacttgccttaagtggagttcttttatgtataggacatttatttagaatggtagcatatataattttaattgcttatataatgtatatatttatatataacaaagataaaattataatcaaacttagaaacatccttttaatcttgattcctttcatacttgtttttgtagtattttcaaatagtcttataaaaatgaatattacagacagaaatatttgggatggaagtgagcctaatatcacctctgccgtaagaggaagtaatctagaaagtggtggaagctggaatcctgatgatgctaaattcattgaagaccttcttcatactactgataaggaatcagttgctgaagcatgtaaagaacgaattattgaaagatatacaactacacctccattagaacttggaaaattctttgtaagaaaaatcgctactcaatgggcatatggagataatgctggtgcttactggtctcagcttggcattgatgaaaataatgtgacttttgatatttcaggaaaaggagttttatggtatcagcttgtttatgcaatccttctattatgtataataaaaggattgtttaataaaaatgaacatattgataataaaataataaatctattttatattatcttatgtggatttggagcaatgcttcttatactagaaaaccaatgcagatatgcatttataattaattatatatttgcaattcttcctgttacagcttttaaatcgtcaaatgaaaaataagttactattaatatataagcaactactaagttaatttataattaataaaaaaagtttagattctgaaaaacgttctgaatctaaacttttttatttttactcttgtatttcctgatgattatcttttttattgaaagcaaaaaatttcattattataaatgtaacaggaacacctacaattgcagctaatgcaaatacaattaatttattccaatgaagcatattatagaatattaatacaaaaatattttgtattataaaattaggaatatatgatatacagaatttaatgtatttaataacccccatatcttccttaaaaactaatgtactatttaaaagatatgaaattgtcattgcagtaacatatccaagtacaaaagaaacattaacacctaaaaacaaagaatatacatatgaaaatactattccatttatagtatttatccctcctacaataagaaaagtaaaaaactcttttgtaaaaaatatattttttaattttttaaccttaccaggactatactgatcccacggaagaatattatttccactcactatatatctctcactagccattaatgaaataggtgcatcacttaaagaatccgaatagaatttttttatttcccctttttcaaagtactttttaaatcttaataccttttcttctccataacaattttcaccttcgcatattcctgtatctttattcacttctgaagcaattaaatgctttatacctatccttctgcatatagtatttaataaaaactctggagatgctgaaattataacatcactctcttctttgctctttaaataccagtctttaattttatcctgattttcattccaaaataattcaaccatactatcaacatcttttattcctttcaaaaatgaataaaacttttctttaaattgaagctttgaatacatcccaaacatatacttaataaatcctataatttgaattggtaaaaacctaataagcattggacttttcttaagtgaaaaaaaataaaaatctaaagtgctatcaccatcataaattgttttatcaaaatcataaacattcattaattttatcctcaacttttttctttaattataattaaaatcttataattaaaaattataagattttaaaattcatgttttttaaatatttatattttacaagtactctcattctataaataatattaatcatattctaaatcacaatatcaaataatatataaattaatattattttttacacatatattattagcaatacaataataatgtacagtagcgttaaagcaattaagaacttatccttaagaagtacacttacaggatctccatcagattctccttcaacatttaaactgtatttcatgcaaataatcataactaatgggactgtccatacaagattattttgtggatatctttctattgttgttggatcaacacaccataacgaataaaatactatggtaaggcctaagcacatatacatatttttatccagaaaatcatgattatagtactttaatacttttctacttttgcttccttcagtttttaattcatttcttcttttcccaagacctaaatagaatgacattgcaattacagttaaataaagccaattagatacatttattgatgtaattgcagaaccatataatactctaaacaaaaatccagatactaaaatagtaatatccattataggcatattcttaaatcccatactataagcaaaattgaaacctacatacattattacaaaaagccatgccttaatgtttaatccacatgcaagataattaaaggctattcctacaattgcaataaatactgctaatacatatgcttcttttattgacactgctccacttgctataggtctcttacatttagtagaatgtcttctatccttctcaacatcttgtatatcatttattacatatacaatggatgacaatatactaaatgaaaaaaatccaaatatagttttacttaataaatcaatattaaataaattctgactgaaaacaagcggtaaaaaaattaatacattttttaaataatgatgtactctcattaatttcaaataatttttcatattttatacctctgtatatatttaaaataaaatttagtcttttataaaatctactgcaaatttcttatattatcattccttatatttctaatatatagaaaatttaatacatattaaatttacacttttattattatactatattaaaatttgtttaacaaaccttcttgatttaaaacataattaatattattcttctattgtaaaattatacatcatataaaatttaattactttattattagcataagttatttttaatacttttaaaatttgcttcattgcaaaatatattaaaaaaatacgaggatatacctcgtatttctcgtactttttattacatataattttaatctattcttcaattacatgaagattcctactccaacacctaatggtaatttaaatataaaccaaagcattaataaaatactccatcctattaagaatactattgagtatggaaccattgttgatataagtgtccctattcctgagtctttatcatatttttctgcaaatgcaacaattaaagcaaaataactcataagaggagatattatattagtagcagaatctcctattctgtatgccatttgtgttaattctggagaatatcctattcccattaacattggaacaaatataggagccattatagcccattttgctgatgcagaacccatgaataagttaatgaatgctgcaactactataaacgctaataataatggaattccttttattccagtagcttctaagaagttagctcctctaacagctataacagttcctaatttagtataactgaaatacgaaacaaattgagctgcaaagaatactagaactatatatgaacccattgctgacatgcttttacccattaagttaattacttgcttgtcatttttaatagttctttcaccgataccatatgcaatacctggtattaagaataatatagcaataattacaactatagaatccataaatggtgattttaatatttcatgtgtttctggatttcttaatattccattgtaaggtacaactaataataaaatacctattaatgttactaataatgcaatacctgcaaataataatcctcttttttgttccttagtaacttccattacttcttcgttgtcattgcctttatattctccaagtctaggctcaacgattttttcagttacaaatgttccaagaatagttataagaaatgctgatgctattataaagtaccaatttcctgtcattccaacttcatatgttgggttagcaagccttgctgcttcagttgtaataccgcctaatagcgcatctgttggccctggaagtaagttagcactaaatccaccggataccccagcaaatgcagctgcaatccctgctaatggatgtcttccacagcttttaaagattactgctcctaatggtattaaaacaacatatcctgcatctgaagctatactagacataacccctgcaaaaacaactactacagtaacaaatttctttggagtacttaatactaatttctttaatacagttgaaattaatccacttccttcagcaactccaactccaagtaaagctactaacactgttccaagtggtgcaaaaccagtaaagttcttaattgcacttgtgaacacatatctaattccttcaggagttagtaaacttacaacccctactgttaactcttttaattcacctgatgccacatcaatgccttcatatgtaacagaaacaccaagcttgtacgcaatatgtgatacaaccattattattgcacataatattacaaatagtgtagttggatgtggcaatatatttcctatcttttctacagtgccaagtatccccaactttttcttcttattttccataatttcctccttggtaaaatagtatgatacacatcaaataacatcatactctgtatttacgtatattatataattaaattaaatatttttcaatatttatttaaatatgttaataaagttacagtatattttgtaatattatatatatctatataataaatatgtatatttattagctgtttttatttatactacattgatttttttagagtacttgttcttaaatttattttacagtttaagattatttataaactttaaaagattaaattataaaaaagaatgcagaaaaaatctgcattcactctattcattcatttattctattcttaattagtaatctttttaaataaaacaataatgctgatactgttccaccagatgtatcaataaatatatctctaaggtttccatctcttcctgatacaaataactgatgaaattcatcagtacatgcatataaaaatacaccactaattactattaaaacaatatattttagctttaagtcttctttaattaaatttattattaaaaagcctaatatcatatattcaagaaaatgtgcacattttcttacaatgaaattagctatatcaccaaaaataccgctcatatcaattcctagcttagataatatactaataatcccaaggctctgtgaatcagatgtttcagcaggctgattagacattaaaaatataaaagtcatccatataacaattagtagtaaatttataacatacttcttttttgtaaaatatttgtttatcatattattatccttatcttattatagtattaatttctttctgacatatatctattaatgtaagcaagagattcttctaaaagttcctgacccttttccaatccctctattttcatttctaaattacatactctctggtcaatttgattcataagctgctttatatcttgcaataaatgtgcctcataagtaacttgtattccttctgcatcaataaaaactttttcaggaggataaccacatttagtacactttgccattactccttttttctccaaatcaacaaataccttaaatatatcgttattgcatctttcacaattagataacatagtgaagtcataatgactcacatcataataataattatttccacattccttgcaagttaattttaatttattatcttctgttactatataaaattcatttcctttgcatccgtcttttttacaaactacagtccttatcatagcttccatatcctttccaaattactaatttaagcgtgtaccactataatacaccttaataaatattatgcttgaaagtatccatctatgaaatagaatttatagatcttatcataactttaatattctattttccgtagttgcaatttatgctaaaacgtaattattttcagaaattaatattatttttctaaatgttccttaatttcctgttcaactaatcttatcttataatcaagctcttctgtatttttcccttctaatacaaaacttctttttgtcagttttaattctttcaattgatcttctaaaaccatattggtatccataaatttttcatctccattcaaaattatccctaattacacatcaataaaaattcatttcaacttctattataattattgttatccaatctgtcacttaattgcttaaaattaactatctttattcattttattagtatatttagatcaattctaattattactaataaaataaatttattttattagtaatttatatatctttatgtctctaatatactattcattgcaaacagattaacaacatttttataatattctttctcttatgtttttatcacacaatatataaaaaaagactatgaataaattcatagtcttaattatggtggagataaagagattcgaactcttgaccccctgcgtgcaaggcaggtgctctcccaactgagctatacccccaaaatggtggaccttcagggactcgaaccccggacctaccggttatgagccggttgctctaaccaactgagctaaagatccttctaatcttgataaacaagattacctggcgacgtcctactcttccacacagtctcccatgcagtaccatcggcgctatagaccttaactgtcctgttcggaatggaaaggagtgttacctctatgccatcatcaccagatttatgtactcttcacttttagtgaatttcctcactcaattttgaaaaaactttttgttctttcaaaattgcacataagtgagaatccaaattttacatttggttaatcgaacttactcagcgaactaagtgagtcgagtttcctcttaattaatgtatttacaacttgattatattggtcaagccctcgacctattagtatcagtcagctaaatacgttaccgcacttacacctctgacctatcaaccttgtagtcttcaaggggtcttactagcttatgctatgggaaatctcatcttgaggtgggcttcacacttagatgctttcagcgtttatcccttcccgacttagctacccagctatgcttctggcgaaacaactggtacaccataggtcagtccatcccggtcctctcgtactaaggacagctcctctcaaatttcctacgcccgcgacggatagggaccgaactgtctcacgacgttctgaacccagctcgcgtgccgctttaatgggcgaacagcccaacccttgggacctacttcagccccaggatgcgacgagccgacatcgaggtgccaaacctccccgtcgatgtgaactcttgggggagatcagcctgttatccccgaggtagcttttatccgttgagcgatggccctcccacgaggtaccaccggatcactaagcccgactttcgtccctgctcgacttgtaggtctcgcagtcaggctcccttatgcctttacactctacgaacgatttccgaccgttctgagggaacctttgggcgcctccgttacattttaggaggcgaccgccccagtcaaactgcccacctaacaatgtcctgtcaccagtttcatggcatccagttagaacttcaatactatcagggtggtatcccaacaacgactccattaaggctgacgccctaatttcccagtctcccacctatcctgtacagacaataccgaaattcaatgctaagctacagtaaagctctacggggtctttccgtccaatcgcgggtagcgagcatcttcactcgcactacaacttcgccggattcacagttgagacagtgcacaagtcattacgccattcgtgcgggtcagaacttacctgacaaggaatttcgctaccttaggaccgttatagttacggccgccgtttactggggcttaagttcacaccttcgcttgcgctaagtgttccccttaaccttccagcaccgggcaggcgtcagcccctatacatcagcttacgctttagcagagacctgtgtttttgttaaacagttgcttgtgcctattctctgcggcctaccagatggtaggcaccccttctcccgaagttacggggtcaatttgcctagttccttaactgtgattcttccgtcggccttaggattctctcctcatctacctgtgtcggtttgcggtacgggcactacttctctttctagatgcttttcttggaagcatgaaatcagatacttcggttccgtggaaccttccccatcacgccctaggattgttagaacggatttgcctgttctaactccctcaacgcttagaccagcatccaatagctggcacatcctatccttctccgtcacaccatcgataataacgattatagtggtattggaatatcaaccaattgtccatcgactacgcctctcggcctcgccttaggtcccgactaaccctgagaagacaaactttactcaggaaaccttagatattcggcctgtaggattctcacctacatctcgctactaatgccaacattctcactcgtaatcagtccaccgctccttacggtacgacttcagcccgattacgacgctcctctaccgctcatacaaagtatgaacccgtagcttcggtggtaagtttgagccccggacattttcggcgcaggatctcttgactagtgagctattacgcactcttttaatgagtggctgcttctaagccaacatcctagttgtcttagaaatcccacatccttttccacttaacttacactttgggaccttagctgacgatctgggctgtttcccttttgaccatggaacttatctttcatagtctgactgccgtgctgatagtatctggcattcggagtttgataaggttcggtaagcgctatgccccctagcctattcagtgctctacctccagtactcacatttcacgacgctagccctaaagctatttcgaggagaaccagctatatccgagttcgattggaatttctccgctatccacagctcatcccatgctttttcaacagcaacgtggttcggtcctccacgaggttttaccctcgcttcaacctggccatggataggtcacccggtttcgggtctacagcatgcaactagtcgccctattaagactcggtttcccttcggctccgtaccttaagtacttaacctcgctacataccgtaactcgttggctcgttctacaaaaagcacatcatcacacacataaggtgctttgatcggttgtaggcacatggtttcaggttctatttcactcccctcccggggttcttttcacctttccctcacggtactgcttcactatcggtcatcaggtagtatttagccttgggaggtggtcctccctgcttcccacaaggtttcacgtgtctcgtggtactctggtgcagaactgatcattatgacttttacttacaggactattacctcctacggtccaactttccagttgtgttcggttaatcataatttcacgttatgttctgtccgcaaccccagagataaatctctggtttgggctctttccttttcgctcgccgctactaagaaaatcgatttttctttctcttcctctaggtacttagatgtttcagttccctaggtgttccttcataaagctatgtattcactttacgatgcatgaggtttctcatgcgggtttccccattcggaaatctccggatctctggctatgtgcgcctacccgaagcttatcgcagcttatcacgtccttcatcggctcctgatgccaaggcattcaccatgcgccctttgtagcttgacctttttaagttttgatatacaaaactggttatattaatcattcacaaagaatatttattcttggctttgttgtattatatacattaatctatgtgcaattttcaaagaacatttttatttttatttcgtcacctctcagcgacaaatactattatataaacttaatccgtatatgtcaacacttttatttattttttttatcttttttataaaaatccagcaatccctttaataatcaaggattcgtccattatatttctctaaatttagcattaaattaagaaaaaactactatgttttttaaatttgtagtgtcgaatttaagtttactattcaattcatttttgtaagatctataatagttataattcactttcaatttaattacaaagttttcattttcaataaaaaatagccaaggcaactgtgttatataatatattaaaaagtcaactctattaaaattaataccttaataaagaaaattctttagcataaacttttttaaacatgcaacttgattttggattcttttgaaggctataattattctttattctttaggtttctttttttaatactacaacttttactattttaaaaattattcatagatttgatatttcacttcattataattttctaagcaataaaaaaagctactgcatattgcagtagctttaaaaatctctcaaaattgaacagaatcaatactcattaagtaacctttgagcaagttgtaatttttatagatgctttgcatctttatactagtcaaacaccatgtttgctagatttctccatagaaaggaggtgatccagccgcaggttctcctacggctaccttgttacgacttcaccccaatcgctgaccctaccttaggtcgctgcctccttgcggttagctcacgaactttgggtattgccaactctcatggtgtgacgggcggtgtgtacaaggcccgggaacgtattcaccgcgacattctgattcgcgattactagcaactccagcttcatgtaggcgagtttcagcctacaatccgaactgagatcggttttatagttttgctcactctcgcgaggttgcatctcattgtaccgaccattgtagcacgtgtgtagccctagacataaggggcatgatgatttgacgtcatccccaccttcctcccggttaacccgggcagtctcgctagagtgctcaactaaatggtagcaactaacaataagggttgcgctcgttgcgggacttaacccaacatctcacgacacgagctgacgacaaccatgcaccacctgtcttcctgccaccgaagtggcttcctccattacagagtaattcaggagatgtcaagtctaggtaaggttcttcgcgttgcttcgaattaaaccacatgctccgctgcttgtgcgggcccccgtcaattcctttgagttttaatcttgcgaccgtactccccaggcggaatacttaatgcgttagcggcggcacagaggtcatgacaacccctacacctagtattcatcgtttacggcgtggactaccagggtatctaatcctgtttgctccccacgctttcgagcctcagtgtcagttacagtccagaaaggcgccttcgccactggtattcttcctaatctctacgcatttcaccgctacactaggaattctcctttcctctcctgcactctagatatccagtttggaatgcagcacccaggttaagcccgggtatttcacatctcacttaaatatccacctacgctccctttacgcccagtaaatccggacaacgcttgccacctacgtattaccgcggctgctggcacgtagttagccgtggcttcctccttaggtaccgtcattatcgtccctaaagacagagctttacaatccgaagaccgtcatcactcacgcggcgttgctgcatcagggtttcccccattgtgcaatattccccactgctgcctcccgtaggagtctgggccgtgtctcagtcccaatgtggccgatcaccctctcaggtaggctacgcatcgtcgccttggtgagccgttacctcaccaactagctaatgcgacgcgggtccatctcatagcggattactcctttaattgctgtaccatgcggtactacaatcttatgcggtattaatcttcctttcgaaaggctattcccctctatgaggcaggttacccacgtgttactcacccgtccgccgctaatccactcccgaaggagcttcatcgctcgacttgcatgtgttaagcacgccgccagcgttcgtcctgagccaggatcaaactctcaataaaaagtttaatcttagcttactcaaaataaagaattgctggtttacttaaatgtttatattatattctgttcaattttcaaagatcttataatattcttattttaataataagaatatctggcgacgtcctactcttccacacagtctcccatgcagtaccatcggcgctatagaccttaactgtcctgttcggaatggaaaggagtgttacctctatgccatcatcaccagatttatgtactcttcacttttagtgaatttcctcactcaattttgaaaaaactttttgttctttcaaaattgcacatagtttttaatgtatttacaacttgattatattggtcaagccctcgacctattagtatcagtcagctaaatacgttaccgcacttacacctctgacctatcaaccttgtagtcttcaaggggtcttactagcttatgctatgggaaatctcatcttgaggtgggcttcacacttagatgctttcagcgtttatcccttcccgacttagctacccagctatgcttctggcgaaacaactggtacaccataggtcagtccatcccggtcctctcgtactaaggacagctcctctcaaatttcctacgcccgcgacggatagggaccgaactgtctcacgacgttctgaacccagctcgcgtgccgctttaatgggcgaacagcccaacccttgggacctacttcagccccaggatgcgacgagccgacatcgaggtgccaaacctccccgtcgatgtgaactcttgggggagatcagcctgttatccccgaggtagcttttatccgttgagcgatggccctcccacgaggtaccaccggatcactaagcccgactttcgtccctgctcgacttgtaggtctcgcagtcaggctcccttatgcctttacactctacgaacgatttccgaccgttctgagggaacctttgggcgcctccgttacattttaggaggcgaccgccccagtcaaactgcccacctaacaatgtcctgtcaccagtttcatggcatccagttagaacttcaatactatcagggtggtatcccaacaacgactccattaaggctgacgccctaatttcccagtctcccacctatcctgtacagacaataccgaaattcaatgctaagctacagtaaagctctacggggtctttccgtccaatcgcgggtagcgagcatcttcactcgcactacaacttcgccggattcacagttgagacagtgcacaagtcattacgccattcgtgcgggtcagaacttacctgacaaggaatttcgctaccttaggaccgttatagttacggccgccgtttactggggcttaagttcacaccttcgcttgcgctaagtgttccccttaaccttccagcaccgggcaggcgtcagcccctatacatcagcttacgctttagcagagacctgtgtttttgttaaacagttgcttgtgcctattctctgcggcctaccaaatggtaggcaccccttctcccgaagttacggggtcaatttgcctagttccttaactgtgattcttccgtcggccttaggattctctcctcatctacctgtgtcggtttgcggtacgggcactacttctctttctagatgcttttcttggaagcatgaaatcagatacttcggttccgtagaaccttccccatcacgccctaggattgttagaacggatttgcctgttctaactccctcaacgcttagaccagcatccaatagctggcacatcctatccttctccgtcacaccatcgataataacgattatagtggtattggaatatcaaccaattgtccatcgactacgcctctcggcctcgccttaggtcccgactaaccctgagaagacaaactttactcaggaaaccttagatattcggcctgtaggattctcacctacatctcgctactaatgccaacattctcactcgtaatcagtccaccgctccttacggtacgacttcagcccgattacgacgctcctctaccgctcatacaaagtatgaacccgtagcttcggtggtaagtttgagccccggacattttcggcgcaggatctcttgactagtgagctattacgcactcttttaatgagtggctgcttctaagccaacatcctagttgtcttagaaatcccacatccttttccacttaacttacactttgggaccttagctgacgatctgggctgtttcccttttgaccatggaacttatctttcatagtctgactgccgtgctgatagtatctggcattcggagtttgataaggttcggtaagcgctatgccccctagcctattcagtgctctacctccagtactcacatttcacgacgctagccctaaagctatttcgaggagaaccagctatatccgagttcgattggaatttctccgctatccacagctcatcccatgctttttcaacagcaacgtggttcggtcctccacgaggttttaccctcgcttcaacctggccatggataggtcacccggtttcgggtctacagcatgcaactagtcgccctattaagactcggtttcccttcggctccgtaccttaagtacttaacctcgctacataccgtaactcgttggctcgttctacaaaaagcacatcatcacacacataaggtgctttgatcggttgtaggcacatggtttcaggttctatttcactcccctcccggggttcttttcacctttccctcacggtactgcttcactatcggtcatcaggtagtatttagccttgggaggtggtcctccctgcttcccacaaggtttcacgtgtctcgtggtactctggtgcagaactgatcattatgacttttacttacaggactattacctcctacggtccaactttccagttgtgttcggttaatcataatttcacgttatgttctgtccgcaaccccagagataaatctctggtttgggctctttccttttcgctcgccgctactaagaaaatcgatttttctttctcttcctctaggtacttagatgtttcagttccctaggtgttccttcataaagctatgtattcactttacgatgcatgaggtttctcatgcgggtttccccattcggaaatctccggatctctggctatgtgcgcctacccgaagcttatcgcagcttatcacgtccttcatcggctcctgatgccaaggcattcaccatgcgccctttgtagcttgacctttttaagttttgatatacaaaactggttatattaatcattcacaaagaatatttattcttggctttgttgtattatatacattaatctatgtgcaattttcaaagaacattgaaagacttagtctttcaaaattgaacagaatcaatactcatcaagtaacctttgagcaagttgtaatttttatagatgctttgcatctttatactagtcaaacaccatgtttgctagatttctccatagaaaggaggtgatccagccgcaggttctcctacggctaccttgttacgacttcaccccaatcgctgaccctaccttaggtcgctgcctccttgcggttagctcacgaactttgggtattgccaactctcatggtgtgacgggcggtgtgtacaaggcccgggaacgtattcaccgcgacattctgattcgcgattactagcaactccagcttcatgtaggcgagtttcagcctacaatccgaactgagatcggttttatagttttgctcactctcgcgaggttgcatctcattgtaccgaccattgtagcacgtgtgtagccctagacataaggggcatgatgatttgacgtcatccccaccttcctcccggttaacccgggcagtctcgctagagtgctcaactaaatggtagcaactaacaataagggttgcgctcgttgcgggacttaacccaacatctcacgacacgagctgacgacaaccatgcaccacctgtcttcctgccaccgaagtggcttcctccattacagagtaattcaggagatgtcaagtctaggtaaggttcttcgcgttgcttcgaattaaaccacatgctccgctgcttgtgcgggcccccgtcaattcctttgagttttaatcttgcgaccgtactccccaggcggaatacttaatgcgttagcggcggcacagaggtcatgacaacccctacacctagtattcatcgtttacggcgtggactaccagggtatctaatcctgtttgctccccacgctttcgagcctcagtgtcagttacagtccagaaaggcgccttcgccactggtattcttcctaatctctacgcatttcaccgctacactaggaattctcctttcctctcctgcactctagatatccagtttggaatgcagcacccaggttaagcccggtatttcacatccacttaaatatccacctacgctccctttacgcccagtaaatccggacaacgcttgccacctacgtattaccgcggctgctggcacgtagttagccgtggcttcctccttaggtaccgtcattatcgtccctaaagacagagctttacaatccgaagaccgtcatcactcacgcggcgttgctgcatcagggtttcccccattgtgcaatattccccactgctgcctcccgtaggagtctgggccgtgtctcagtcccaatgtggccgatcaccctctcaggtcggctacgcatcgtcgccttggtgagccgttacctcaccaactagctaatgcgacgcgggtccatctcatagcggattactcctttaattgctgtaccatgcggtactacaatcttatgcggtattaatcttcctttcgaaaggctattcccctctatgaggcaggttacccacgtgttactcacccgtccgccgctaatccactcccgaaggagcttcatcgctcgacttgcatgtgttaagcacgccgccagcgttcgtcctgagccaggatcaaactctcaataaaaagtttaatcttagcttactcaaaataaagaattgctggtttacttaaatgtttatattatattctgttcaattttcaaagaccattttctttcacaactttacgttgttattatgttgtcaccctcaagcgacttacttagtatatcacttgaatttgatttttgtcaacaacttttttcaaaactttcaaatcttttctttaaagtatttaatcatctttaattccagttgtttgtcacctcagcgacgtgttttatcttaacattgaattaagtaatcatttttacaaaattattctatatatttaaattatattcaaaataatcaatattaatgcaaaatactcattttttctactattgatacgctaggtatagttattgttctaattctcctataactctatagacatatgtttaaataatgcttataaccaaaaatgaagttgttttttattatactttttcttttatttacctacacaattataatataattcataaaaaaatcgcattgaattatcagttctaatataattattagaatttaccaatgcgactttagtattttattttttattatatcctatcttttcaagtataatcagtgctgtatcttcaatagccctttctgtcacatcaataattttacatcctacttttctcattattttatcagcatactcaagttcttctaatactcttgcatcacctgcatactcaatatcagaagttattctatggaacttatctaatcttctttttcttatttctattaatctaagtgggtttattgttaacccaaatactttttttctatcaacttcgtatagttcatctggaactccaacctcaggcattagaggcaaatttattgctcttactcccttattagcaagatacatacataaaggagttttagatgttctagataaaccaattaatacaacatctgcattttttaatcctctataatctttactatcatcatattgcatggcaaattccatagcttctattctcttaaaatattcttcatctgtttttctcattgctccaggattatatgttggctgcatatttaacatatttgctgcaacatttattattggacctagaacattcataacagagatatttctctccatagctttttgtgttaagtattcacgcacattaactgttattattgtagatattataataacattatcacattgttctgcacatttcataacatcttccacatcttctaaagacttaatatacggaattcttttcacttcaactttttcattaaactgacttgatgctgctattgcaacttgatttgctgtttcacctatagaatcagaaacggctaaaaacgttaacataaaatcataccctctttctaaaatattctagctaaatatttttatttattcccttttagtaaccattttacatatttaattatatttttatattactcttttttttatagttttaatagtagtgaatttttatttaccatatgttacactttaaggtagtatgaattatttggaggtgaactatgaatactaaaaaagcattaacaataagtgttcttcctgcaatgtggttaatctatataatatttgaattactcacaggaagaatcaccgatttaaaaactattatttttaatatctttcttatacttctttttgccctagtaggatacattatatacagtataagcttgaaacataataatggatttgattttaataatttgctaatattatttttaagttttctttttattgatcaaggatttaaaatagtcataaagttcttttattttaatgttcgaaaaacgctaattcctggtgttctttatttcagtcctataataaacacagatggttcttggttaaatgcacgttttggcacatcagtaagttttcctttattaataatagttaatgtattagcattaattttatttatagaggtatatagatactatcactttaagggtaataaagatttttggtcagatatgtgttttatttttgttttatgtggagccttatgctcattaatagataaagttttctatggtggaagtttagactttataggaataagcaatttattcatagcagatataaaagatatatatataaatcttggtatactattttttatacttactctttttaataatggttatctttcttctgaagaagacacctcattaaaagatgatattaataatataaagaaatttcttatttttattaagaatgatatagtaaatacttttaaatcttaaaagtatttatatatcaactacttattttactatatatatagatttaagcttatataatatgttaaaatttataataatgtatataaattgcaattatactatatgattacttattgtatcagtattataaattaaaacattaaaatctgattgtaaagattaatttctaagcaaaaagaggatataattaaatctaaaaaagtgctttagtaaaagtatttttcatgataataaagatcttctgtcctgcacagaaggtctttatttatttctctaagaaacattcctttgttttaattatattatcacaaataaactatcatatacctaattgcatatctacttaaatactaaataaggagaattaatatgtataatacaccaaaatcaaatagacttcatatttcaattttcggaaaaagaaatgctggaaaatcaagcttgataaatgccttaacaaatcaatcactttctgttgtttcagaaatccctggcactacaaccgaccctgtttctaaatcaatggaacttcttccattaggtcctattgtactaatagatactgctggacttgatgataatggacttcttggagaattaagaattgaaaaaactctaaaagttattgaaaaaactgatttaggcgtacttgtctttgatgcatgcagtaacgatttaaaaaatgaattaacttggtatgcagatttagaaaaaaagaaaatacctacgataggtgttataaataaaatagatttatgtaatgataactgtaaattaataaaatctaatttcaatattccatttgtagaaataagtgctaaagaaaagattaatatttcaggtttaaaaaaattacttattgataatgcaccaattgattttgagatgcctacaattttaggtgatatagtaaaccctaaagacaaagtagtactagtagcacctcaagatattcaagctccaaaaggaagattaatacttcctcaagttcaaataataagagatatactggacaatgatgcactagctctaacagtaaaagatactgagcttttagatattcttgactcattaaaagatgaaccatctcttataataacagattctcaaatgtttagaaaagtaaatgaattaattcctgaacatttaaagcttacttcattctcaatattaatggcaagatacaaaggtgatttagatctgtttataaacggtgctaaagttataaattcattgaaacctaatgataaaattttaatcgctgaatcatgtacacatcatgctcttaaaggtgacattgcacgcgaaaaacttcctctattattagaaaaaaaagttggtggaaaattgaatatagttaatattactggagttgattttcctgataatctatcagaatataaattaataattcattgtggtgcatgtatgtttacaagaagacagcttctttcgcgattagagcatgtaaaagaacaaaatatacctataactaactttggagtagcattagcagaattgaacggaattctagatagatcatgtaattttcttttaaattctaaatcttaattgacgacaaaaccattttctcatataaacttaattaaaataaagttagagcatgatttaatatcaactctaactttttattttatgataaacaaaaaaagagcttttacaataaagtaaaatactcttatatataaatactaagcaagttttcactacaatttaatttggtggctcacccgggaatcgaacccgggacaccatgattaaaagtcatgtgctctaccgactgagctagtgaaccacaatatgatacatattgttctaaatcttttgtcgaacaattgcctcaacaagatattattatacagactattatgtatactgtcaatacatttttcatatttttttaataaatattttaaattattttattttatagaattaccttactcatatattgactttatacacaaaaaaataaaataatccacactttttatgaattattcattcatttctgtggatatttatctttcaactgtagataactttagaaaaaatctttaaattctgtttttcactctttattatcttgtccaatttaatactatatatttatactgaataataattttcacattataagtctttctttttaaattcatataaaattagacaacaaaaaaactgttgaatatttacaacagtttttggtgcgagatcaggggttcgaaccctggacaccctgattaagagtcaggtgctctaccaactgagctaatcccgcatatttcacctggcgacgtcctactcttccacacagtctcccatgcagtaccatcggcgctatagaccttaactgtcctgttcggaatggaaaggagtgttacctctatgccatcatcaccagattaagtgagcttccaaattttatatttggttagcgaacttatgcaaatcgttttagcgatttgtattcattattaacttttgaaaaaacttttttgttctttcaaaattgcacatagtttttaatgtatttacaacttgattatattggtcaagccctcgacctattagtatcagtcagctaaatacgttaccgcacttacacctctgacctatcaaccttgtagtcttcaaggggtcttactagcttatgctatgggaaatctcatcttgaggtgggcttcacacttagatgctttcagcgtttatcccttcccgacttagctacccagctatgcttctggcgaaacaactggtacaccataggtcagtccatcccggtcctctcgtactaaggacagctcctctcaaatttcctacgcccgcgacggatagggaccgaactgtctcacgacgttctgaacccagctcgcgtgccgctttaatgggcgaacagcccaacccttgggacctacttcagccccaggatgcgacgagccgacatcgaggtgccaaacctccccgtcgatgtgaactcttgggggagatcagcctgttatccccgaggtagcttttatccgttgagcgatggccctcccacgaggtaccaccggatcactaagcccgactttcgtccctgctcgacttgtaggtctcgcagtcaggctcccttatgcctttacactctacgaacgatttccgaccgttctgagggaacctttgggcgcctccgttacattttaggaggcgaccgccccagtcaaactgcccacctaacaatgtcctgtcaccagtttcatggcatccagttagaacttcaatactatcagggtggtatcccaacaacgactccattaaggctgacgccctaatttcccagtctcccacctatcctgtacagacaataccgaaattcaatgctaagctacagtaaagctctacggggtctttccgtccaatcgcgggtagcgagcatcttcactcgcactacaacttcgccggattcacagttgagacagtgcacaagtcattacgccattcgtgcgggtcagaacttacctgacaaggaatttcgctaccttaggaccgttatagttacggccgccgtttactggggcttaagttcacaccttcgcttgcgctaagtgttccccttaaccttccagcaccgggcaggcgtcagcccctatacatcagcttacgctttagcagagacctgtgtttttgttaaacagttgcttgtgcctattctctgcggcctaccagatggtaggcaccccttctcccgaagttacggggtcaatttgcctagttccttaactgtgattcttccgtcggccttaggattctctcctcatctacctgtgtcggtttgcggtacgggcactacttctctttctagatgcttttcttggaagcatgaaatcagatacttcggttccgtggaaccttccccatcacgccctaggattgttagaacggatttgcctgttctaactccctcaacgcttagaccagcatccaatagctggcacatcctatccttctccgtcacaccatcgataataacgattatagtggtattggaatatcaaccaattgtccatcgactacgcctctcggcctcgccttaggtcccgactaaccctgagaagacaaactttactcaggaaaccttagatattcggcctgtaggattctcacctacatctcgctactaatgccaacattctcactcgtaatcagtccaccgctccttacggtacgacttcagcccgattacgacgctcctctaccgctcatacaaagtatgaacccgtagcttcggtggtaagtttgagccccggacattttcggcgcaggatctcttgactagtgagctattacgcactcttttaatgagtggctgcttctaagccaacatcctagttgtcttagaaatcccacatccttttccacttaacttacactttgggaccttagctgacgatctgggctgtttcccttttgaccatggaacttatctttcatagtctgactgccgtgctgatagtatctggcattcggagtttgataaggttcggtaagcgctatgccccctagcctattcagtgctctacctccagtactcacatttcacgacgctagccctaaagctatttcgaggagaaccagctatatccgagttcgattggaatttctccgctatccacagctcatcccatgctttttcaacagcaacgtggttcggtcctccacgaggttttaccctcgcttcaacctggccatggataggtcacccggtttcgggtctacagcatgcaactagtcgccctattaagactcggtttcccttcggctccgtaccttaagtacttaacctcgctacataccgtaactcgttggctcgttctacaaaaagcacatcatcacacacataaggtgctttgatcggttgtaggcacatggtttcaggttctatttcactcccctcccggggttcttttcacctttccctcacggtactgcttcactatcggtcatcaggtagtatttagccttgggaggtggtcctccctgcttcccacaaggtttcacgtgtctcgtggtactctggtgcagaactgatcattatgacttttacttacaggactattacctcctacggtccaactttccagttgtgttcggttaatcataatttcacgttatgttctgtccgcaaccccagagataaatctctggtttgggctctttccttttcgctcgccgctactaagaaaatcgatttttctttctcttcctctaggtacttagatgtttcagttccctaggtgttccttcataaagctatgtattcactttacgatgcatgaggtttctcatgcgggtttccccattcggaaatctccggatctctggctatgtgcgcctacccgaagcttatcgcagcttatcacgtccttcatcggctcctgatgccaaggcattcaccatgcgccctttgtagcttgacctttttaagttttgatatacaaaactggttatattaatcattcacaaagaatattattcttggctttgttgtattatatacattaatctatgtgcaattttcaaagaacattttcgcttgcctactacagccaattacttcgtcagcttcaaaaattattcattcatgtacattagtactactcatttcataattttttcgcttcctcgtacttgtcattattagacttcgcttttgaaagacttagtctttcaaaattgaacagaatcaatactcattaagtaacctttgagcaagttgtaattttatagatgctttgcatctttgtactagtcaaacgccatgtttgctagatttctccatagaaaggaggtgatccagccgcaggttctcctacggctaccttgttacgacttcaccccaatcgctgaccctaccttaggtcgctgcctccttgcggttagctcacgaactttgggtattgccaactctcatggtgtgacgggcggtgtgtacaaggcccgggaacgtattcaccgcgacattctgattcgcgattactagcaactccagcttcatgtaggcgagtttcagcctacaatccgaactgagatcggttttatagttttgctcactctcgcgaggttgcatctcattgtaccgaccattgtagcacgtgtgtagccctagacataaggggcatgatgatttgacgtcatccccaccttcctcccggttaacccgggcagtctcgctagagtgctcaactaaatggtagcaactaacaataagggttgcgctcgttgcgggacttaacccaacatctcacgacacgagctgacgacaaccatgcaccacctgtcttcctgccaccgaagtggcttcctccattacagagtaattcaggagatgtcaagtctaggtaaggttcttcgcgttgcttcgaattaaaccacatgctccgctgcttgtgcgggcccccgtcaattcctttgagttttaatcttgcgaccgtactccccaggcggaatacttaatgcgttagcggcggcacagaggtcatgacaacccctacacctagtattcatcgtttacggcgtggactaccagggtatctaatcctgtttgctccccacgctttcgagcctcagtgtcagttacagtccagaaaggcgccttcgccactggtattcttcctaatctctacgcatttcaccgctacactaggaattctcctttcctctcctgcactctagatatccagtttggaatgcagcacccaggttaagcccgagtatttcacatcccacttaaatatccacctacgctccctttacgcccagtaaatccggacaacgcttgccacctacgtattaccgcggctgctggcacgtagttagccgtggcttcctccttaggtaccgtcattatcgtccctaaagacagagctttacaatccgaagaccgtcatcactcacgcggcgttgctgcatcagggtttcccccattgtgcaatattccccactgctgcctcccgtaggagtctgggccgtgtctcagtcccaatgtggccgatcaccctctcaggtcggctacgcatcgtcgccttggtgagccgttacctcaccaactagctaatgcgacgcgggtccatctcatagcggattactcctttaattgctgtaccatgcggtactacaatcttatgcggtattaatcttcctttcgaaaggctattcccctctatgaggcaggttacccacgtgttactcacccgtccgccgctaatccactcccgaaggagcttcatcgctcgacttgcatgtgttaagcacgccgccagcgttcgtcctgagccaggatcaaactctcaataaaaagtttaatcttagcttactcaaaataaagaattgctggtttacttaaatgtttatattatattctgttcaattttcaaagaccattttctttcacaactttacgttgttattatgttgtcaccctcaagcgacttacttagtatatcactcgaagcatttcatgtcaacaactttttcaaaacattgttttgttgtttcatgtcctgacgacatcatttatactatcactttataaatatactgtcaacacttttttatagttataaaaaatattatttagtgttagataacttaaatgcttaccaatcatatttttataccataatcctcttatttatattagtatttaaaacctctattttaatctataaacccaaatttatatttatctgtttagctctaattttttatgtttcacaaaagtagctatcccactctttcatttgataattgatagtgtaaagttgacagtttcaatgaaaaggctcaatttttattgattttttatttttagaaatctacttcataaatttcatacttaactatcaattctctaagtctgttgaattcactatattaaataattatcttatcattataatttcctataaattaaaagagtgtgccagaataaattctggacacactttatattaactacatattctatataactttaaaattcttcacatatatactatattaatgctctaatttcatgaattctataaccaattcttctttttaataactaaaggatacatagtagatcctataagagtctcaccttttcttatttcactacccttatctgctataacattatctaaaactacctcatcttcgattctgctattttgcattattatgcaatcctttatttttgcattttttccaacataaactcttcttccaataacacaattttcaactgtaccttctatcctacatccattagcaataatagaatttacaacattactattgtccgaatagaatgttgggccttcatctttagtctttgtataaattggtctctcttcattaaatatttccttattaacttttttatttaaaagagctacattactatcatataaagcttttattgaatttatacagtctaaatgtcctttaaattcatatgcaccagctgaaagattatttaaattattatgaatatattctttaacctttctatacataccgctgcttatacattcatttactatatttaagaacaattctctttttaatacatacatttccatattgatattagccttaggattctttccaatattctctcctacactaataacacttcctgaatcatcaatatttaaaacaccgcagtcaccaaaagattcgtctgcgttattaactttcttatacacaattgttatatcttttccagtacttttatgatattctaacacttctttataatctatattgcatatcatataacttggagctaataatacatattcttttctgcttctatttaaaaattgaatattatctgcaaaattatgaacatcatcatatacaggatcatcatttccaaaattaaatactcttaatccatctgtttttctatttaaatcccatggtcgtccattagtaatatgatcaattaacgatcttgatttattctttgtgaatattccgatacaatttattcctgagtttgtcatattagataatacgaaatcaattactctatatcttgctgctataggtactgaagcaagagatctatttacaactagttcacccattctattttcattttcatctaagttaattataccaatacaatttttcatttctttctcccccttagcataccattaaactgctttattgctttcttctataactgtacccatttttacttcttctttagctgctattatcgctatttcttcacctaaagaaatcttacagtcttttcttacaactgctccactacctactattgctttttcaataacaacattatcacctatttttgcatcagtcataattatagaatcccttataactgtatttttacctatatgcacaccttggaataatattgagttttcaatttgcccattaacaacacatccctcaactacaagcgaattattaactttagcattttcaccaatatattgtgctggtcttacaggatttactgaataaatcttccaatcttcatcatgcaaatctaattcattatcttctcttattaaatccatatttgcttcccaaagactatctatagtcccaacatctttccagtatcccttaaatggataagctactaatttatttccgtcattaagcatcttaggaattatattcattccaaaatcattttttgatgttttatccgcttcatcttctcttaaatatttctttaatgtcttccaattaaatatatatattcccattgatgctaagttattttttggtgcttttggcttttcttcaaattcatatactgataaatcgtctctagtattcataattccaaaacgtgatgcttcttccatagggacctctattactgcaatagttgaatctgcccccttttctttatgaaaatcaagcatttttgtataatccatcttatatatgtgatctccggataataccaatatatattctggatcatatcggtccacaaattctatattctgatatattgcattggcagttcccttataccattctccacccttttcttcttgatatggaggtaaaatacttacgcctccttgtgttctatctaaatcccatgcttcacctataccaatgtgtgcatttaattcaagtggtttatactgtgttaatacccctaccgtatatattccagaattagcacagttacttaatggaaaatctattattctatattttcctccaaatggtactgctggttttgctaactttttagttaacacccctaatctagacccttgtccaccagctaatatcattgctacaatttcatttttacccataattttttctcctctcatacgttttattctcataaaatggatttttgtgctttacacatttatttaaataatatgcttaacataatgtttttatgttaatttgctatttgttaagcatatcaatttttgctatatattaattattaaatttactacttatttatttttcttaatattttaaagctagatggatacattattaaaacactttcatatccaacaaatttatatttttcaccttcattaaataaatctaaataagttccttctaaagtaataccccttactactttttgtgcatttgaaacattaacaacaactacaattctttcattttcatatactctttcaaatgcaaaaatatcctcttctgtatcgaaaatattaaaatccccttttttcaaagcatcttgaccatttctaatttgtgctatccttttataaaacccaattaaatcaacatcttcattttcccaaggataactctttctgttatctggatcttttcctcctgtaacccctgtttcatcaccataatatatcaaaggtaccccaggaatagtaaattgtaatgctactattatttttaagcatcgtatatttccatctaatacagtaagtattctttctgtatcggatgttccaataagattaatatttcctaaaaatacttctctaggataattttcatataaagacattactttcttttttaacttatctgattttatatatcctctagtaaagttaattaaactctcccttaatggataattagttacagattgtatctctttgccatatagatatcttctttttttagaataacttatcttattagatgcatcatcccatacatcccctattaaaacagtttccttatccaaggtatctagcctatctcttattatttctataaattcatctggaagctcatctgtaacattcaaacgccatccacttgctccaagatcaatccatttttttattattgaatcatccctatttactaaaaagtcaatataactattatgcattacattaatattaggccttccttcaatcccccaccaacattcatatccatatggatatctattaaatttataccaattatgatattttgaatttggagattgatatgctcctatttcatcatagtttccggctttattgaaatatctgctatctgaacttgtataactaaatactccatctaaaattattttaatatctttacttttagctttttcacataattctttaaaatcttcctctgtaccaaacatctcatcaattatgtcataatctcctgcatcatatttatgacagcttgaagatttaaatattggacttaaattaattatatttacgcccaaagactttatataatctaattttttattatccctctaatattgcctccatagaagtcccatcttatagtccttccttgataatcttttatatatactggagtatcatcccatcttccatatataaaagaatttttttgggattatttatactaccatcatcatttccattacagaatctatctacaaatatttgatatataattccttctttataccagtctggtaaattggatttcttatatatagttatttgatatggtacaggattataggtatatatctgaccaataccacctagatgttcatcattatttccgtagtatactctgtcatacccatctattaaaataaaataataccccaagactcccaaagcatcttctgtatcaatctctatagaatatcgataatttccactattaaggtattccttttccattcccatatttacttttgtaccatcaaattgtaatagttcaatagctactactatctctttctctatatcaattgataacttaaccttctgtccttcctctacagcaccaaaaggtcttctatatactatgctttgcgagtcatgcattacctttatcctgtccattgatttacctcctatagattcttataaattacttctgatctccaagtccctgctgcatattgttcagttattctgtcagatgagaacatttttgaatgtgcaatatttatctaacacattttctaccatttatcagtctttctataaagagtatcaatcttattttgagcttttaaatatgaattaaaattattcaataaaaaaactcatcattataagttagtagattttcataaatgtttctaaatttatttctataattatgatatttaccatttattaaatcgtccattactcttcttatctttgtataactattataaacatctatgaaatatatcaaaaattcttatagtagttaattctttcatctgcagttaatgcgaatatgactatattatcatttgttaattcattttttattaaaatactaattacatcttatatatcaagtatttactaatattgtcctgttaattctctgtacatatcaagatatatctgtgctgatcttccccaactattatcagaattcattgcatttataacaaggttattccatttctttttgtccttatatatccataaggcatatttaattatatttaacaattcttctgaattatagtttttaaatccaaatccatttcctgaaccaatatattcattatatgggtttactgtatcttttagtcctcctgtttctcttactataggaattgatccataccttaatgctatcaattgccctaatccacatggttcaaatgccgatggcattaagaacatatcacttgaagcatatatcttattagctaaagtattatcaaacctaatatttgcagataccttatctccataagcataatctaaccatttaaaatgatcttcataatgtttgtctccagtacctaaaattacaagctgaacattctcttgaagcaatttgtctgaaatattaactaataaatcaattcccttttgacttgttagtcttgttaccattgctatcattggaatactctcatctacctttaatcctagttctttttgaagcgcaattttatttatagctttacttgtaaatgtattcacatcataattcctaattattctcctatcagtcttaggattaaattcatcataatctataccatttacaatacctcttagaacatatgatctatcccttaatactccatctaatctatgtccatattctggagtttgaatttcacctgcataactattacttacagttgtaataatatcagagtaatagagtccgcccttcataaagctgacaccctcatcaaatttcaaacatgtattatcatataattcaagatcaaatccaaataattctggtagtatattaggatcgaacactccttggaatgctatgttgtgaattgaatatacacatttcatattccagtaaaaattatcatattttttatattgaaactttaataatactggaagcatacctgtctgccaatcattacaatgaattaaatcaggttgccaatctacttgccttaacatatctaaaactgctctgtcaaaaaaagcaaatctttctgcatcatcataaaatccatataacccatcacgattaaaatatctttcattatcaagaacataataggtaacaccattatagaaacattcccatactccgcagaattcatctctccatccaacacgaacattaaaccattttacaaatcttagtttatcttttacttcccaatttaattctttatatttaggtataacaactctaacatctacatttttttgagcaagtgctttaggtaatgcccctgcaacatctccaagaccaccgcttttaataaaaggacttgcctcagatgctacaaataaaactctcatttcttatcccctagcctaatatacattaataattacagattattggtgacaataaattatcatcaataatccataaccttacatgtcttttattttaattaatttctttttcatctttttctgtttcattattttcttcatttttaaatatatctttaacttttaacactaaagttgccattggtggtactttaatctttacagaatacggttgattttggaaaggagccctttcagcaaataatggtgtgtccataatttgtcctgaaccaccatatttagaatcatctgtattaaataattcctcgtattcacctaaaaatggtactccaatttgataatcataataaacaattgaagtaaagtttactataaagattaatgtttcatcatcttttctacttctccttgtaaatacaagtatgctttggtcactattatcagcttctatccaattaaatcctcgatgatcatggtccaattcccaaaatgctttattatcaagatataacttatttaaatctttaaaaaataactgagttttttcatttatctctaaagcttctattagattccattcaagttgttcgtattctctccattctataccctgagcaaattcacatcccataaatgtaagtttctttccaggatgtcccatcatatatcccataaaggctcttaatcctgcaaatttattccattcatcgccccacatcttttcaattaaagatttcttaccatgaactacttcatcatgagataatggtaatacataattttccgcataattatacatcattgcaaaagtgatgtttctatgattattctttctatacgaaggatctatttttacatattctaatgtgtcgttcatccatcccatattccactttagattaaatcctaatccatcttccattggtggttttgttatattcggccacgctgttgattcttctgctatcattaatgcagttggatactctgcaaaaactgcttgattcaattgtttcaaaaagtctatagcttctaaatttccatttccaccatatttattaggtttccactctcctggctctctactataatctaagtataaaatgcttgataccgcatccactcttaacccatcaacatggaattccctaaaccaatataaagcatttgatattaagtaactttgtacttctgctcttcctaaatcaaagttacatgttccccatcctttattttcagctctccattcttcttgatattcataagtagctgtaccatcaaatttatataatccatgtgcatctttacagaaatgacctggaacccaatccataataactcctatattttcttcatgtaacttcttgattaataatttaagtccttctggatttccatatctacttgttggagaatagtatcctgttccttgatatccccatgatgcatctaaaggatgttcaacaagaggcattatttcaacatgtgaatatcccatatcctttaaatacgcaggtaaaatttcacttatttcttcataagataaaaaatcaccatcttgattccttctccatgaacccaaatgaatttcataaatatttaatggctgctctaatacatttattttatttctattttctatccactttttatcattccaagtaaaatctttaggtgcatatattatagatgcattatttggtcttaattcactaaaaatagcatatggatcagatttatattctccactattccccttagaatcaactacacaatatttatacttgtctccttccttaggttgagtgaagaatccagaccatattccgttctcactaattttttcaagtttataagcatcattaacattaaagtcattaaaatcaccaacaacataaacctcacttgctcttggtgcccatgtagcaaactgaactccttttacattatttctaattacaacatgagaacccaaaatattatatgcactataattctttccctgatggaacaaatactcattaaagcttgttatttcagtatcatcaatattttctttatctttttctgtaattatttcttttgcactaggtaaattttctttactcatggctgttaatttatcatttttactttctactatttttgtctcttcaatatctacttgaacacttcctttaacatcttctgtctttttagtactagctgcttttacttctttattttccgctttatccgtatcagcctttgttgaactagatgtttttgaagctttagtagtctttctagtagttctagtttttgttgttgttttcttagctgttgttgtttttttagttgctcttgtctttttctcaactttttcattttctaaaggtttatcacttactttttcttcaacttcaactatttttttagtatctatatctatttctttattttcattatcgatatcttttttgcttaaagatttcgcatcagtctttaactcagttgatatatcccctttagctacattgttttctgttttagatttagctctagctctagtagtcctttttctagttgttgtttttgccttttccttcgtagaagatgctgaagaatctacttttgctgttgtttcaactgtagtttctgcaattattttactgcttccattaggtttatctgacattaactcttacccccatccatattagtatccctctcatagtcgttaacctttcctctgcatttccttattttatttttaacttattattgcctataattatattttaccaaaatttgtgagttttttcacttgtttttataattttccattaattatttttgtaattttacccattaaaatatgttttttacttttttagtattatatctctttatatcttaaaactaatttgcaaattattcaatattatatatgtattaataacgttaacatttttttaaatttaaaatatttttaattttcaaaaaaattctacttaaaataacaaatttgtttatttataacttatatcatttttaattaattatcataacatatataaagatattatgaggataattcaattcataatcattaatcaaactctcttcataatatcaaattcttttttaaaaatattatttctaaacgctaaaaaggatagttatttctaactatccttattcttacctggcgacgtcctactcttccacacagtctcccatgcagtaccatcggcgctatagaccttaactgtcctgttcggaatgggaaggagtgttacctctatgccatcaccaccagatcctagttctttctaaatctatgatttagctaaaagaactgtactcctcagctcgtctgagcgagtttccttattaacttgtttgaaaaaacttttgttctttcaaaattgcacataagtgagaatccaaattttacatttggttaatcgaacttactcagcgaactaagtgagtcgagtttcctcttaattaatgtatttacaacttgattatattggtcaagccctcgacctattagtatcagtcagctaaatacgttaccgcacttacacctctgacctatcaaccttgtagtcttcaaggggtcttactagcttatgctatgggaaatctcatcttgaggtgggcttcacacttagatgctttcagcgtttatcccttcccgacttagctacccagctatgcttctggcgaaacaactggtacaccataggtcagtccatcccggtcctctcgtactaaggacagctcctctcaaatttcctacgcccgcgacggatagggaccgaactgtctcacgacgttctgaacccagctcgcgtgccgctttaatgggcgaacagcccaacccttgggacctacttcagccccaggatgcgacgagccgacatcgaggtgccaaacctccccgtcgatgtgaactcttgggggagatcagcctgttatccccgaggtagcttttatccgttgagcgatggccctcccacgaggtaccaccggatcactaagcccgactttcgtccctgctcgacttgtaggtctcgcagtcaggctcccttatgcctttacactctacgaacgatttccgaccgttctgagggaacctttgggcgcctccgttacattttaggaggcgaccgccccagtcaaactgcccacctaacaatgtcctgtcaccagtttcatggcatccagttagaacttcaatactatcagggtggtatcccaacaacgactccattaaggctgacgccctaatttcccagtctcccacctatcctgtacagacaataccgaaattcaatgctaagctacagtaaagctctacggggtctttccgtccaatcgcgggtagcgagcatcttcactcgcactacaacttcgccggattcacagttgagacagtgcacaagtcattacgccattcgtgcgggtcagaacttacctgacaaggaatttcgctaccttaggaccgttatagttacggccgccgtttactggggcttaagttcacaccttcgcttgcgctaagtgttccccttaaccttccagcaccgggcaggcgtcagcccctatacatcagcttacgctttagcagagacctgtgtttttgttaaacagttgcttgtgcctattctctgcggcctaccagatggtaggcaccccttctcccgaagttacggggtcaatttgcctagttccttaactgtgattcttccgtcggccttaggattctctcctcatctacctgtgtcggtttgcggtacgggcactacttctctttctagatgcttttcttggaagcatgaaatcagatacttcggttccgtggaaccttccccatcacgccctaggattgttagaacggatttgcctgttctaactccctcaacgcttagaccagcatccaatagctggcacatcctatccttctccgtcacaccatcgataataacgattatagtggtattggaatatcaaccaattgtccatcgactacgcctctcggcctcgccttaggtcccgactaaccctgagaagacaaactttactcaggaaaccttagatattcggcctgtaggattctcacctacatctcgctactaatgccaacattctcactcgtaatcagtccaccgctccttacggtacgacttcagcccgattacgacgctcctctaccgctcatacaaagtatgaacccgtagcttcggtggtaagtttgagccccggacattttcggcgcaggatctcttgactagtgagctattacgcactcttttaatgagtggctgcttctaagccaacatcctagttgtcttagaaatcccacatccttttccacttaacttacactttgggaccttagctgacgatctgggctgtttcccttttgaccatggaacttatctttcatagtctgactgccgtgctgatagtatctggcattcggagtttgataaggttcggtaagcgctatgccccctagcctattcagtgctctacctccagtactcacatttcacgacgctagccctaaagctatttcgaggagaaccagctatatccgagttcgattggaatttctccgctatccacagctcatcccatgctttttcaacagcaacgtggttcggtcctccacgaggttttaccctcgcttcaacctggccatggataggtcacccggtttcgggtctacagcatgcaactagtcgccctattaagactcggtttcccttcggctccgtaccttaagtacttaacctcgctacataccgtaactcgttggctcgttctacaaaaagcacatcatcacacacataaggtgctttgatcggttgtaggcacatggtttcaggttctatttcactcccctcccggggttcttttcacctttccctcacggtactgcttcactatcggtcatcaggtagtatttagccttgggaggtggtcctccctgcttcccacaaggtttcacgtgtctcgtggtactctggtgcagaactgatcattatgacttttacttacaggactattacctcctacggtccaactttccagttgtgttcggttaatcataatttcacgttatgttctgtccgcaaccccagagataaatctctggtttgggctctttccttttcgctcgccgctactaagaaaatcgatttttctttctcttcctctaggtacttagatgtttcagttccctaggtgttccttcataaagctatgtattcactttacgatgcatgaggtttctcatgcgggtttccccattcggaaatctccggatctctggctatgtgcgcctacccgaagcttatcgcagcttatcacgtccttcatcggctcctgatgccaaggcattcaccatgcgccctttgtagcttgacctttttaagttttgatatacaaaactggttatattaatcattcacaaagaatattattcttggctttgttgtattatatacattaatctatgtgcaattttcaaagaacattttcgcttgcctactacagccaattacttcgtcaacttcaaaaattattcattcatgtacattagtactactcatttcataattttttgcttcctcgtacttgtcattattagacttcgcttttgaaagacttagtctttcaaaattgaacagaatcaatactcattaagtaacctttgagcaagttataatttttatagatgctttgcatctttgtactagtcaaacgccatgtttgctagatttctccatagaaaggaggtgatccagccgcaggttctcctacggctaccttgttacgacttcaccccaatcgctgaccctaccttaggtcgctgcctccttgcggttagctcacgaactttgggtattgccaactctcatggtgtgacgggcggtgtgtacaaggcccgggaacgtattcaccgcgacattctgattcgcgattactagcaactccagcttcatgtaggcgagtttcagcctacaatccgaactgagatcggttttatagttttgctcactctcgcgaggttgcatctcattgtaccgaccattgtagcacgtgtgtagccctagacataaggggcatgatgatttgacgtcatccccaccttcctcccggttaacccgggcagtctcgctagagtgctcaactaaatggtagcaactaacaataagggttgcgctcgttgcgggacttaacccaacatctcacgacacgagctgacgacaaccatgcaccacctgtcttcctgccaccgaagtggcttcctccattacagagtaattcaggagatgtcaagtctaggtaaggttcttcgcgttgcttcgaattaaaccacatgctccgctgcttgtgcgggcccccgtcaattcctttgagttttaatcttgcgaccgtactccccaggcggaatacttaatgcgttagcggcggcacagaggtcatgacaacccctacacctagtattcatcgtttacggcgtggactaccagggtatctaatcctgtttgctccccacgctttcgagcctcagtgtcagttacagtccagaaaggcgccttcgccactggtattcttcctaatctctacgcatttcaccgctacactaggaattctcctttcctctcctgcactctagatatccagtttggaatgcagcacccaggttaagcccgagtatttcacatcccacttaaatatccacctacgctccctttacgcccagtaaatccggacaacgcttgccacctacgtattaccgcggctgctggcacgtagttagccgtggcttcctccttaggtaccgtcattatcgtccctaaagacagagctttacaatccgaagaccgtcatcactcacgcggcgttgctgcatcagggtttcccccattgtgcaatattccccactgctgcctcccgtaggagtctgggccgtgtctcagtcccaatgtggccgatcaccctctcaggtcggctacgcatcgtcgccttggtgagccgttacctcaccaactagctaatgcgacgcgggtccatctcatagcggattactcctttaattgctgtaccatgcggtactacaatcttatgcggtattaatcttcctttcgaaaggctattcccctctatgaggcaggttacccacgtgttactcacccgtccgccgctaatccactcccgaaggagcttcatcgctcgacttgcatgtgttaagcacgccgccagcgttcgtcctgagccaggatcaaactctcaataaaaagtttaatcttagcttactcaaaataaagaattgctggtttacttaaatgtttatattatattctgttcaattttcaaagaccattttctttcacaactttacgttgttattatgttgtcaccctcaagcgacttgcttagtatatcacttggtttgacttgtgtcaacaactttttttaaaacttattttgcttcattaaattcagcttttatcaagttttaagtttgttgtttgccgccctcagcgacgtgttctatcataacaccataagcattttcatcgcatgtaatattactacttatttttcagtttatcaatatttttctacattattctagcaatttcctcattaatcctagtatagacacccttggtatggtttatgcctatattgtttaacattagttctagttttcaccaattaacataataatattctatattatatattagttaagtagcattatttaatacagtttcaatatcaaatataactctttaggtgaagcttattatgttatattattaaaaattcaagtactactatatatatattactaatttaaaatcaaacaatataatttaataatataaaccctaattaattttcaaaaattattgtattaatttttacatatacattttttatctaaatctatacaatattattaagaaataagattattgtagttaataatcaattaataactataagtaatatataattaatttttattatttaaatatacttaactcaaaatctctaaatatagttaatatataatgtatatacatagtactcaagtactcacaacttaactattgacagtcatttacattaaatatataataaaaatcagttgagacgtgttactgttaaatcaggcataagttttctaaaacacttagggaagcttatgtctttttttatttattttaggtaagtgttatattttataaaaactaaccaaaaatatagatataaaataataataaattaaacaatgaaaggatgtgaattatcctgattatcaggatataaattatgtttggatttttaaagaaccttttcaaaaacaacacagaaaacacaacaaaagttgaggaagctccagtagcaaaaacagctcctgttgctgaagaaagcgctaaaacatttaaattagttgctcctatgtctggtaaatcaatacctttatcagaaactccagaccctgttttcgctcaaaaaatggctggtgatggattagctatggatcctgcatctgatactatcgtagctcctgctgatggagaattaactttagtgtttaatacaaaacatgcttttgcaataactttagataacggtgttgaattattagttcatataggtatcgaaactgtttctttaaacggtgaaggatttgaacaattagcagaacaaggaactaaagttaaagctggtgatccaataatcaaaattgacagagagttcataaaatcaaaaggacttccattaataactcctgtattaataacaaacccagatatcttaaaatcaatttcaccaattgaaaacatagaaactgttgctggtgaaactacaatattagaatatactatgtaacaattcactataagaaattcattattatagtaaaaaagatgccatttaggcatctttttttagtttttaatacaaaaaaaacatcttcaacgattcaacattgaagatgtttttttcaaatatgatattataaaaacagttcggtttaaactctatacactaacatattttttaatattagttgtttcctaatatatcattaatagcattcttatatccatcagccttggcaccaaatatagcttgaatacccttaccaacttccataacacctgctgcgcctaatgattttaatctatctttatctactttagatctatctttaacttctactcttagtcttgttatacaagcatcaacgcttactatattttctggtccacctaaagcttctaatactgctggagccttttctgcaatttcacccttagctccacctgctgatactttagtatctgtatttgattcaccatttcttccttgatagtctgctttactatataacttagtttcttcttcattttcatctctacctggagtttttaagttaaatttccttattataaatgagaataagaagtagtaaactactgcataaactgcaccaactaaaagaaccataaaccacttagtaggcacgcctgctccagctggaagtaatccaaataagctgaagtcaattaatccacctgagaatgtcatacctataaatacattaaatatgtccattaacatgaatgatatacctgctaatacacagtgtactccatataaaactggagcaacaaatataaatgtgaattctaatggttcagttatacctgttaataatgaagttatacctgctgctaataataatgatcctacagcttttcttttacttggagctgcacatctatacatagcaaatgctgcagctggtaatccaaacatcatgaatgggaatttacctgccataaatcttgtagtacctgaaacaactgtagccattgtgtctgatgaagctccaactaaatcagtcatactagataattgagcaaaatatgctgtatttgctcccgcaaccgattgccaagccccgttaactaaaatttgaccatcaacaaatgagccaaaccagaatggagtatagaatacatgatgtaatccaaatggtattaaagctctttcaattaaaccatagaagaaagtccctataaatcctgcgtctctaactaagttagcaatcattccaattccattttgaactactggccataagtatgctaatattgcacctacaaatgccatagttatagctgtaactattggaacaaatcttgatcccgagaaaaatcctattacctgtggtaattgaatttcatggaatctatcatgtaatatagctgttatgatacctgttataataccgccaaatactgacatatttaatgtaaagattcctaaattagttgtaacataagttccatattcaccaacattatctggtgtaagaactcctaattgagtaactcctaaagaaagtaatgtagaaataacttgattcattactatgaatccaaaaactgatgctaacgctgctgtacccttatcttttttagctaatccaactgcaacaccaactgcaaataaaatcggtaaatttccaaatacaatatcacctatatttttcattactgttaagattgctgtaacaaatggaatgttaacaaaagcaataagtggctgataaattcctggtgggttatctaaacctgaaatacctaatagtgctccaccaacgcctagtaatatacccgctataggtaatgctgctattggtaacataatagctttacctattctttgtaaatattgaagcataataattcctcctcaatttgagttttaagatttaatttattaatatagagttggccaactcaaattttaaacaacaaaaaaaagactcattaataacattccaaaacttcataaaaatattctctttaaacgagaatatttaaacaaagtatttgtttgtataataagtcttgcctgcattaccagttacaccttaaattttaattacattatgttaatatattaacacatttcttcatgaatgtaaatgttttgacatttattttttttgattcatcctaaatctttcaacatgaatcgttaaacatgaaatttcatcatctgtaacagaaatacctacatttttttcaattatgcgtcctataccttcagatattatatatgactctttataagtttcttttataatttttgttaaatcattatctattgtattattactcattattctttgaattgcaaattttacatgagtgcagaaacgagcataatctaaagaatctttatatattttgcaatctaatttcccctctacatattcaacaatttcactaattaaatttgtatttttaatagtatttgatatttttccatcatttaaagctgaatgaatatgtagagctatgaatgcaatctctccatctggtatttctacatttgagtgattttcaatcatctttgcaactagctttgcaagattgtattccttagaatatagtgtctgtgtttctattaaaaatgggttttcaattttcgagggcactgaaaaagtgcctttcggaataaaagacctaaaaaattatttaaaaacaattttttaggtcttttatgttatacttaacttataaaataatgtaggtgattcgtatgataaaaaagcaagaaacaatgattttaagtgaatattcaggaatttatgatttggttgttccaagagataatctgttaagaaagattaatgaattaattgatttttcatttatatatgatgagattttagataagtattgctctaataatggtagaaatgccattgacccgatacgtatgtttaaatatcttttattaaaatccatatttgatttgtcagatgtggatattgttgagcgttcaaaatatgatatgtcatttaaatattttcttggcatggctccagaagaagctgttattgagccaagctcattaactaaatttcgtagacttaggcttaaagatataaatattttagatatgttaataaataaaacagttgaaattgctcttgaaaaaggaatcctaaaatcaaaatctatcattgttgatgctacgcatacagcagctagatataatcaaaaatcaccacgtgaagtattacaagaacgttctaaaagattaagaaaatcagtttatgaaatagatgagagcattaagaatacttttccatctaaaaatacagttgatgatttagaatgcgaaattaaatattgcaaggaattaatagaaattatagaaaagaacgaaggtatttcatcttatccaaaagttagagaaaaattaaatattttaaatgaaatattagaagatgatattcaacacattcaggctagcgccgatgcggatgcgaggattggacataaatctgtagattcatctttctttggatataaaacacatattgcaatgactgaggaaagaataataacagctgcaactattactactggtgaaaaaaatgatggtaaagaattagaaacattaattaataaaagtcaagaagctggaatagagattgaaacaattattggtgacgctgcgtactctgaaaaaggtaacattgaatttgcaaatataaataatattaaacttgtagctaagttgaatccttctgtaacgcaaggctttagaaaaaaggaagatgagtttcaatttaataaagatgctggaatgtatgtatgtaaagaaggtcatatggctatccgcaaagcccgtcaaggaaaaaggaatgtttctacaaatcaagtagatacttattattttgatattgaaaaatgtagagattgtctgcaaaaagacggatgctataaagaaggtgctaaaagcaaaacctactcagttactataaaaagtgatgttcataaatctcaaatagagtttcaagaaagtgaatttttcaaggaaaaatctaaagagagatataagatagaggctaaaaatagtgagttaaaacataggcatgggtatgatactgcatcatcctcaggtctaattaacatggaaatgcaaggagcattagccatcttttcagtaaatgttaaaagaatattgaagctattaggatagaaatatcctttaatttgattaatatctaaagaaaaaagagttaatgaaactaaattttttaagtttcattaactcttttttatctagatataaccgcactaaaaaaactttaagtttttcagtgccctccaattttctcattattttttaatctttttatagcaaaaaacaagtggtctataagactaatatgaatacgctcgtttaattcttcatcaaccatattagaaacttcataaatagcctcttcacaagcagcaaaaaactcggaatcaattacctttacaagttattttaaattatttatattttctttctcttcaattataaatactttattaatggaagttcccttaggtattacgcttcctggtttttttccgaaaccgatacctactgcaaaaagaatcttttctatatcttctgaattaactaaaacaatgttattattaaatacctttactacaatctcatctctactaagtattgtgctcatcatttcactccttataaataagctttattaataaacgttagtctcctttataaaaatcttccttaataatataatacgtggcgtgatctctccacttaccatttactaaaagatatttttcattgatgcctactaatttaaatccaattgattctaaaacttttctcgatttaatattatctactaatgcggatgcttcaactctatgaagatcacaatctaaaaatgcataatttaaaattaatttaacactttctttcatatatccattaccttgttcatcttcatctattgaatatcctaatactccgctttttaaagatccacatacaatattagatatttttattttccctataaatttattttctttaaaaatccccaagtccacatttgttccatttaacatttgtctgtaactctcaattaataaacttctttgattttccaatgtataaaaccctgaatctcgtgttggttcaaatggagcaagataattcttatttttattatagtattcaactaactcctgtgcatcacctggatttaaatttcttaaaattatattctttccttctaattctatcatgggataatttttctgttttgaatattctattctcgttattccaaaaaataattcatctaaatattcacctttgcaatattcattttggcttaatattccctctaaagtaaatcctaaattaagaaatgcatttatatttatattttctactgatcgtatatttactttaaataccttactatttttaaatattgcacttaatactaaacttaatgtatcacaaagtaattcataattattttctctataaaaattcattttaacatcacatcgtttatttgaaacgctaagttcagttatattaaatcttcctactattatgtcattattatctttaattatatattcttcttcacaagatttatccgcttgtatttttacttttaaattaggcttcatatcattctctccaagttacacaataattaactacatcatttattcctatatatcgctattattcaagtattattatactataataaaagtttattattaaatacatatttgataacttgtagcaattatcttgcttcactattaaattatacacaaaatccacaatatgttgtggataacttattaagtcttttcaatatattgtggattattattaactttcttactttttattatttattcctaaaatatcctttataacttcacctgcaattatcattcctgctactggcggtacaaatgacatacttccaggaacaggccttttagcagttcctttaacttctgaggaatattcagatttaggctttaaaggcatttcttccgaatatacaacctttaatttttctacacctcttttacgaagttcacatctcataacttttgcaagtggacatacttgagttttaaaaacatctgacactttaaattgagtaggatctagtttatttccagttcccattgaactcattatatttatattgtttttataacaatattctgccaacccaagtttagcagatacagtatcaattgcatctacaacataatcaatgtcttttggtacaatttcttcaatattatcatttgatacaaaaacttgacgagttataactctacaatctttatttatagattgtattctttctttaataacttcaacctttgctttatctatagtatcatatgtagcaataatctgcctgttaagatttgttaaacttatagtatcattatcaacaacagttatttctccaacaccagctcttgctaatgcttctaccgcaaatccacctactccacctactccaaatacaattactttgctttttcttaacttgttaagtccatcatttcctattaatagttctgttcttgttaaagaatgttccgccattgtctatccgctccttaattttaatcaatttaattttattctacctaatataaatatcttctaacccttaagatttattttaattcagtctaatactttactaattttataaacttgtttctagacattaaaatcgttctgtaattataccatatttaaatttaatttttatttctaaataattatacatcaatttaacatataaaatctatcggtttactatattaaaatattttcgaaaaatttgtaaaaagtttactattaaattctaattataatgtttataataataattaggattttagaatagtttttctaattatacagtatacttaactttatttttagtctaatttacctattatctaaattattatcttgttcagctaatatatactacataattagttttaataaagataaaattatttgtaaatatcggaggaataacaatgacaataggaattattgctgctatggcagaagaattagaaatcttattaaaagatttatcattagaacaaaaaaaagaaaaagctaatatgacttttcataaagggaagctttacggccaagatgttgtagctgttgtttgtggaattggtaaagttaattctgctgtatgtactcaaatattaatttctgaatatagcgtaaataaagtaataaatgttggtgttgcaggaggaattgggaaagatatatatcctggtgatatagttgttgctgaaaatttagttcaacacgatatggatactagtgtttttggagataaaatcggacaaatacctagacttgatacatttgattttaaatgtgattctgaattaatatctttagcaaaaaaatcctgtgaagaactttcagatttgaatagctttactggaagaattgcttctggtgatcaatttgtcgctaatattgaaaaaatccaatggcttgatcaagaatttggagctatatcatgtgaaatggaaggtgcaagcatcgctcaagtttgctacttaaattctgttccatttgtagttataagatcaatttctgataatgcaaacaatggagctcacatggattatgaaaaattcgttccaattgctgttcaaaattcaactaagattttaaaaagaatgcttgaaatgatgtaattttactaatatatcattctaataaattttctacatcatcaaatgaatttttcttactttatgaaaatttatagtatttagaattaaataaaaaaaatctgtaactccagtatcttctgtagttacagattttttagtctatgaccatactttagttaaaaataatataataaagaaatacacacataaaactattactgcaaatgatgcaacaagcttaaacatagatatgattaaagcgagaatatctttattactaagtttagcttcttttaattctcttaagccttcttctctttcttctttttttctttgctcaacttctaatttttcaaaatcccttctgaatatgctcattaaacttctcctgctctgtgacatgctacaaaatgtttattttttatttccttatattctggtattttttctctacacaaatcagttgcatatggacatcttgtattaaatttacatcctttcggaggatttgctggtgatggtatatctccctgtagaattattctttctcttttaattgtaggatcaggaattggtatagcagaaagtaatgcctttgtatatggatgaagtggattatcaaacaattcatctttttctgcaagttcaaccattgatccaagatacataacaccaattctatcacaaatatgcttaactacagaaagatcatgagatataaacatgtatgtaaatcctttttccttttgaagatttgctaatagattaattatctgtgcctgtattgaaacatccaatgctgataccggttcatccgcaacaataaaatctggatttaatgcaagtgctcttgcaatacctattctctgtctctgtccacctgaaaactcatgtggaaatctctcaatttgatattcagaaagtccacacttatccataacttcaatcactgtttttctcaaatccccttttttaacaagtttatgatcaatgagagcttctcctattatctgtcctactgtcattcttggatttaatgaagaatatggatcttgaaatataagctgcattttagatcttaacttcctaagttcatttttatgcatagtatcaattctttttcccttataatatacttttccatctgtaggttttaaaagttgtaatattgttcttcccgtagttgatttaccacaccctgattctcctacaatacctaatgtttcacctctatatatttctaatgatacatcatcaacagctttaacattacctattgttcttcctaaaaaaccaccagttataggaaaatatttttttagattttcaatttttaatataacttcattttccatctatctattctccttttctgttgattttttattatataaacagcaggcaactttatgtccatttcctatatcataaagtttaggcatgtcatttttacatatttccatgcatttatcacatctctcattgaaataacaacagtctttaatatttattaattgaggtacttgtcctggaattgaatacaattcatcttgtttttgtgtaataactggcttagatttaagtaatcctaacgtatatggatgacaaggattcttaaatatttcaagtacagggccttcttcaattacctttcctgcatacattacaacaacataatctgccatttctgcgacaacaccaagatcatgtgttattaaaagaatagaagtattaaattcctcttttatttctctcattaaatcaagtatctgtgcctggattgtaacatcaagggcagttgttggttcatctgcaattaaaagtttaggattacatgaaagtcccattgcaatcataaccctctgtctcataccacctgataattcatgtggatatgaatcaataatctgctcagctcttggtattccaacatctttcaaaagttctattgtcttcttttttgcttcagatttattgagacctttatgtagaattaatggctccataatctgcattccaattgtaaacgtaggatttaaagaactcataggttcctgaaatatcatagcaatatctttacctcttatatttctcatttcttcatctgaaagttttaataaatctttttcttcaaaaaatatttctccaccatcattaaaacctgtatcctttgaaacaagtctcattatgctcattgcagtcatcgatttaccacaccctgattctcctacaatacatacagtttcaccttgttttactttgaaagaaacatcgttaactgcctttactattcctgattcagtattaaaaaaagtttttaattcttttacttctaataaattattcattatgtttcttcctcctatcttttcttcttaggatcaagtgcatctctaagagcatcacctaaaagatttactgccataactgtaatcagaatacaaattcctggtggtatccaaagccatggtctcttttgaaaatctgcaagtttgtttgccactgtcatcatattccccaagatggaattggttcagctactccaagtccaagataactcaatgctgactctgttaatattgcagatgcaactccaagtgtagcatttactataatagtaggaataacattcggaattaaatgcttaagtatttttctgctatcttttagtcctaaggcttcagtcgcctgcataaattcctgttctctaagtgacaatatttctgctcttacaagtcttgcaatagatggccatgaaagtattccaattgaaagcattaaaaagaaaaccctcatatccccttcaatttttaaattagacattgcagcacctaaaattaatattaccggcataaatggtaatgataaaaatatgtcagttatctgcattaaaatagtatctactttacctccataatatccagatactgcaccaactaaagtacctattattatttcaacaagaacagatataataccaactaaaatagatattcttccgccatacattaatcttgtaagcatgtctcttccaagataatcagtacctaaaatatgtccagccattggcgccattttcacattatctgaatgtgtattaaaatcatactgcataaataatggcccaacaaacgaaaacagaataattgctattaacattattaatcccaacatagcaagcttgtctttttttaatctttttagaactagtctgcttggtgattcaataacttgttctttgcttttcttcacattactcatcttattttcctcctatttcaacttaatacgtggatcgacaactgcatataaaatatctgataataaatttccaagcagtgtcataatagccataaacatattaaatcccataagaagtgtataatctctattaagaatagcttcataacctattcttccaattccaggccatacaaaaatagtttcagtaattattgcacctgcaaataatcctggtatagataatcctatgaatgttacaactggtattagtccattcctaagagcatgcttataaataactactttttcttttaatcctttagcacgagcagttcttatataatcctgctgtataacttcaagcatagatgttctcacataccttaccaatgttccaaactgtattgctgtaagtgaaaatactggtagaaacatatgctttaatatatcaataaaattagtcattcctgttgctgttgaacctgctgatgtcattccccctataggaaaccatcctaaatttaatgaaaacagcttaatagataccaatgcaacaaaaaaagacggaagtgatattccaataaatgaaagtactgttatagttttgtcaaatattgaatactgctttgtagcagaaataattccaagtggtattgcaattattaaacataatataaaagatgtacctgcaagataaaatgaattccacacatatccattaattactgatgtaactggttgttgatatcttagcgaatcaccaaaatcaccctttatagctccttttgcccaatttatatatctcactggcaatggtttatcaagtccatatatttctttaagctgttcaactttttcagctgtcatattaggattaacttttccatcaacaaaatctccaggagctaaatttattattccaaatattattatagaaataactatcaatattggtatcatttttagtattctttttacagtatactgtatcatacgctcttctctccatttcaaaaatattatctaatttactatgtatcaaatttatatttaactttattttttaaaatttatgcaaggaacttatatttacaaattccttgcacttatattattgatactactcttctaaagttgccttatataaatttagatagaaataaacatacggagaactatctaagcctttaactctgccattatatgcatacatatcacttctttgatacataaagatatatggtaaatcttcatttaattcttgataatattgtgcatataaatcttttaatttagattcatctgtttcaatatcaatttctttagcaagttcatcaacttttgggttaacataattagttttattttgagctccatcacttctgaaaactgtatccataggatcttctgttagactccatgccataaacatcatatcccagtctttaccttgttgtttttgtctcattgacacgaaatccattgcctcacttgtaaacttaacgccaagttctttccagtcagaatctgctacagataaaatagaatctacaacaggattatcagtagcagctgtaaagttaattgtaagttttaccccatccttttcccttattccatctgatcctacaatccatccattatcatctaataatttctttgctgcctctaaatcatatttatattcatttttacctttagaatatgcccacgaaacttcagattgaggttcattaataacttttgcataattattataaacagaagaaacaatcttagctctgtttaatccaattgttaacgcttgccttactgctttgtctttgaattgaggcttatcacagttaaaagcaatgtaaccatatccattggtaggatataagttatatcctaaaaatcctatatcctctgcaccttcaacattatcttcagaaacagtaagatctgtaaaatcgatatctcctgattgtaacatttgaagttttacaggatctgtaacaactttatatattacatttttaatttttggtgtacctaagaagaatttatcattagcttcaagtactgtttcttgtccttctttatagcttacaaatttatatgctccagaagatggtcctggattagtatatgtttctttaattttatcagtatttccttgtttgtaataatctgaataataagcactatttactgggtaaatttgtcctcctaaattgtaaattgctgatgagctaggattatccaaagaaatagttatagtcttatcatctttcatttcaattcctgaaattgtgcttgctttacctgcatgatattcatcaacacctaaaatttttgaattaccatgtaataaatctataggtcctgtgtaagaagcatcacaaataattcttattgcaagatcaacatcttttgatgtaattggagtaccatctgaccagtttgcatcatcccttattttaaatgtataagttttaccatcttcagatactgaatgactttctgttaagtaatcctgctcctcacctttttcatttggtaccataagtggtgcaaacatacttcttgctatgttagtatcatattgcccttcagaatatattggatttaatacaccatctggtgcatctgttcctattattaaagtatcctttctattcttaactggatttgcagacatatcctttgcaacatatgtttttacaactgtggatgataaatcttgattttgcccagctccatccccatttgctgatgtttgctgtgccgccccttgtccacatccaactaacattgatattgataacactaatgacatggatgctattatttttttaaatttcattttaaaaaacccctctttattatttttaactatatatctaatctgctatatgtatcatacgcatgattcgaactttaataaaaaaaagctattaaacaaaattctcgtttaatagcccctttgctacttaccgaaaatttaatattataaaataatattaaattcccaactatcattaaataagtttatactttttctctatttatgtcaatattgtattttaatagtttttttatatttttattacttttatgtaattattttatcaccatcattgttttttatataatttaatcatatttttattattaaatttaaaatcaatcttcagacagattttgtataaaaaaaggaataaagcatttcgcattaattcaaaaatactctctcaagcatttattttaagcgttataccttattccttcgtttattttctcgttaattttttatttgttaataatcttttttatgagaaagatttaactcaatttatgaataaataatccacttctaagcttaggttcaaaccatgttgattttggtggcattacttctccaatatcagcaacatccataatatcatgaacttctgttggatacattgaaaaagcaattttcatatctgaatttactctcttttcaagttctttaattcctctgattccacctataaaatcgattctatctgatgttcttacgtcctcaatccctaaaataggagttagtacattattttgaagaattgcaacatcaagctgctctattggatcattttcatcaaatgttcctgatttagcctcaagtatataccactcattttcaatatccattccaaaagtatgttttttagatggttttactggagcattattctcagacttagttacaataaatttttcatctaatttattcaagaattcttcttttgtcattccatttaaatctttaacaactctgttataatccattaccattaaatcgttatctggaaatgcaacagctaagaaataattaaattcttcttctcctgtataatctggattttctgctctcctctttagaccaacttttactgctgatgctgatctatgatgcccatctgctatatataaataatctacttctttaaataaatcagttaattcattaatgattatatcattatcaattacccatactatatgctgaattccatcttcagctacaaaattatatattggctttcttttactttcattttcaatccatgcttctataatctctgaagctatctgttcttctttataagttaaaaatattggccctgtatttgcatcacaatagtcaacatgatttattctgtcttgttccttatcagctcttgtaaattcatgtttttttataatattattcatataatcatctattgatgcacaaaacactatacctgtctgagatcttccattcattacttgtctataaatatataaacatggttgctcatcctgagtgtattcaccacctgaaatcattttatctaaattttctttagccttttcataaactttttgatcatgtacatcaattgaaggatctaaatctatttcagctctatcaacatgaagaaatgagtgtggatttccaattaccatttctcttgcttcttcactattcataacatcataaggtaatgctgcaatttttgaagctaaatctgtaacaggtcttatacccttaaatggtctaattgttgccatcgaaattcccctatataaaaatatattatataaatcatacataatattgttctatttttatcattaaaaagcgacttgttttcatcaccatatatatattcaatataaaaactaaatgatacatcactacaatatacttcttagctttcatatctttaaacttactaaggctcagtagagcagacttttattgtaagcaaactctctgagcctgaaatacttacttaaattataagttaaagaattcttttattgttgatactacttcttcaccaattcttgtttgtgcttcattagtagcagctccaatatgaggagttacactaacctttggatgattaactaatgtagtgttctttgttggctcttcttcaaaaacatcaagtcctgctcctgctattacttcattatcaagagcttcaagtaatgcagcttcttcaacaactttacctcttgcacagtctattaagaaagctgtatttttcattaatgctagttccttcttgccaattaatgatcctgcatttttatcatatggaacatgaagagaaatgaaatcagaaacttttaacacttcttctaaagataaaaagtcatatgctaatgaatcatttttaccaaataaatcagtataaacaactttcattcctaatgcttcaccttttctagctaaagattgtccaattcttcccataccaactatccctagagtctttcctccaatttcagttccttggtatttctttttattccattcaccatttctcattgtgacatttgctataccaacaaatcttgcaagggcaaacatgtgagctaaagctaactctgctactgaatccgaacttgctgctggagtattcttaacagtaactcctgcttcatttcctgctggaatatcaatgttatcaattccaacacctgctcttatagctaattttaaatttccacctttttctgcttcaaaaatatctgcagtaagttttgttgctgatcttataacgatagcatcaaattcctttaatttttctcctaattcctctttttcaatatgttcgtttacaacctctaccctaaagcctttaaagcttcaattgatgctgcttgcaaaccatcgtttgttaatactctaaccattttttaaaatccccttaaatattgttatgcttattaccatatatatcataaataatatgtaatatttttttagtttctttcaataaatttccccaaacaaagaaagaaccctattagtgtacaaactagcagagtttaattttctacgccatcgtaactaatattttatatccaacaaaagttgtctgaattataattataaaaaaataacctcatttttctgagtaattaaatttatacacttataacatttgttatattttactacttattttcttccagttcaatactttattgcttcaattagtaatttaaattattaattgaatatttttttgttattttataagataatttgtttaatatatagcttttataatgattatttaatatctaaaaagtatatatatattatattttacatttaatgtaaaatataaaaatcccacactaaaatctaatgtgggattttttatttattctaaaacttattatttattttctgcttcgaattttttcataaattcaactaaatacttaacaccttctattggcatagcattatatatacttgctctcataccaccaacagttctgtgtcctttaatattttcgattcctgctgccttagcttcttttacaaatttagcatctaattcttcattgccagttacaaaaggtacattcattagagaacgatcttcctttacaactgtaccgctaaataattcgcttgaatcaagataatcataaagaattttagctttttcttcatttctcttcttcatagcttctaaaccaccaagttttttaaggtgtttaaatactttaccacaaatatatattccataagctggtggtgtattatataaagatttattgtctgcatgtattttatattgaagcattgttggtgtaccttcaagtacatcttctgtaattaaatcttctcgaattattacaactacagtaccagctggtccaatattcttttgaactccagcaaaaatcaatccatacttagttacatctattggttctgataatatatctgatgacatatctgcaactaaaattttacctttagtgtcaggaagatcatggtatgtagttccatagattgtattattgtggcagatgtatacataatctgcatcatcactaatttctatattttttaaatctggaatataagtaaatgttttatccgctgaagaagcgattctatttactttaccaaacttttcagcttctgctgctgctttttttgcccattgccctgtaataatgtaatctgcaactttattcttcattaaattcattggtaccattgcaaattgtgttgaacccccaccttgaagaaataatactttgtaattgtctggaatattcattaaatctcttaaatccttctcagcatcttgtattattacttcaaatgccttagaacgatgactcatttccattactgacattccagtccccttataatctaacatttcttctgcggcttcttttagaacctcttctggtaatacagctggtcctgctgcaaaattataaactcttgacatgaaaattgccccccaatttttatattttataactattatagcatattttatatttttaggaataacatatcaataaaaattttatcaaattttattgatatgttaattatgtaatatatactcaatcaattcacttgttaatcatctttacttttgaaaatatgtaaaacgcagaataattctattatcgttatcttctaaattagtttttaatattccaaagttatccacagatttgactacattgtaattttctgaagaataaaaaaggggctgtatcaaattgaaattttttaaattcaatttgatacagcctattcttataaacgtaaattttattcatgtatatatttccaaatattttattttgaaataacacaaataaaggataaacattattatccatattttaactatatatttaaaattacgaagcttgctgcttatgaagcagctcaccgttacgattttgaatggttttatggtacaatttattaacattataaccaaacgccattaacaaaaattcagtacgaactttaatatttccacgcataaaaaatcttctaaaaccataatcttgtttaataactccaaatgctccttcgacttgaattgatctgttcattcttaaaagtattcctttaggtgtagtgatgtttttaagtgaatttgttcttagacgcataaaatttttagccacatgtatttgtttattaccttttgctttcgtacatttactcttatattcacagccatcacagtcttcacattcatagatgctaacagtagtttcatatccagattttgtttttttcttttttgttccttttagaagcatttttttaccagatgcacaaatgtagtaatcttcatctgtgttatagtacatattttctttcttactaatatcactcttgaatttctttgtctttgacttttcataatttgcaggtttaataaaagcttcttgtttcttagattcaagatatgcataattttcttcactttcgtatcctgcgtcagcagttacggattcatatttttgatttaaattcttttctaatctatctaaaaatggtataaaagtaagctggtcagatctttcacttgaaatgtctactcctacaatatattcaccttctacccctatttggatattatatgctggttttaattgaccgtttttcatatgatcttctttcatatgcatgaaagttgcgtcatgatctgtttttgaaaaactgtttcgtccattaaaaatgctattgtattcattatatttattttgcttttcaataaattcattaagttgttcagtatatctttggaatttactttttcttttaccttttccataaacaaattcaatattattggcttcaatcataattctgatactatctaaaatataattagcatcttgaactgatattttagcattagtaataataagacataaattcaaatcatgattcatttttattaagctttcttttattttcttttgtagtctatcttcaaatttatcaatagattttttccaaacaaaagtatatcgatttgcagatgcttcgattttagttccatcaataaaaatatttttaaattgaatttcattaagttctctaagttttttcacaagttgattaaataaattttctatacaaccagctaatcgttcacgtctaaatctatctatagaattgtgtcctggtggtagttgaccttgtaaaagccatttgaaatttatatctcttttgcatgccttttcaagagcacgacttgaatatattccttccatatatccataaactataattgcaaacatagttttaggtaaaagtgctggatttctaccaatagtagagtaagttctatttaattctgaataatctaatccctccataacatcataaagcactcttactgaatcactatcagatataatattttctatatttattgggaaacctatttgatgcataggtataatattattagtgttcatattaatattatgcgcaaaaaagagaattcaaatttatgaattctctttttttatcggctagtatcaaaattgttttgatacagcccctaatgattagtcataattatcatattcatcatcaaaatatagtactgattctgtttctctgcaatacttaacacacatgcactgagccagctttcttggacacttataacataagcatgttaaatcttttccatcacattttcctttttttatttctgtacagtcactacagtttactccatttcctgctgccatacttatcactactcctttaaatatattgctacattacatattaacgcaaagttctcgattgtcaaatcaatattttaataattaggttcatctaaataaatataaccgtataaatattgtgttgagtagatctcttgatacttaaaacaatccccatgccacatagattcagatatatatgtcttgttattatctattttttctactacagcaacatgtccacatccgcctgatcctggtaaacttgaattccatacagcaatagctcctactttaggctctgtaccatacttatatttaccagttcttttatttgattcccaccattcataagcatttcctataaaatttgcttctattggtggttttccagtcaattcccatgcacgtccccatgcataccatgtacagtttcctcttatttgctctcctgaactattaaaaaatggtggtgataatcttactttataaaatatattcgcatctgaatagtaatgaacatcattcaaacttggagatgtagtccttattccacctaaagttactgtgacattattttctttatgatcttcaacaggcttcttgtctttatcagtatttgattgtatatctgttggtttttcaaagctaatccaatcagaacttacccatgcatttttttcattaagcactataggataaaaaccattttgtatatttcctacaatattaacttcagctcctctagctaatttatctactacagaagaatcaatagatgcttctgaacgaacattaagaaaatcgctatttgtatttacatatgcttttttattgtaatcttcttgaggtgatgctgtagtttgatcatttgccccacttaacatagcaccattctctgcgaaagtataactttttccatctatacttatactacctttttcaagtcttccctttgaatcagcataataccacgtatcattatcctgaatccatcctgtaagcattattccatggtcatcaaacatgtaccattcatcatcaatttccttccatcccttatccataattccactaggagacatatgataccatttttcattttcttcaaaccatccagttagcattacaccatgatcatcaaacttgtaccatttttcattgtcttttacccacccagactgcatgataccagaatcattaaaataataccatttaccatttatttgtttccagtcattaaccatagtcccatcatcatttaacatataccatttgtcattatcctgaatccaccccgtattcatatgccctttttcatcaaaatgataccacttattttgaatttctttccatcctatagatttttcttgattttccgtccaaatccacttatcactttccttattccattcagcatagacaggcatagaaactgtcagactcattaatgtcattaaaatcacttttttaacatatgctcttctcactaacttttccccttttttattctaatttttataaaccatcagtaaaatattgcttatttacatattttaattccatactttacatattatattatattatattgtttaatataacaaactaaaatatataaaattaaaaatttaataaaaatatacataataaaaaaagcacttgtccctttaaaacaacatttataaattttgagtaacgtttatgtattaaaattaatcataaatcatctcaaaataaatattgtttattaaacaagtacttttaataatattctatatgtcatataactttataaaaataacacaattaaagcaataaccacaactcctggaattcctaaaaatccagctattaatgcagtaatcggattaattggtaacacaaaattagtgtgtattccaataactcctaaattagcagttataatattaactacatataataaaacaactcctattattccatttatcagtatttttattggccacttaagtaattttatacataaaaataatgctactattcctaccaagccatataataaatattgttcattcataattaacgcctcttccctaaatgctactccatgactttaagatttttttcgtatatatagtcatatcctacttgaagatctatagaccttgctattgataataaataatcatatctttttcttgctacattctctgagtaaatagctacttctataagtgtagcatcactaacattatcaaacatacttcgtgctgcacttatttctttttttgcttcttccatctcatctaatagcttttcataaagttcatatgaatttgtactattatacaagtatcccagaatcttttttctgttcacataaatccctccaaaaaagttcttattatattactatccactttttggaaatattatgcttcatttattttttatttttatattcatcatttgtaacaatttaacctatagtccatatactatatgatataagaagcttttcactcatgtcaaacaaaaacttctaactcccatctatgtaacacctttttctaggaacccaaaacccacttgggttcctttattatatttcttttcttccttcaagagcttttgataatgtaacttcatcagcatattcaagatctcctccaacaggtattcccgctgcaattctagttacttttacatctaatggcttcaatacttttgaaatatacatagctgtcgcttctccttcaatattaggatttgtagctaagattacttcttttacgtctgcactcattcttgcaacaagttctcttattctaatatcctgtgggcctctgccttgcattggagatatatttccatgtaatacatgataaactccattgtattcttttactttttccatagtcataatatcttttggttgctcaacaacacatatcattcccttatctctattgggattcgaacatagagaacagggatctgaatcagtaaaatttccacatattgaacagtactttattgttcctctagccttaactaaagcattagcaaattctctcacttcatcttctggaagattaagcacatgtaaagttaatctctgcgctgtcttttttcctatgcttggcaactttgcaaattcttctattaatttttctatggctactggataaaattccatattaatttctccttttcttcttagagttcttatatatattattttaatcaattgtttacttatttattataccgtactttaatgtaattattgattgtcatttttatttattgaaaaaagcatacaaggtgatggataatccaacttcctgtatgctatattttaataattataacctgctagaataatccacccattccaccagttaatttacccattttacttgaagtttcttcatcagcttttttcattgcttcattaacagcagttaatactaaatcctcaagcatttcaacatcatctggatctacaacttctggttttatgtttatagcagaaacttcttttttaccatttactttaacaactacagctccaccacctactgatgcttcaaattccttagtttcaatttctttttgcatatcttccatttgcttttgaagcttttgagcctgcttcataagattgttcatgtttccgccgccgaagcctcctgggaatcctcctcttgccataaaaaaatcctcctcttattcttaaatatcattttttaattataaaacatcttcaaataataaacaagtttcactattatactctaaaattactatcttctaaatttatattttaactattatattattcatcatatacttcaaaaggtatgccttctattttatctttaagcatttgctctttatcaacaagatcttctttttcttttataattgtataattaactataactttttcacgaagtactttagagaatatttcatttacagtttctctatactgttggttttctaaccttggcttgctttgtgagtatagttcattaaatcctatagttagtactccatttttaaaactatatggttttcctgttattaaggatgcatgaattattctcgctctcatggctttaaacatttctaatatttcagcccacgctcttgcaacatcatcaattgttagtttggattcagtattgaaaccttcattaacagcttcaccattgcctgatattttattctcaatttttttagaactagtagcttctcttttttgatttgaatcattacgtatagtcccagtattattactataattttcagattcatccactgatgaattactcactatttgaacttttccgtttttcaaatcttcctctagtctgttcattcttgataaaataacttcattagaagtatcatactctatcttacacatttttattattgataattcaagatatagtctgctttgcttactcatcttagaattagcttctgcttcttgaagaattcttatatccctcattatttcttctactcttattttacgcccctgttctcttactaatgtaatattttcaagagacatatctaatacttcttctggattagtagttaccttaatcataagaagatttctaaagtgagctataagatcttttatgaatagctgcatatctttacctgaatatacaagcttatcaacaataatcatcgatttttcaatatttctttctattatagaattagttatatcaaataaatattcattagttactaaaccaaggatacttaccaaatcattatagtctatttcattttctcccattgcaattgcctgatctaatatacttagagcatctctcattgctccatcacaaactcttgcaataagatctaaacttttatcttcacaatctatgttttgagcttctgttattcttcttagccttgctgatacttctttatgattaatcctcttaaaatcaaatctctgacatcttgataatattgttattggaagcttttgtggatctgttgtagccaatatgaatattacattcttaggtggttcttctaaggtctttaaaaatgcgttaacagctccaactgatagcatatgaacctcatccattatgtatactttatattttgcttcctgtggcggatattttgtatcatcaataatatcccttattttatcaataccattattcgatgctgcatccaactcagtaacatctatagccaatccttcattaatttttttacacatctcacattcattgcatggctctccatcttgtaaattaagacagtttaaagcctttgccataacttttgcagtagatgtctttcctgtacctcttgttccacagaaaagataagcatgtgctattctatcatttataatttcattttttaatgtggtagtaatatgttcctgaccaactacatcatcaaaagtctttggtctccattctctatataatgctgtataacccaaaggcctctcacctcgctatttatcttaaatatacccttattatacactaatgccacttcaattcaaaatatctcttaattcaacctatcatcatattattttaagtaaaaaatatatattaaactataaactttacaattaatatttaaataacataggattttaacatggactgataattatcacatggcaattgaagtatattaaatcttagtgttttagtttatactaatttaaaataccttataaaagtaatattaaacatataaaggagaaatattcaatatgtcaaaaaaaattattcaccatgtttgcattcaaactaatgattataaaaattcattagatttttataaccaaatactcgattttgaaatagttcaggaaactaaaaattttcataatcgagactataacacatggctgaaatgtggagatttcatgattgagttacaaacacctaaaaataatattccactaaataactatagtactttaaatgaaggaattgttcatatgtgcttctttgtagataatatacactcagaatatgaaaaaataaagtcatgtggatatacaaagttcaaattaaaaaataacaaagaaatatataaagttgaaaatggatttttatttaaagttatagcacctgaaggtactgaaattgaatttagagatagtcaaatataaaccaaactatttataataattaaatgaagagaattattagttttcataattcatctaacaatgataaaataaatatactacaattaataggtaacgggaggattttaattttatgagtacatatgatgataaatatttatcaattgctaaagatatactagaaaatgggtactatgataacaatagaacaggaatgcctacatacaaattaccacatcaaataatgcaatttaatttagaaaaagaatttccgattttaacaacaaagtttgttgcttttaaaactgctgttaaagaacttttatggatatttaaagatcaatcaaataatgttaaagatcttcaagctcagaatgtacgtatctgggatgaatgggaaatggaagatggtactatcggaacttcttacggatgggttgtaaaaaaattcaatcaaatcgacaaactaattgatgctttaaaaaacaatcctcaagatagaagaatgatgcttaacttatggcaatgggagcacttagatggtggtgctttatacccttgctgctgggcaacaatgtgggatgttactgatggcagacttaactgtatgcttatccaaagatcaggagatttaccacttggagttccattcaacacaagccaatatgctgtattagtccatttattagctcaagttactggacttaagccaggattatttactcatgtaataaacaatgcacatatttatgaaaatcaaattgaaggtatgaaaactcaattaacaagaaaagatgatgcttatgatgctccaaaactttggattaaccctgaaatcaaaaatttctatgatttcacaccagatgatataaaacttattgattataaacatcacgaaacaataaaaatgcctgtatccgtttagtttacagttagcagttaataatcttttaccatactatattttttaaattatatatttatgatttgtagtataataagataattttaaaatcatataaggagggctatatatgctatcattaatagtagctattgcacaaaataatgttatcgggaaagataacaaactaatctggcatatttcagaagacttaaagagatttaaatctataacttctggcaatacaatgcttatgggaagaaaaacctttgaatcacttcctggaatacttcctaatagaaggcatgtgattataacacgtgatgataaatatgctgttgattctgatcaagttgatataatttctgatttggattcatttataaaaaatcatgaaaactctgaagaagaaatttttgttattggtggtgcagaaatttacaaacaacttctacctcactgcaaaaaactatatttaactaaagtccatgaatcttttgaaggtgatacacactttcctgaaatagatttttctaagtatgacattgaatattcatcagataaaatgattgatgaaaaaaatgggcttacatattcttttattaatttagtgagaaaataataaaaattattcatatctgagtatttttatattcagatatgaatttatagaatatactgcaatagtaatttaactacaacataaaattagaaattggggagataaaaatgaaactattaacttttgaatacgataacaaaaaaagtttaggtattttagtaaataacaacaaaatatatcctataaaaaagattggtattaactatgaatctatgaatgaattgatatgtaatataagtgatgaagaaattaaattattaaataataaaatttttgagggcttttgcgataatgatcttatatctgttgaagaagtaaaaaaatctgctcctattccaattcctgcacaagatataatatgtcttggaattaattattcagctcatgcagaagaatcagcacgatataaaaaagaagcttttgaaaaagatagaaaatatcctgtttatttttcaaaacgtgttaacaatgcaacgactgatggtgatattattccattatatgatggattagtggacagccttgattatgaatgtgaactagctgttatcattggtaaagatgcaaagaacgtatcttctgataatgcttatgactatgtatttgggtatacaataatgaatgatgtgagcgcaagaaacttacagacaaggcataaacaatggtattttggaaaaagtcttgatggatttacgcctatggggccatggattgttacaaaagatgaatttaatgaacctcctgttttaaaaatatgctcaagagtcaatggagaattaagacaaaatagtgtaacagatttaatgattacaactatatcagatgcaatatctgaattatctcaaggaatgaccttaaaagctggtactataattgctatgggtactcctgctggtgtaggaatgggatttcaacctccaaaattcttaaaatcaggtgatattgttgagtgtgaaattgaaggcataggttgtatcaaaaatacggtaaggtgactgtcacctgtcgctttttgtaaaaagaaaatgagggtatttcatataaatgaaatcccctcattttcttatcctattgattgtgtcctatattgttaatcctattgaagaataacctatttaattctttaaaacttcttcatacgactatgaagaatccatataaataaaccacgcaccttgagttgttatcagctctctatacgttacttctgcagttagctcagaccagattgatccacggcacacgaaagtgaccacttatcgctgcttccttccagacctgacgaggttcatgggcttccattgcgtgggacccagtcatcaacaccacttacaaaagtcagactataaattactgatacctaatcaaggaattcaaccctgctatagcggattgcaggttacagggcaccgctaactccccatctagcgtggcaatggtggaatgaagagggattgaacctccaaacttttcttaatcctttaagaaaaagtctcgtccccagtggacatcagaccatgttattcattgcaacatgcttaagtacaataaattattcttatatactttatgcaaatcacatagtatttattaatgtaataaaataattacactgttttaatacttgttaatgataacatataaaatacctaaattcaaggctataatatttaaatttttttataaaaaaatgctttgtttttcatatattaaattaaactccaaattttatattcacgtaattatactttcttaaataggttattaaaatttattgtatattctaccttaaaagctacttaatcttaacgagtttataaaagttatcttactatatattggcttacaatcttttcatattctgcatctgctctaactttattaagacctttattaaacttatctaataattcttgatttttgcccttatttactgcaaacccataattaaaagtttttaatttatctcctgctattttcaaattagctggtgtagctttttttacttcatatgctattataggatggtcttcaattacagcatctgagcttccttcttcaacatctaaaaacatactttgtgagttatcaaaatattttaaattcaagctatacttttctttattatcttctgcaaactcactgcctgctgttccttttttaacagctacattttttccttgtagatcttcaaatttactaattgaagtttcatcatgttttactcccatggataatccagattcaaaatattcttctgaaaaatctaaaatttcttttctttcatctgtaatacttattgctcccatagcaccatcaatagttccatctgaaagaccagaaattattgatccaaaatccattggttttaattcataatcaaaatcctcttttttagatatagcttctaataattctacatcaatacctgtataagtaccattttcctcaaatgagaatggtggaaaattcgaatcacatgcaattacatatttaggctttgtctcatcattagatgttgtattttcattaatgtcttttgtattttttccacaggctgtgaatagtaatgttagcaacattaatgacattatagctagtaataaccttccttttttcatttgtaattacccctttcaacaaaaatatattttttataaaattattttctgtaatttatccattgcttatactaatttttgtacacaaaatataaagaaaaattttattattaaacttaaatattgacacaataaacaaaagctaatgaaaccagctgtaataaagcttgtttcattagcttttttgtttgttcatcaaaattgcatagaagataaccttttttaatatactaacctgtctaagtatatttatgtaatgactataaatgagtttactattcacttctcaaatcaaccattattaattactttatctaaaaattctctacatctttcacttttcggattagtaaatatctcttctggtgatccttcttctaaaatatatcctttatccataaatataaccctgtcagctacttcttttgcaaagttcatttcatgagtaacaattaccattgtcattccttcacttgccaaatctttcataacctttaatacctctccaaccatttcagggtcaagagctgatgtaggttcatcaaataacattatcttagggttcatttccagtgctctagcaatagctaccctttgcttctgaccacctgataatgtatctggataaacatcttttttatccttcaatcctactttatccaataattcaagtgcctttttttcagcttcttccttagttaatctttttaattcaacaggtgcaagcatcatgtttttaagtacactttgatggggaataaattgaaatgctgaaataccattcctatgttctgtcttaatttatctatattcttgttatttactaattcttcgcctaaaattttaatgcttcccccttgaatttcttcaagtctgtttaagcatcttaaaaaagtactttttcctgatccagaaggtcctattatacaaacaacttctccttctttcacatctaaagatatatctttaagtacttctaactttccatagctcttctttacactatttgcttttatgaccatgatgtaagctcctttctatgtattttgataatatacttaatgtagttatcaaaataaaatacattataccaactattgcatatgtctctagtggtttaaagtttctagctactataatctgtccacttgctgttaattctcttatagttattactgttaatattgatgtatcctttattgtaactataaattgattaattattgatggtatcattacctttattgcttgtggtaatattaccttttgcattgtttttaaatatccaaggcctaagcttcttgatgcttccatttgcccaacatctacagcctgaataccagctctaaatatttcagacatgtatgcacctgcatttaaagcaagagcaattatggcacaatacattggattagatctttctacaattaatggtgcaataccaaaataaataattaatgcttgaaccattaaaggtgtgcctctgattatatataaatatataatgtatagtgtttttaatattttatttttacttatactaaatatcccaaaaacaattcctaatataacagctattataattgaaatgattgaaatttttatagtaaccaatagtccactagttaaactaggtaaagaatcttttaataattctaaaaactgcataaacttctctcctaactaattatcacaacagtaatgaaggcttaaagccctcattactaattttttaattattttcctatatattgtccaacgatcttatcgtattctccgttttcttttactttcttaagaccatcattaaatttttgtaataattctttgttttttcctttacttactgcaaaaccataatcaacttttgttaatttgtcaccagctattcttaacttagatccaccatcaactttaatcttatacgctattactggataatcttctaataagaaatcagaatttccattttcaacttctaagaacattgttggagaatcttcaagataatttaattttaaaccatatttatctgcattttcttcagcaaattgagatcctgctgtcccttttttaactgctgcactttttccttgtaaatcatctactccatttatatcagtgttattagcattaacaactaatgataatcctgattcaaaataaccatccgaaaaatctaaagcttgttttctttcatctgtaatacttatacctgcaattgctccatctaattgtccacttgtaagccctggaattacagcttggaaatccattggtttcaattcatattcaaaaccttcttcttttgctatagcatctaataattctacgtcaatccctttataagatccattttcttcaaatgagaatggtgcatatttagcatcacatgctattatgtatttaccttctttagcttcccctattgatgactccttgcttccgcctgcatttgctgatccacaccctgtaagtaatgctactgataatactgatgccattacagcagataatattttgctctttttcattttaattaacccctttcaaatatgagtaatactatttaattactactcgtttttatattaaaattattttatataaactttttaattgcttttgcttatttctccacataaatttgtattcataattttttctatatcttcatatttttcagtttgtcctaaagcccacattaattttgtcactgctgcttcagtactcatatctctacctgaaatcagcccacatttttctgcttcaactccaacctgataaacatttaagtttgctccatcataaacacattgacttactacaataacaggaattctatacttacttgttatttctttaaactttgcaagcaaatttgtatattcagaaggtattccacccaagccaaatgcttcaacaacaacacccttatatccctgatttacaataaaatcaataatctctggtcttattccaggtattaattttaataaaaaaactttatcgcagatctttgaataaatcttagtagtttcttttactgaatcataagattcttctaaaattacttttccattttttattcttcctaaataagaatcattgcagcttacaaaagcatcttcatctaaagaatgaattttaaaggctcttgtcccaagtattatttttccattaaatacgagacaaattttatttaattctgaaagtgcaacttgaaacccttgcaataaattagttattccatcgctgccttccttatcgattggaacttgagatcctgtaaaaacaactggtttatcaacattttttaacatataagaaataatagatgttgtatatgccatagtatctgtaccatgagtaactacaattccatcaaatttttttaatccctcatatatggcatttgcaataattacccagtcttcagagtacatattagaactatcaatatttaaaattggttttattgtaattgtgcattgagttttaatttgtggtatcttctctataagccactcacctgttaatccaggaacaagtccatcttttgtttcaacacatgcaatagtgccgccagttgttaataaaagtatgttcttcataaaacttttctatacctctctctgcctactacaaactctttcttgtaaatggaaaatatgctgcgaaattaatttttctgtactttcaaaatctctttttactaaggattctgctatctttatatgttcatgtttttcattaataaattctagctcatgactatctgccataagtattcttgataaattctccattatgcctaatccaatctcaacaaataatgaattgtgagttgcttttataattgccatatggaatgtatcatttaatttattaaacgaaaagaaactatctttcgctgttatttctggaaaatttgatgcaagttctaatatactcataagttcagaatcatctgctgttttaattgctattttagctgctgctatttcaacaattaatctcatttgaaaagattctcttatacttctattagtaacaggtttcactaaatatccttttctcggtaaagatttaagatatccctctatttctaatgcaccaagggcatcccttaccggagttttgcttacattatacttttctgctaattctgataatgtaagaaaatctccatctttaatttgagaacttaaaatatcatgttttaattttttatatatttcttttgaatatgccccttcaaatcctttcaatatcattacacctttccactgaaatcccactgatatatcaattaaaataaaaaaagacaacggaatcctattataaaaataaatgctccgttgcctttattaaaatgaattatacaaaataaaatcctgcatgtcaagttttttcagttttaatttttctactaaaatcgatacttgtactcaagaaactgcagcacaatactttttatgctgcagtacacttaacataaaatcaacttgtttaagctaatttatggtacatttctgataacatttcatctgttatttcaacaggattattataaagatttgggtgacgacttattcttactaaatcattaatttgatcttcattaaggtttaagtcttttaaatcatttctcaatcccattttattctttagctcataaatcgcatctgccatactatcagaattttcgaatccaagagtcttagctaatttgtctattctttccccttcataaccattagcattaattctaacaaaataatctaatgttaatccacacgcttctccatgtggtatatgatgaatattggtaagagggaatgaacatgcatgtgatgatgttgtctttggtaatgtaaatgccaagccagctattaatgatgcttcacacattttttctcttgcttcttcatctttaggattttcataagccttgtacaaatatttaaatacaagatctgctgcatgaattgcgcaggcatcacatattggctgatgtcccttactccagtaaccttcaagggcatgagataatacgtcaatacctgttcctgctgttactttaggaggcatagtatatgtcaattctggatcaattatagctacacttgggaagaacccatctgaaactataggagatttttttccattttcatgatcagtaagtactgaaacacaagttacctcacttccagttcctgatgttgttggaactgcaattaatggcagatgatcaattggaagagatactcctgttccatgatattttctaattgaatcttctgttaacgctacacttgctgctgccttagcacaatccattgaacttccgcctccaagtgctacaacaaatccaatattcttttcacgtataatgtttgcacattcatctacttcagtaacatctggatttggtgaaatttcaccaaatgatgctataatagttccttcactttcatttattattttttcagctaatccatttgtgaagaaaaatggatctgcaactaataatccattgttacatccaatagctcttgcaatatctttaacctctgaaattcttccttttccaaagtgaatctttacaggttgtaaataatcccagttcatactttcaccttctctataaattaattacagtatttttcatctacaattgttaatacttcatctaaaattggtagatattcttctaattcttctttagtaattattaatggtgggcatatttcaataaagttttcacgaccaaatgttgcaaatccacgtttctttagttctgcaaaaatccatggcataactggtcctggtactccatattcctgcattggttctcttgtttctttatttttaacaacttctaaagcaccaaataacccgatacatctagattcaccaatacatttatgtttttcaaccatgttatccataaatgctgataaaatgtcatgcatttctgctacatgttcttcaattccatgttctctgtaataagttactgatgcaacaccagctgcacaggctaaagtatgtccactatatgttaaaccacattgtaaaacattttcttcaaaatactcagcaatttctttagttacaatacatccacctaattgaacataaccacaagttacaccctttgcaaacgtaataatatctggcttaatattaaagttcatatatccaaacattttaccagtacgatagaaaccagccataacttcatcacaaattaataatattccatatttatcacaaagtgctctaacaccttccatatatccatctggtggaagaattacaccattagctccaactattgattccataactattgcagctacattttgtgttccttcataacgtaattgtaaatcaagtgcttctaaatatctctttgtagcttcagcatcatctacaccttttgtatatccgtctctatacatttgtggattcataaagtgaataaatccatttgcaccaccaacttcagcaacatatcttctccagtcacctgatgcatttgaagctccaagagttgctccatgataacttctatagcatgagaatattttagttcttcccgtaaccatacgtgccattttgaaagcattttcgtttgattctgctccaccgtttgtaaaaaatactcttccgtaagtatcttcccctgcagcttctactaataattttgctaacttactctttggttctgatgcatatgcaggtgccataaaacacattttatcagcttgttcttttattgcttcaacaatttctggaagctgatgtcctaaatttgagcatactaacaaagatgacatatccgcatatttttttccatcataatcataaaaataaattccttctgctctctctattggtaatgtatccgctcctgattttgcccatgactgcattacatatttttgatgcatttctgctatttcttttccatttaaactcattttcttttcctcctaaaataaaataatattttcaaaaattataattaccctaaaataaaaaggacgcatattacttttatgtaatagacgcccttgtcttctatgtcattaagtttatctttttatccttatctttacaatgtaacaaagcctaattttatttgtgctggaacacaacatactatatcataaaactatttttaatcttaatatgttttctaaatgagataaatcaattttagtagcactctattaacctgtttaattaaatcttttaataaaacagacctatataatcccctaaatttctaagtttataatattaatgacatccctgaaagaattaataagatatatgttaaattcaaaaatatatttttatctaatttttcagctaattttccaccaacccatgttgctataaataaaggtatgatgcttagtaatattaaatttatattactacttgtaaatagaccagatttatattgtgaaaacgccatatatgtgttaagaacaacccatactggtgcaattgtcgctctaaattcatccttatctttaaaaacctgcactgcatagacaaccagaagtgctcctcccgacacaaacattccatgtattatacctgaaagtaataatacaattagtaatattgatggatggactgttacctcctttttcaaaattaaatttttcaatgcaattataaatataactattccatatacggtaagaagaacattatcagaattaacaagttcacaaattttaattccaactaccattccaataatcataaatatgattatttttattaattctttccatcttatatttttatagttcataatagctattaataatcctgatatcaatgccattacatttagtataaccttagcattatccaatccaatcaaacatgctgatggtggcattgccaaaaccgttcctgcaaatccagtaatcccttgtactacatttgaaaaaaataaaataattaaaaataatatttctgataacatttttagcccccatgtaatttcattataatttcactactaaaagacaaaaaaatgccagaattaattttaaactttaactctgacatcgttgcctataattttcttttagtctatattttatctttaataatacataaattcaatgaattctagtctaactttacatgtgttctagcacatatattaaaatagtaattaaaaattatagtctttatatttgacctttttatactttgaattttttctcataaaaaaagatagacttttcagcctatcaaattaatcctatttatcttcttttttcaattctagtggtttttctgtcaatacagctttacttgatattagcttcttgcatgtattacaaaaatatcctgtagatccacatccttttatacattctacaacattaccacattgtggacaataatatgtcatatttgtcacctctatcaatttaaaatttatcctatgtatatttaaatactattttcctacctactattatatcaaattttttaaacagatgatatttatatatataatcttatacaatgcagaatattgtcaacttattttttttaaaagttgacaatctccttgtaaggatttaacatattacaataggagggatcttatgaataataatgtaaaaaataatatactctgtggaatttttgctgctcttatagcagtaggtgcatttataaaaatacctattcctatatgcccattcacattacaatttctatttaccaaccttgctggattgttgcttggtaaaaaagtaggaagtcgagcagttggtatctatataattttaggtcttataggacttccgattttttcagaaggaggaggaatcggatattttattcatcccacatttggatatatactgggattttatgcaggaacttatgctgctggacatattgttcataaaaataataatttttcatttaaaaatatattatatgccagcttttgtaatctagctatagtttatgtgtttggaatgatttattactatgctataggtaactattttataaattctccaataggattatatacattaatactatactgctttattcttgcagtacctggagatatactactatgtcttatatctacatgtgtagcaaaaaaagtaattcctgttataaataactcaatacaatccacagaagaaaattcaaaattcatatcaaagaatatttaaattatgaggtgaaaaatgagtaaaggaatttttattacagcaactggaacagatataggaaaaacctatgtcacaggattaatattaaaattattaagagaaaacaatataaatgcttcttattataaagctgcattaagtggagcagatttagtaaatgataaacttattcctggagatgctaaatatgttgctgatattagtaatttaaaagaagacccaacaaatcttgtttcttatatttataaaacagcagtatcaccacatttagcatcagaaattgaaggtaatccaattgaaatgaataaaataaaatcagattttttaaaagcaaaatctaattgtgactatataactgtagagggaagtggtggaataatttgtccgctaagaatggacaaccagcttataatgcttaaagacgttataaaagaacttaatcttgatatattcattattgcatcatcggaacttggtactattaacaatgttgttttaactgttgagtatgcaaaatcgaataatatcaatgttagaggaataattatgaataattatgatgaaaataattttctgcatagagataataaaaaatcagtagagcgtttgacaggaattccagtaatagctacagtgaaaacaaatgataaaaatttagatatccatataaataaattattaaatttataccaggagatatagttatgagtattagcttagaagaaaaagatttgaaacatatatggcatccttgttcacagatgaaagactacgaaaaacttccaccaatagttatagatcatgcaaaaggcatgtacttatatgatatccacggaaaaaaatatatggatatcataagttcatggtggtgtaatttatttggacattgtaacgaaaggataaatactgcattaaaaaatcaagtagataatttagaacatgttatatttgcaaatttttctcacaagcccgcaattgaattatgtgaattattatgtgaagtccttccaaaagcattgaataaatttttatttaccgataacggttcatctgccattgaggctgcaataaagttaagctttcaatatcactatcaagtaggtgaggtacacagaaaaacctttatgtcactatctgatgcctaccatggtgaaacagttggtgctttatctgtaagtggtatggacttatatgctgaaatatttaagccactactttttgatatagtaagagtagatgctccagactgctatagatgtaaatacggaaaatgtagagaaagctgtaatgctgagtgttttgaaagtgcagaaaaagcttttgaacaatatggtaatgtaacatctggatttataattgaacctattgttcaaggtgctgctggaatgagaatgtactcacctatatatttaaaaaaattaagaaaaatatgcaacaaatataatgttcatcttattgatgatgaaatagctatgggatatggaaggactggaaaaatgtttggatgtgaccatgcagatatatcaccagacataatgtgtgtatcaaaaggcttaacaggaggatatcttccaatggctttatgtataagtactgatgaaatttataatgcattttatgatgattataataagggaaaagcatttatgcacagtcatacatatagcgggaatgctcttgcatgttctgtagctgtagaaattttaaaaattcttaaagaagaaaaaatcatagaaaactctcaagataagagacaatatttcaaagatttagtatataacacattcaaggattacaaatatgcaggtgatataagaagtcaaggccttataaatgcaattgaattagttgaagataaaaatactaaaaaaccttttgattctaaaaaaagaataggctatcaagtttataaaaaagctttagaaaaagggcttcttttaagacctataggagatatactatattttaatcctcctcttactatagaacctgatgaaatgcagtttgcagttaagacatgcttagaatctattaaagaagttcttggtgaatagcagggacagtagatagatttgtgtaaaaacaaaatctatctactgtttttttgtatgaacagttggtagttttggaataataaaacatataagtttaggaggaattattatgacaaaaaaaattgatactaactttgactacaatgaagaaataaaaaaatgtaaaaccatcgatgatgttatgggtaagaatgggctaatacagaaacttgtaaaagatgtccttgaaaatatattagaaggcgaaatggaagagcatcttggaagaaataaatatgagcgtacagaatcaaataatcaaagcaatagaaactatagaaacgggtatagcagtaaaaatctacgaagctccttcggtgacgtcgacttagacgtaccacgtgatagaaatgcagaattcgaacctcaaattataaagaaatatgaaactgtctgtactgagttagataaaaaaattatatctttatatgctaaaggtatgagtacaagtgatatccaatcagagattgaagatctatatggaataaaaatatctccatcgatggtatctaaaataacagataaagtacttgctagcgctaccgaatggcaaaatagagctttggataaaatatatcctatcgtttatttagatgctatgtactttaaagttagaagtaatggaaagataattaataaagctgtttacatttgtttaggatatacaatggatggctataaagatattttaggtatatgggttgatgaagcagaaggtgctaagttctggttaggaatttgtaatgacttaaaaaatagaggagttaaagaaatattaattgcatgtatggatggtttaaaaggattaccacaagctattaaaacagtatttccatcagtaaatattcaaacatgtattgttcaccaaattagaaattcaatcaaatatatagcttcaaaggataaaaaggcatttatgaaggatttaaaagaagtttacaaagcatcaactgaagaacttgcgttggcgcagctagacaatttaaaatctttgtggggtgataaatacgctatagttattgattcttggtataataattggagtaatctatcaacattttttgatttctctccaagcataagaaagatgatatatactaccaatgcacttgaagggtttaatcgtcaaatacgtaaatttactaaggttagagtgatctttcctacagatgaatcgttaaataagtgtgtttacttagctacgatggaaataatagaaaaatggagtcaacctactccaaattggggtgctacgctagcggagctatcaataatatttgaagatcaattaaaagatgaattagcttagaagcttgtacttttattgattaatatgcatacttttagattttattgaaatactaaaaaaggtaataaaaaacattattagtatttcttaaatataaaaaaatattactggaaatcaaaatttccagtaataataaattgataaaaatactaattacacaaaactatctaaactctcgaatagcataatcaattttcaaataagtaattaattaatattgaagagatataatttattttagctcttcaatattatttagaagttatatctaatactattttaaaataaaaatttatctttggctatactctgcatattgaggggttcctagtgcatacccacctgcaacttcatgaatcattcctgttacaaaagatgaatcatcacatgcataatataaaactgcattagctatatcttcaggttttccaactctatttaatggtacatgtcttaaaaatgatgttctaaattcattagacatgttttctagtgcagcctttgttgctatcaaacctggtaatactgcattacatcttatattttttccagcatattgtattgctatattttgagttaaagaattaattgctgcttttgaaacacaatatgacattcttgataaatcgggaacaaccgaacctattgttgatatatttactatgcttcctcccccgcatttctccatataaggtattgcagctttacatggtaaatatacactttcaacattatcttttaatattctaaaaaattcatcagtgtctccatctgtcaaatttttatccaaatcaacgttagttttaccatagttattgactaatatatctaatcttccttccgcttcagcagcatattttaccattgtagtataagtttctacttctgaagaattaaaataaacaaatttagctatttcacctttctttttcatttcagctataacttcattagcaagttcttgtgaacgagctgctaaataaactgtagcaccttctcttgctagtgcctgtgctgatgctaaccctattcctttagttgatgcagttactattgcaactttcccttctaattttttcattctaaattcctccttacatgcatatcaaattttatgccatgtgatcaaacatcttacctaattttgcaatcaaatcatttctatccatttcattattttttttcatcttttctctatttaattcacctgctaaatatgtgaatttctttcctaattgctcaaatccatcttttacaacatcttttggatacatagcagcttcaactaccttaggatctgatggtttatttttcaaccatgttggtgtaattgttgatccagcagataataacagtacatctacgttagtatccttgcattcatatgcaaccccttctgttagtgtcatcatataagctttatgtgctgcatactctgcacaaaatggcaatgaagtccacccagataaagaaccaattgttataaatgcacctctatttctatttttaaattcacctatataatgatgcaataattttgagaaggttcttatattaattctgtacatctgctcatatttagaataattaacattgttatactggcccattgcatggagacatgcaacatattctattaatcccatatctaaatctttgattgattctattattttttcagctgcatcatattcagataaatcttgaggtaatacccttacttcaattccatgtttatcatgtatatcttttgctaacgcctctaatgcatcctttcttcttcccactaaaattacatccatacctctattagctaattcataagcactagctttaccaattccatctgttgcccctaaaacaattccccactgaccatatttttctctaaaattcatataaaattcctccttaaaattaccatattaaatctatcaattatatatatatctatcagtttgtttttttagtcacttttattcttaaataaaaatgaaattgttctaaattattattttcttggtaataaaaaaaactagaatatacagacagttatatctctgtacattctagttttaatgctattatttatatattaaaataatctttcactactttaatgatattttaaattcttctcctgcttgtttaaagtcattactcatctttccactctgctctggaaatttaactgaatatggtgttaatgtaagttcttttgcattttcatctaaatttctatctaaattatcatatctaagtaccatagactcctttgatcctctctttaaataaaattctactttattgcccaaatcatctgtacctttcagcattacatcataatgttcatttttattataattttcaatactacagataacgttttgtcctaaagcatttgatgtatacttttctaatattaccttctctccattttcaagaacaaatgaattatttagagttatctccttagtgtctatttttaacgcatcaccatttgttttaaattgaaatacccatttcccttttttaggatttttatgattaaccataacctttgaatattcaatttttatatttaagtctccacttaaatccatatcttttaatgaacttaaattatattcatatactgactgttctgaataatcatctattctcttacttctaccactctcagaaataaattttactcttttattattgatgtaaattgttttatttgtattatacaaatcattttcttttagcatattttgagaacttatcgtttctgaaattacaagctgattttgagactgatctaatatgatctcattaagctgaatagttataccattatcagtaatacttttattcataactgtattataactttctaaatctttgtgaattccaattgattctgaaatactttcactcatctttgccattatttcagctccagcatcagttccaaacaatcctatacttccaactacaattactaccgctactgccacagctataccttttctattttttctctgtggctttatagattttctaaatttactttttaactttttcttttcgaaatcattgaactcttctcttttatagttatctatatctatattcatatcatttaacatttcatatatattcttgtccatacggctaacacctctcgctttcttttaatttaaaaatatccctcagcttctttttggctcttgaaactctgttataaatcacatctcttttaatacccgtttcctgactgactttatccacttcaatctcttccacatacaatttataaaataattctctatctctttcatttagtgaattcatcatttcctgcatttctaaactcaattcattttttaaaagttcatgagttgaatcatctactgttatgtttaaatcatctaccttctcattatctaactctctcagatattttcttttataatctattgctttaaatttagctattccagctatccagttcttaaattcacttttgttttcatcaaatttatcaatattattccaaagtcctaacaatacatcatttatgcattcatcttgaacactctgtaaattgtacaaatgtttttttataacagatttaataatccatccataggtatctataacataatctaatgctttttcgtttttcttttttaattgatcaagaaaattttcttcatttattttcatttttacccctctttctagtaagccctgcatagttaactatcccttacacttaatacttcgtaatatgagatgcaatatctatcaaaccaaataattttttaaaattatttcaattttatcagattatcaaagttaaattctttactagaagatataatttaaatatttttacactaaaaaagtgcaacatttttttgtaatatgctgcacttttctcattattaatagtatctataacctattctaaaaaattattaatttttattactgccctataacttgaaatttcttttataatattggtacacaaatttcgcactgatgcttatttatcatttgcattgcatagcgctcaacaataggtcttctatcatcaaattcatattttctttttgataactcagaaaatatctccatccatgcattttgtacagcatcaacagtatgacctattataaatacacaatatcttccaccaatagtttttccaaaattaaacctcattacgaaaattgaaatagtctatttcatcttgaagcatcaaaaacacctttgaaataagatatccatcagctgctgcatgattcattcttacactaacaggcattattaatcttccattttcattcttgaaccttccccaatttattattggcataaagtagagatatccatctggaagctcaatatttaaagaatcataggaaagccatgaaatatatgatgcatcaaaccaattgggatactttgctgaatcaataacatattctcttgtttcctttcctctttttatatcatcttcacaagccttataaaaaactttataatcactaaaatattctgtgtaaactggtatacatgtttctgtatcttcatgaaaaacatactgtgttggattaatcttattatatactataagttcattggtattgtataaataagacattctataatcttctcttgagtttaatacctttgaaagtatatatagaaaatttatatagaactttgttcctgattttttagaaacttcaacaagtcttgtaacatcaattttattagtaattgatactgaacatttacagtcctgtgaaaaatgattaaatactccttttctataatacttctccatatctataactttataattcatgtttttatctccccatttattgtgtattaataagataaatgctatttttactacaagcatatatcttatattaatattctaaggctaaaacatttgaaattatatgccataaatttttataatcaaaaattacaatgccatctgtaatgaaactattacagatggcattatctaatttgaatatataattttctttatagtttcaacagaaaggtaatatttttttgaaagttcatctaatgaatatccatttctgtataaatttctaatttcattatttctctgtctgcatttaattttagcaccagtcttttctccccatctagtgcgttttcccgatttattgggaatatatattatattaccttctacatatttttgtatttcagaaataagctctttaggaagtatttccatagcatttacatatttcataataaaaccccattcctcaattaatattaaggatataaagcctgcttatttactgaataaaattgatgataataatttttctccatataaagcatcatcaactactcaacagactttatatggagatcttccacagctattactctcacatttctccctcatttctataaattaattcatagaataattatatcatatatccatacttgtaaatttttatcaacgccatagctacttaattaataataatgcaaaaatattatataaatctattaagcccctatacacataacatatatataggggccttctataattggcggagagaaggggatttgaacccctgataaagttgcctctatacacgctttccaggcgtgctccttcgaccactcggacatctctccattaaatgtttataccaaattattttatcataaatgcctattaatcacaataattatagtatctaacaccataagacagaatatatttcttctaaaaatttatttatatctattactcctattctcttcaaaaaatttaacaagaagttcagagcactctttatcatacagccatttaacatctacaaaagaatttaatcttctactatctaataaacttataacagatccacacgctcccatatctttattaaaagttcctatataaacttttgaaattctactttgaactatagcacttgcacacataggacatggttctaaagttacatacatttctgctccatcaagtctccagtctccaatcttatttgaagcctcctttattgctaaaatttctgcatgtgctgttacatcattcaaagtttctttcaaattatgtccccgacctattattaccccatcttttactattatagctcctactggaatttctcctttatcataggctttaattgcttctgcttttgcttcatctataaaattcatttataatttcacatcctttctaggcagatatcaatgttatttatgttaaaaaaactgctgaaataattcagcagtttttttaaattagtcttctaattcattgttttcagaatcatctacttcataaataaacattcttactttcttaactctatttttctctatttcttcagcaacaagctttagattgtgaattaaaacttcttcattttcttcaggcattcttcctagttctccaatcattaaacctccgattgaatcaaactcttctgaatctacatctactccaattaattcacttatatcatgaagccttacacttccatcaaagacatattcattttcttttataacttcaactgatttatcatagtcatcatattcatcttcaatatcaccaactatttcttctattaaatcctctattgttattattccaacagtaccaccatattcatctaaaaccacagcaatatgatttctacttttcttcatttctttaaataattctactatttttttaaattcaaatgtataaaatggttctcttatatattttttaacattaaaatcctcacgtggattttcaaccatagctaaatctttaacatttaaaaatccaataatattgtcaatagtttgattatataccggtattcttgaaaactgctcacttttaataacactcatgacttcatcataagttgcttcttcatcaattgaaataatatcaactctttgaaccataacgtcctttacctgctggtcagcaaagtcaaaaacattgaatatcatttccttttcaacgttttctaaaactccttcttcttcacttacaccaaccatagtctttagttcttcttctgttataaatgattcagcctcattaggatcacatccaacaaggcgtataaaaagagaagatattgctgtaaaaatatatataaatggtttaaatataactactgcaaactcgataaaccttgcaacctttagtgcaactgcttcagctttttgctttgcaattgatttaggtgtaacctcaccaaagataagtactaaaattgtcattacaccagttgctattccaactccgctacttccaaaaatatttgtagctaaaattgttgcaagagatgacgctcctatattaacaatattatttcctattaatatagcacctaaaagtttattagggtcctcagtaagtttttcaactctttttgctccaggcactccttcttcaaccatatgtctcaatctaattttgcttaatgacatcaatgctgtttctgacattgaaaaaaagctagataatgctattagtataattagtatgattatctgccacgtataactagggtccaaatacaatcactctcctaaataatttaatttaatattactttaaattataccatattatgattaaaagtaatataaaccctttcattttatgatgctctaaactctattttaaaattcatattttttgatttaatcgaataaatatttgatattaaaaaaagctcccatagaataatctatgagagcttttctgaatgtctaatttatatattaataataggtaataacttttttatttctttttgttatctttttttgatttgttgtcagctacagccttaacatcataagcgtttaagtacatttcttttaattcgctcattaatgggtatcttgggttagcacctgtacattgatcatcaaatgcttgctcaaccattgaatctaagtctgctctgaatttatcttcttcaacaccagcttctttaatagtcattggcatatttaattttctttgtaattcttcgattgctttaactaataattcaaccttttcagcatcagtgtttccacctaatcctaagtaatctgcaaccttagcatatctacatgctgcatttggatatttgtattgagcaaatgctgcttgcttagttggagcatcacatgagttgaacttaataacttcattgattaataatgagttagccataccatgtggtaagtgatggaatgcacctaatttatgagccattgagtgacaaattcctaagaatgcattagagaatgccataccagccatacatgatgcatgagccattttttctctagctttaacgttagttgttccttcactatatgcatctggtaagtatttgaatactaatctgattgcttctaaagctaatccattagtgtattcagatgccattattgaaacataagcttctaatgcgtgaactaatacgtcaacaccagcacaagctgttaatcccttaggagaagtcatcattaattcagcatcaacgatagccatatctggagttaattcataatcagctaatggatattttactcctgtttgttcgtcagttataactgcgaatggtgttacttctgatccagtaccagctgatgtagctatagcaaccatcatagctttttgacccattgttgggaatttgtagattctctttctgatatccatgaatgtcattgctaaatcttcgaattcaacttctggatgttcgtacataacccacataatcttagcagcatccatagctgatccaccaccaagtgagattacaacatctgggttgaagcttaacatttcttctgctccagctctagcacatcttaaagttgggtctggttcaacatcacagaatactttaaattggattccgtttctttctaatacttctgtaaccttgttagtgtatcctaagtcaaataataccttatctgttacgataaatgctttctttttgcccatatcttttaattcatcaagagcgattggtaaacaaccgtatttgaagtaagtcttttctggaactctaaaccaaagcatgttttctctccttctagctacagttttaacattaattaaatgttttggaccaacgttttctgaaactgagtttccaccccatgatccacatccaagagttaaagatggtgctaacttaaagttaaataagtcaccgatagctccttgagatgctggcatgtttattaatgttctagctgttttcattttttcaccgaatgcagctattctgtctttagattttatttcgtcagtgtaaagtattgaagtatgacccataccacctaatactattaatctatcagctttttctaaagcttcttcgaaattcttaactttataaagagctaatactggagataatttttcgtgtgagaatggttcttctaattctactgaagtaacttctccaactaaaaccttagcagtttctggaactgtaactcctgccattttagctatcttataagcagattgaccaaccatgtcagcatttaatccgcctttttcgtttaagattatctttcttactttatctatttcttcgcctttaaggatataagctcctcttgcagctaattcttttttaacttcatcgtaaacttgttctaaaacaactaatgattgttctgatgcacagattacaccattatcaaatgttttagataataatactgagtttacagccatttttatatgagctgtttcatcgattattgctggagtatttcctgctccaactcctaaagctggtcttcctgatgagtaagcagctttaaccattgctggaccacctgttgctaatattatgtctgattcagccataacattttgtgataattcaactgatggttgatctatccatccgattattccttctggagctcctgctttaactgctgcatctaaaacaactcttgctgcttcgattgtagcgttcttagctcttggatgtggagagatgattattgcatttctagtctttaatgctattaaagtcttgaatattgcagttgaagttgggttagttgttggaacgatagcagcaataactcctattggttctgcaactttagtaactccataagtatgatcttcttctaaaacaccacaagttttcatatccttgtattgattgtatatgtattctgctgcgaagtggtttttaacaaccttatcttcaacgatacccataccagtttcttctactgccattttagctaatcttattctttcattattagctgcgatagctgctgctctaaagattttatctacttgttcttgagtgaatgttgcaaattctttttgagctcttcttagttcagtgattctttgtgttaattcttgagcgtttgtaactttcattcctgttcctccaaatcaatttatcttaaattttgttgatttcaattacctattttattattcccataaaattatgttaaatgcttgttatttttttaacacatcttacaagcttattttagtgtattgtttattttttgtcaaactttttttaatgattttttagttaaattgaattattctccatatttatttttacaaaaaacctgttaacctcagcctttatcactctatttctaaatttaaaatattttctgaaaattaaatattttgttcaactttgttattttttattcatccacatttttacttttatgtatttttaattataattgttatttttttatcaatttattcaaataaattttatttattacttagattacgatttcaatcaaataatttacaatttatatagtttaaaagttctctatccactcaaattcctttctatatttagtcctatacagaaaaataaaaagcagttcaattacattaaactactttttatgtattaattttttataattaattcttattaaaaattctctgcaataacttcagcaattgcttccgctacaagttgttgactgtttgaatcagcacatctctcagcttctttctcattacttaagaatcctgtttcaactaataccgcaggcatatttgtatttcttaaaacaaataaacttcccgatgctgattgttcatcagatttaacacctctatctgctgcatttaactttttaattatattatcattgattaattttgcaagctttttagattttgccactctttcagcatctactccacttccatagttatcatctttagctgcaacactgtagtatgattctattccatttgcttctggaattccatctactgcattatgatgaatacttataaaaaattctgcatcagcttcgttagccacatctactctgtgagataaactgtcattaagatctgtaaatttctgattttcagttctagtcaaaattacagtaaagcctcttttttcaagttctacctttaactttttagcaacctgcatgtttaaatcagtttcaatataatttatgtcatttattgttgttttaaccccttcatcttttccataagcatgtcccggatctacaactataactttaccttctgtttttgtattatcatccgtagaacctaatactgcttttctctttccatcagaaccaatctcatatccatctacagtatcatttataatcatttttccacttgatttatctaagtaataatatgacataccattgtcatcactgaaccaaccagttttcatacagccatcattatcaaaaaagtatctataattatttatatttacccatcctgtagccatacttccattttcacttaaataataattttttccttctatacttcttaatccagtaaccatgcttccatcaccttgaagataataccaagaattatttgcaagcttccatcctcttgccatagttcctgattcattcatataataccaagtatcaccatctttaagccatccagttaccatattcccatcactgtttagataataccagtttccatcaggattaatccatccaaagacttttgtattatcatctttataataactccaagaattattttcttttttccatcctatactcgatgttacatttattgaattattaacatttgtatttatagataatatttcagattgtaaactcacaacttcttctttttcaataccagcaaaaactagtaaacttttatataacttatttacttcttctccataagttgcacttggtgcccattttcctgatcctccaagttcatttatggttttacatcttcccattatagttttaaaatgccttggatcataagtatcactctttggatatccctctgcaccagcatataatgctaaatgatccaaatgagcttgtactccttctttccatgaattaaacttttgatgagcatctggatcactatcgtctccacccttttctattttgagcccacatggattgcaataactttcatctaaaacaccaccaaaatttccatatccagtttctttagctgcctgaacatatgctattgcaggatttactcctccacattcttctgcatatttccaatacaaatctgctaaatcaataaatgtttgagtcgcatttctttcttttgcccattcttttgcttgttttacagtaactgcacaatctgatagtatattataatcttttattgtctctgcctgtactttcttaggttgaataaataaaataacggttatcaaacacattagtatagctataaatcttttctttatattcactactattaccttccttaatatatttccttttattcttcatagtttgataatattaaaaagcaagctattattttattcttaataatagcttgttataaatatatataatttaaatgttcttttgggtactacttaaaagttaacatcagttccatagtatgtgcattcaaataatttttccattgtttcttcatcaatctctctaggacttgatcctgtacatgcatctaaaattgcattatgtgctataaacttaacattagatttaaaatcagcttcttcaactccatattctttcattgaatgaggaatacttaaatcatcattgaattcattgattaatttaattaacgaatctgttaattcagcatctgtgtttccttctaattttaatgttcttgcaatatcagcatatctatcttcacatacttttctgttatattttattacatatggtaagaagattgcattagcacatccatgaggaatatggaatacagcacctaccttatgtgccatagagtgaactattccaagtaatgcatttgaaaaggccattccagctaagcactgagcttcatgcattaaatttctagcagttttatctccttcaaatgattttactaaattttcatttaccatttctatagcttttatcgctaatggatcactaaagtttgatcttaatgatgctgtatatgcttcaattgcatgagttaatgcatccattcctgtgtgagccactaatttagcaggcattgtttgagctaattctggatctactatagctatatctggtgttatattaaagtccgctaaaggatacttaattttttctgtataatttgtaattactgaaaatgctgtaacttctgtagcagtaccacttgtagatggaatagctacaaatttagccttttgtctaagttctggtaaaccaaaaggaacaactgcttgttcaaaagtaaaatctgggtattcatagaatatccacatagcctttgcagcatctattggtgatcctccacccatagctactatccagtcaggctggaattttctcatagcttctgcacccttcataacagtttcaactgatggatctggttctacaccttcaaataattcaacttccattccagcttcttttaagtaatcttcaactttttgaagaaaaccaaatcttttcattgatcctccaccaactacaacaaaagctttctttccttttaaagtcttaagtacttctaatgaaccttctccatgataaatatctcttggtaaagtaaaacgtgccataaattgtcctcctaatttttatttatatataaaatagacaatataattatatcatatatttttaaaattaaatccatttttagaaataatatgtaattgatgttttgcaatatttttatcctttaatcaacaaaaaggagaattcatgattgaattctcccttttattgaatataaatatatatttatatcaaatagtttgtgtatgttttattttatgataaattaattatgagcattatttaaaattttattatttaagatattcatcaatagcagcagcagcttttttaccagctcccattgctaaaataactgttgctgcaccagtaactgcatcaccaccagcataaacgccttcttttgtagttaatccattttcatctgcaactaagcatttccatttgttaatatctaaaccttctgtagttgaagatattaatggatttggtgaagttccaagagacataattactgtatcaacatccattacaaattcagaatcttctttaacaacaggtcttcttcttcctgaagcatctggttcaccaagttccatcttaacgcacttcatacctttaacccatccattttcatctgttaagatttctgttggattagttaatacatcaaaaattattccttcttctttagcatgatgtatttcttcagctcttgcaggaagttctgcatcacttcttctataaacaatgtgagtttctgcacctaatcttaaagcagttcttgcagcatccatagcaacattaccgcctccaactactgcaacttttcttccagctcttactggagtttcatattcttccttgaaagctttcattaagtttactcttgttaagaattcatttgcagagaatacaccatttgcattttctccattgattcccatgaatttaggaagtcctgcacctgatcctataaatacagcatcaaacttttcctctttcattaattcatcaatagttattgttcttccgataactacatttgtttcaatcttaactccaagctttttaatattttcaatttcagctttaactacatcttcttttggtaatctaaattcaggaataccataaactaaaactccgccagcttcatgtaaagcttcaaatattgttacatcatatccttttttagctaaatctccagcacaagttaatccagcaggtccactacctataactgcaactctcttaccatttggagcttcaacatctgataagtctatcttattttttcttgaccagtcagcagtaaatttttctaattttccaattgctactgcttcacctttaattccaagtacacatttaccttcacattgactttcttgaggacaaactcttccacatacagctggtaatgcactatatttagcaatttccttagcagcagcttcaaaatctccttctttagcttttgctataaatcctggtatattaaccgacacaggacaaccttctacacatttagggtttttacatcctaaacatctattagcttcttttattgcttgttcttctgtatatcctaagcatacttcttcaaagttcttagctctaacttctggagcctgttctgttacaggtgttcttttcattctatcttgcatattcattatttatcacctctgcatccacaaccaccatggctatgagtgttcccttcttctaattttaaagttgctctgccttcttctgatttatacattgcttgtcttctcatagattcatcaaaatcaattaaatgaccatcaaattctggaccatctacacatgcaaatttaatttcatttcctacagtaactctacatgcaccacacatacctgtaccatcaaccattataggatttaaactaacagttgtttttattcctaattcttttgtaagcatagccataaatttcatcattatcattggtccaattacaactgcatgatcatatttattaccgtcatcaactaatttttgaagacaatctgtaactcttccattgaacccatatgaaccatcatctgtagcaatataaaggtttcctgctacttttttcatttcttcttctaatattaataattctttatttctacttccaactataacatcacatgctattccatgttcatgcatccattttacttgaggatatactggtgctgcaccaactccaccagcaacaaatattatattttgtttctttaattcttcaatatcttcatttacaaattcacttggaacacctaatggtccaacaaaatcagctacgaattcgccttctttaaattctgctaattgtttagtacctgcgccaacagtttggaaaactattgttacagttcctttttccttgtcataatcagctattgttaaaggaattctttcacctttttcatcattttttattattataaattgacctggttttgctgattttgcaactctaggtgcttctatatccattaaatatatgttatttgtaagttctcttttactaactattttaaacactcgtatttcctcctatttatatatactaacacgtaattactttgttttaccgactttaatacttcacataaggtactctaaaaggtcccataatatcaaaaatgaagtctctttcttttaataattctaatttttttatattatcttttattctttgcaaaactacagttataattttcctttccttattgtaatctattatttccaaggaaatatcattatcttcattattatttttcacaataataaacagccctatctttgcagttttaacaatatccggtgcttctatatcaattaaatatacttcatccataagttttttctttccgaaaattttatatgacatacgccccacctcagcaccataatatagtactttttctttttattgtatatattatttacattgacaaaagctcccttagacagagagcatttgctttactaatatattttgaaattatatattaaagatttacttcagttccatagtatgtgcattcaaataacttagccattgttgcatcatctatttctcttgggttagatcctgtacatgcatctaatactgcattatgagctataaattcaagattagctttaaattcagcttcttcaattccatattctttcattgaatgaggtatgcttaatttatcattgaattcattgattaatttaattaatgaatctgttaattcagcatctgtgtttccttctaattttaacgctcttgcgatatcagcatatctatcttcacaagattttctattatattgtattacatatggtaagaagattgcattagcacatccatgaggaatgtggaatacagctcctactttatgagccatagagtgaactattccaagtaatgcatttgagaatgacattccagctaagcattgtgcttcgtgcattaaatctctagctactttatctccttcatatgatttcactaagttttcatttaccatttctatagcttttattgctaatggatcactaaagtttgatcttaatgacgctgtatatgcttcaattgcatgagttaatgcatccattccagtatgagctactaatttagcaggcatagtttgagctaacgctggatctactatagcaacatctggagttaagttgaaatcagctaaaggatacttaatcttttctgtgtaatttgtaattactgagaatgctgtaacttctgtagcagtaccacttgtagatggaatagctacaaatttagccttttgtctaaggtctggtaatccgaaaggaacaacagcttgttcaaaagtaaagtctgggtattcatagaatatccacatagcttttgcagcatctattggtgatcctccacccatagctactatccagtcaggttcaaagtttctcatagcttctgcacccttcataactgtttcaactgatggatctggttctaccccttcaaataattcaacttccattccagcttcttttaagtaatcttcaactttttgaagaaaaccaaatcttttcattgatcctccaccaactacaacgaaagctttctttccttttaaagtcttaagtgcttctaatgcaccttctccatgatataagtctcttggtaaagtaaaacgtgccataaattgtcctcctaaatatatctgtggttttatttttcttttcacagaatatatatagcaaaacccgtgccaacttgttatttttttgtcaagcaagtgtttttaagggtttgtgatttcaagtttctataataaacaaaaaactgtcctaaatcaagacatttcttttcgtttttatgtcttattttaggacagtgtactattttaggacgtttttattccatatttctttatttttagatataatgtgttcctactaatacctaattcttttgcagttttagtcatattatttccaaatttcaagattgctttttcaatagttttcctttcaaggaaatttaaattcaaattattgttttcattttcacaaagttgattattattctcatttacattacacttatatatattctcattgttaaaatcttttttaggttcttcatcccataaattaaaggaaatattcccttctaaattaacaatattctcaatataattctctaactgccttatgttcccaggccaactatatgataataaattagaatatagttcatcatttattttaggtattggcttatttaatttaaatgattttattgtcaaaaaatattccattaatttttgcacatcatcttttctctctcttagaggaggtagtgttattggaattacacataatctataatataaatcttctctaaaatttcctttgtttacttcttcttttaaatttttatttgttgctgcaataactctaacatctattggaatttccgtacttccaccaagtcttgttactcttgattcctgaagaactcttaaaagattaacctgcatatctagtggcatttctcctatttcatcaagaaatatagttccaccattagcaacttcaaacttccctggctttccacccttttttgctccagtaaatgtcccatcttcatagccaaaaagttcactttctattatgttattaggtatagctccacaatttatagctacaaattttttatttcttcttaaactataattatgcattgcttgcgctagaacctctttccccgtaccactttctccttgtataagtacagttgaaggactattagctattattttactattagtaacaacattttttattgcagcactttcccctataatatcgttaaaggttaaaaatgcacctgtagcagatttaatatcataattttctttcatattactcatagtaattaccatacctattacctgatctttatgtgttatacccttaaatacaagttctgtcttatagttacttgaatgactaatctttacctctttaatgattgtactattatcattatttaattcatctaaaatattgcctagattaggaacaatatgatatatatcttcttttattaaaaattccttttctttctggaatatatccaccccaaacttatttatgttagttattttcccttgcttgtctacaatcattatccctttttcaacattgtctattatactttccatataattatatgtttgatttaagatatcattaattttatttttatcaatctcattttcaattgctttcacaccaaaaactactaaacctaatgtatgtggatgtttcatgctactttttcctgttaagtttaaagttcctataatatctccattctcattgtgaattggagctgctgaacatgttaaactatgaagaccttctatataatgctcctgagcagttatctgtacacatctattttctttaattgcagttcccattgcatttgtaccaatactccgctcatccatgtaagctcctacttttaaatccatacaatttagggatttagttattttttcagctcctctaatataaagaatgcaaccttcattatcagttagtactataataaactcttcatcttcaacagcagaaaaaaccatatcaatatatatccttgatatttctattaattccttatttctagcaaggattctttctaattcttcaccatataatatttttcgtgaacatttagatttcttttcaacaccatatactctgcttctttcatgtgagttttggattaatatttgcatattttccattttaatattccaccttttatcttaagtttcatttatagaatatatttagtactctgtattattttacaaaataactataatcattatatcatattgaacacttatataagtgtaaatgctatgattttaaatttgaaagtccactattgcagcatactaaaataccataaaaaaatagaatctacctatttaatatttcttataggcagattctattactattatatttatattaaattgcgttaacttcagctaaagttggcattgaagctatagcaccataattagtgcaagttattgcccctactttattagcaaaagctattatttctttccatttatccatgctgatgttctttttatcctcaatatcagatacttgctttaatacagcaccaacaaatgaatctcctgctccagttgaatcaacttgatttatctttattgaaggtattattacattttcaccatcaacacttaggtaagttcccttagatcctaaagttatagttacaactttaacccctaagtcatgtaaagccttaacacctgcttctaaatctttttcaccagtaattaatgttaattcttcatcacttagtttagtaaaatcactatgttttaaaaatactttactgtcttcaacaaattgtggtagcatatcaggttttattaatgcatctctgtagttaggatcaaaagatacatataaattactttgttttgcataatccaataacttaaaataagtcttctttaattcaccttctaagaatcctgtagccgatccaaagtgaattatatctgttgaagttatttttgatgtatcaacattatcaaaagaatattctccatcgcttcctcttaagaaatcaaagttacgttctccatcagcatcaattcctaccaatgccattgtagtgcttcctttttctactgtcatttcagtatttatgtttaaatcttttaagatttgaactaaaaatttaccgaaaaaatcatctccaacttgacctaaaaatgcagcattaccttctaatttagttatggctgcagcaacatttgcaggagctcctcctgcttttttttcaaatttttctccatcctttaaacctttattatcaacacataccatgtcgattaatagttcaccaatacaaaatacatttttattcatatttaatcccccttagattccaaatatttaattcactcattttaactttattatcactttttatatctattttaaaatcatcaaacttagggaaatacattaatgtagttgtctctaatccctcttgataatatatttccataacagaattgtcaataaacatatgtaattttaatgttttatcaacattcagcttaaatttccttattccttttccaccaagtttcatattatttctatcaataatacaaactccattttctttattataagttaagtttatatattcatctctgaatacaaatttaaaatctataaaagtagattcttctaataacaactctaaatctatttctatatttctagaatctaaatctagtgagtattcatttatatttaaatctttaactgatacaatctgcttttctcttaaattttcaacttctttaagtggcttttgatataaaacattatctttgtattcaagaactctaggtaacgttaatgggaacatccatcctccattttctccactaggatattcactatctttatctggcattccaacccagccaatcattatattcttatcattatgagtaaatacctgcggtgcataaaaatcaaatcccatatctatttctttaaattccgaatgattttttaattgtggtaccttaaaatctaaatttcctataacatatcctgattgatatatattttgatttttaaattcttctgcttctaacccttgtggtgaaaataaaaatgcatatttatcatcattaacctttataatattaggacattcccacatatatccgaattctttcatgttagtttctaattcaccaacaagttcccatttttcaatatcatcagatttgtatattaaagcagctccagttaagttttctctttgtactccaagaaccatataatatataccttcatttacaaatatcattggatctctaaaatgtgctgtatatccatcaggttgcttaggtattataggtcctcttttttcaaatgatccatctttattatagtcaactatacattgataagattctctttcatctttttcatttttaacattccctgtatagaataattttaatatatcatcctttacatatgcgccacctgaatagcatccatttttatcaaaccagtcttcaggctttaaaattatttcaggtttagtaaaattcacaaaatcagtagttttaactaatgcccaatgcttagttttgtgttcacatccaaatggattccattgatagaaaatatgatactttccattaaagtaacttaatccattaggatcattaactaagccaaacggcatttctatatgatttttatttctccatatattattgtcattattgctataaaaattatttaaatcttgttttactttttcatatatattcgtcataactacctcttttcttaaaactttaagtctttataattaaatcttcgacactttctctttcaattagttttaatggtatatcatttttttcatctagttctttaccttcaatcaaatctaaaattccttgagcagttttttctccagtaagctcataattaaaagctactgttgttagtgctggatatgcaacactacttatttcatatcctccaaatcctgctactgaaacttcttctggcacctttatattgttttcgtgtaagtatctaagtatcccaagacatatattatctgttgcgcaagctattgctgtaggactatactttaaaatttcaggtgtcattttataagattttttaaaagcaaatccagtttcaacaaaatttacactactattttcattttcatctgtaaaagcatctataaatccttgtttacgttcaataccaacagcctcatcactttcagtaactccagcaaacacaacacttttatgacctttttctttgaaatattttcctagtacggttcctgcttcataatcattaatcttaattgaatccacatattcactcttttgcccagtaaatatgataggaactgataatttacttactaatttaatatgctcttttgtaattgatattgagttaactattattccatcaactccttgttgcgctaagctcttaatattagataactctttttcaatacttaaatcacttattaaaataattccctgataattgttttcttctaatcttctattaattccagtaagcaattcacctacagtaacggaattaattcttggaataacaattccaattaatttgcttctctttgtttttaaccttttagcaaaaaaatttgtttcaaaaccagttttttcgatagcttcttttattttttttgcattttcttcacttacataaccattatttaaatatctagatacactgcttttagatacattaaccatattagcaatgtcttgaattgtaactttctgcttcatttcaacctccatataagacttactcactataattatatagtcttattaaaacaataaacaatgcacaattcaaaattcctaataaaattctactgtttaaaattcatataaattcaatacatacccattagttgaaatctgataattataataccttcatctctaattaaaatttattagaaatatcaaacatattatctgcattgctataaatttagataatatattgtctgaataatttggtattattacaaaatatactgatatgaataatcttatcaatatactttgtaataataatcttaaaagatcattattcttttctataacacgatagatttagtagaaatatatatatttctactaaatctattattgcttttatattaaactatcttttattcttcagttttaaagaagaaataagttaaacagaatgccacagccatagctactccatttattaaaagatatccacctatattattcatatatagtaatatacctggtatagctgttattcccattcctgtacctgccatatgaagcatacctgcaagcataccacctactgctccacctatacatccatatacgaatggttttataaatcttaagttaataccgaatattgctggttcagtaattcctaaaaacgctggaactgctgatgaaatatataaagaacgtttctttttgtcttttgtttttaatgctactgcaactgcagctgcaccttgagcaactattccacaagttatcattgcattaaaaggatttaatcctgtagttgatataagttcaacttctaaagcacttaaagcatggtgaacaccagtaacaactataacttgatgtaaaccaccaacgattgctccacctattccaaatggaagtaacataaatgatctgatagcaccaaaaactatttgttctgcactatgcattattggtccaacaattaataatcctaatatcatagaaattaataatgttataaatggtgttacaattaaatctaatacatctggtattacttttttaagagccttttgtatcttagctgcaagtattccaagtactaatgctggtaatactgaaccttgatatcctacaacaggaattgttaatccaagtaatgaaagatatataggctctgctgttccaccagcaactgcataagcatttggaagactaggtgatacaagcattaatcctattacgatacctataactggtgttccaccaaacttcttcattgttgaccatgcaactaatgctggtaaaaatgcaaaggctgtatctgttaacacttcagtgaataagtaaaaattagttcctgtttgtaacaatcctaggtttgttaacaagcctcttaatcccataaataatcctgttgctaccaatacaggtattataggaacgaatacatctccaaaagttcttgaaatcttttgtaataatgacatatttgcatatgcatcttccttggtactactatttgctaaatcttctgatccaccaactatttctgcatatactttattaacaaatcctgtccctaaaataatttgatattgagctgccgcaaagaactgtccctttactccgtcaatattttctattgctttttcatctattctgtctttatcatttacgataattcttaatctagtcgcacagtgttcaattgatttgatgttttctttcccaccaatatgttctaaaatctgttttgctactacttgttctttcatacatatatcctcccacattttttaaaaatcgttttcatgagtatatgataccaattccacatatgcaatgtcaatggttttcaaaaaaaatttttgttagttttttaacatatttagcttttattttaatgtttttttattattttctaatatttcatatttaatacccattattttttccaataaagataaattttatgattatttttaataaactcaattaaaaaaatgctatcttttgatatccattacacaagtgaagtatgatatcagttccacaaaaaaagtgttttgtacatattcctttctcatttagttattatcaaaaaattaatatttattctctaaaaaaaatagttttttgattaataaatcaaaaaactatttttttatcttatttgcatttttcctctatatacaattttcactatcttctcaagctcttcatttaatgcaagctggacttttttcctatctttaaattcaaaggtatatatttttaatccctttatatttttattgaaaagagcatctttactaattgcattatttgaagattcatatacaaattcaacatcctcagaatttatcttcttaacaacttttcttctacttccagcatatattttgcttacatctatatttccattgaataattcatactcatagtctatgaatgaaaaatatgtaactaaaaaaaatataactgcagctatttgcatcagcagtgctattagtggcgagattaaaaaaaacattaatactccaaatactagtactgctataacagcagtcttaatagtttttaatgtgttcctactcttatcacatgctataaattgttctaaaaatacctccataacgctaacatcccctttaagtataaaatttactgtaattaaactttattttttatttatacgatttcattataccttatatttagctatctttcatatacttattactttgttaacataatatttatatatactcacaaatcttctagtaattttatatgaagatcaactatccttattcgaataaaattttaataattatataatatctgtgatataatatacatatattggtaattattataggagggttaaattcaaatgggaattaatgagataataaaagtgggtaataatataaaaaaaattcgtaaggagaagaatatatctcaaaaagatatggcaaaaaaattaaatatgccttcttctacttattccaattatgaaaataataatagagaaccaaatgcattaactctaaaaaaaatagctgatgtactgtctgtagacgttcacgacttattgaatgtgcaatcttctaataacaatgtgagagaaaaatatttatcagatgacagcactacgattaacgtaattgaaaacttaataaaactctgtgaatttacaataaacttcaacaagcttccaattgatgatgcagagttacagtcttcattaaaacttgcaatagaaaataatacaattcctttaacatatataagtaatggatatggagatctcgatttaactaatgaagaatttagggagtttacagataaaatattgcgttttgttaaatttgaagtaaatgagcttatttcaaataaatcttcttaatatcataatttagttcaaaatataaatcaaagtgaaaggcaaactatttatgagctcaaaacaaaaaagcatctatgtttaaatttagaaattaatttaaacatagatgcttttttataatttaaattcttaattctctttttcaccaataactttatatatatattctaagtcaagtgattctctaagtgaatttgctaatatatcatattggctttccttatattctttcatattgaaagtctttatattttccgaacttaatccctttaattccagaagtgtttctataatttctttagatactgtttctttatcaaaaattccatgaatatatgttccataaacattaccctcgttaacaatattcttattattagttgtatcacccatatgtatttcatatccttcaaatactacatccgaaaggctactgaatactccacttactttttcaagttttccttcaactcgaactcgtgtcttttctttttcgaatatagtttcacaagaaagtaatccaagaccagatatttctccaccatactctacattgtggggatcttttaaggtaagtccaagcatctgatatcctccacatattccaaagagtggcttattcttagatacatgcttcattatagacgcttctaatccacattctctaagccaaattaaatctgatattgtatttttagtacctggaagtattattaaatctggattttttaattcttttaccgaaccaacatatcttacagaaactccatcaatatattctaaagcattaaaatcagtgaaattagatattctagggagtcttattactgcaatatctattagggcaatctcttctcttacattaaatctttcagttaagctatcttcatcatctacatcaatattcaaatatggaacaacacctgtaactggtacgtttattgcatcttcaagcatcttcaaaccaggatcaagtatagatttatcccctctaaatttattaataatagtacccttaaccatgttcttctcatcttcttttaaaaatagcatagttcctgcaagggaagcaaaaacaccacctctatctatatctccaacaataaatactggagcttgtgctaactttgccatccccatatttacaatatcatcgtcattaagatttatttcagcaggacttcccgctccttcaattacgataatgtcattttcttctgccaattcattaaaagccttcattatatcgggtataagttttttcttttgtgcaaaataatcctttgcactcatatctcctacaacttcaccatttactataacctgagatccagtatcgcttgtaggctttaacaatattggattcatacgtacgtcaggttctattcctgctgcttcagcctgcatcacctgcgctctccccatttcaaatccatctttagttataaacgaatttaatgccatattctgcgatttaaacggtgctaccttgtacccatcctgcttaaaaatcctgcacaatcctgcaacaataagacttttgccggcatttgaagcagttccctgtatcattattgtctttgccacaatctttcctccattatctaaaagattaataaataattctattttaatatgttcttatatagattctaaaacattaactcttttattattttttatccacaaagccttatctatttctattaaatatccacagcaattatccacttgccaacaataaaattctttattaggatgcgaatacttatctaatatggacattattgttccaccatggacaattattgctgcattattaattttattatctataatattctttattaccttatcaaagcctcttatactacgccttttaaaagcttcagtattttctccattgggaaaaggcattgacccattgctatcaatccatttttgataatcctcatttccgtctaggtctttgtaatttttattttcaaaatcaccaaaatcacattctcttaaatcatcaaatattaatggttcacaataattgtatattatctttgaagtttcaacacacctctttaaaggactagaataaacctgttcagcctttggaaattctttatttttagcaatgataattccctcattacaaagattttcatctgtctttcctatatatcttccatgaagattcccttcagttttagaatgtcttattaaagctattttaatcattttcttcacctttaattatagttcctataccgcatattaccctatgcacctctttagattcttttgctatttcacagcatattctccctgtcaattcgcgatatcttctttcaaatttatctattggaactataccatagcctatttcattagatataataacggcttttctattttcttttatcattttttttatcttttctttaaccttctgttcatcatcatacactactagaagctcttttataagattattaaaattatatataacaggcctattactcattaaaatttcttctgcttttaacccatcaacattcaagcaatctaccacatcttcttttttgaatctacttatattaaacaaatattcaagctttccttgattttctcctccaattataaaaatcacttattccatctcctttccataaaatattcactttacttatgattattcaagaatacttaaaatctattattcttttttgtatatctaatattctacatcctaggttcaataaatcctgtaattaatttcatctactcgtagattattaattgtgaattaatatatattcatatttgaatataatcattttataaaagcataataagcttttctcctaaaataacacttgcaagcataagcaattcacacatttgaagaaaatatcctgctaagtcacccgtaattccagagaatttttttatagacatatgtttataataaataaacattagaaatgcactaataatacatatacttcccaaaacaaaattaataaacaacataattccaatacaaaaagcaatataaatatacatagttatttttacagtatttttttgtgctgcatctgaaaagctggctgcaagtccactagtctttgcacatgggaatgttactattgaaagagcgcttaaggctcgtgacaaaataaatccaacacacaatataagtattgaccttaaaccaatttcactccataaaccaaaatcaactataaagtatacaacacaacttattaaagcaaatgctcctatatgagaatcttttaatatctctaattttctttctacactttgatatgaatttatcgcatccatagtatcaacaaatccatcaaggtgtattccaccagttataagaactggcaaaactgtaagtatagatgcttttaaaagattacccatctgtagtgtattacaaatcaggtatacagtaacaactaataatcctatagctgctccaaccattgggaaaaagcacatagcatatttcatattatccttattccaatcagtttcaggcataggtatttttgaatacattgaaaatgctattttaaaagaaccccacacttttaaatacctcctttatgaaaaattggaatagaataaacaacttcaactacattgtcagctttctttccaatttctttatttatttcacctagatttcttatatatctcattgtgtcatcatcataaacaataccatctgagaatacttcattcgtcactattactaaattttctgcttgattatttattgattctatacctcttattacttcttgtactgtcttatcttttgctccaccttcaagatacatctcatttgctactagatttgacatacaatcaataagaactgttgaattatttgatataaataatgactttaaatttttaaaacattctatggtcttaaaatttttatggtctctcattcttttatgtctttcaactttttttaaagactcattatcatagagaaacatagtagcaatataaattaaattatttgatttataagatactgataagtcttcagcaaactctgacttaccacttccacttcctccagttattaatgttaacattaaattcctccaaactctataaaggtttatattgttctattccaatatcattaaagctgctcattttattatatacagtgcaagccatatctaaaattggaagtaaggctactgcaccactgccttctccaagacacatttcacatgtaataaatggttttaaatcaagagcttcaagaagcatctttccagctggctcttttgatacatgtgaaggaagcatatactcaattgttttatcttcaattttagatgcaacaagagctgcaactgctgatataaatccatcgattactattggaatattatatactgctccgccaataaacactcctgcgagtcctgcaatatcgtatcctccaactttagacaaaacatctataggatcatttaaatcaggatcatttaatcttatagattcttttataacttgaatttttctttcaagacctttcgatgttaatcccgctccttttcctgttacttcttctacaggtgcatttaataatactgatgctattgcactgcttgtagttgtatttccaatgcccatttcaccagttgctataatattgtatccacattccttcatatttccaactaggtttattcctgtttcaatagcctttatcgcattttccctgctcattgcaggtccctttaatatgttatctgtaccatatgctatttttctgtttaaaatatgaaatggaatcatctcttcattcttatttaaagttctatccatatctctataaattccaatatcaactggaaaaacatcaattcctattgatttagccattatacttacggttgccttttcatttgtaaaattttctgttacatttgcagtaatttcttgacctgtttgagtaactccctcttcaactacaccattatctgcacacattataattaaagcttttttattcaagctaactctactacattttgttattccagcaatcttaatcacagcttcttcaagcaatccaagactttttaatggttttgcaatactgtcccatcttctaatagcttcatctatagacctttcatccaagttatttatttcttttatagcctctttaagcttcattgttctccccctgttataaaactatttgtattgaatttactctttatactcaatacaattatatactttaagtcttattatagcttatcattagatacaaatatataatattggtttatacttaaaactcacatactttcaataaataaaatctaccagacttaaaacgcaaaaaatgagccaactctatcagttaactcattcatttaatattttttaaagagaagtaatccatccccatacttcaatttgttttaaggctgggaattctgaatcatctttattttttattagatttgataattttatccactccactttacattttgggatatcaaagcattgacaatctggactattagttgtttttaatatcatttcttctccagttgacaatgatagtttaacacttgtccaataactatcgtgtggataatcagctcttaaaaataaaccaattttatttattaaaacctctcttccaaattcaacggttatttctgcattctcttttttatttatcccccatgattcatatggccatcttccatgtccatctgttacacaaacaccatctattacattgttagcataaaatgctgattcatttctagtttcaacatttgctataacatgcggataaataccaatcgcatttttatgatcagtaggatttaacgccacatttctatattgcattaattcttccttactaggtttttctactgaaaaataatgtctatctccttcaaacgctccatctggataagccaatttagcttcttcagtaaaagggaactcataattcatttcagtatctttaaaataaactaacgatttatcaatacacttatttatcttaatccataaatattctccaggattataagttataatttttaccgatgctccatcacctagagctcccttatatcctaaatatactcgttcctcaccgaatgattctttaattatctctccacttccagaaattaattgaatctttaacattttactagactcctttttaataataattaaagttattttataaaagcttaattctcttattatctttattaaaaacagttaattttccaaaaatgccttgtcctttttcgctatagtaaatcttatcacctttaaaggtatcaaaagcacagtagaatattgaaaattcttcatcactatttaaacttttcacttcaaagccaatcatcttatccttctcagcttgttcagatttaccattttgatgaacatataaaggtttaatcttaacagtatccttctcataaaaagcttctatcttaattcctctgtctataaaagaagaattagatactaacttatcattattacacaattggttatatttagttgagaaaacactcgttaatttaacaaaaggctctccatctaatgaatcgactacaaaattcatgttttctgattcaataactgctttgtcacctgttttaatacatcttgctgttgggtgaatattgtatattgaacgccatttatgctcaccaggataatcaattgctgtaaacacaattacaatattcattttgttttctataaaagaagttcttctgattgtatatagattcttttctaaaacatcatggtcctctttgacattagcccttccagaccatattccttccaacgctatataattgcctttttgattataagaattacctattggatcttgtacttctgcatatgaagaatctccactaattttaaaatcttctctattatcaacatctacagtgttatgcatccattgtttctttaaacctgttcttaatggagaattatataggtaagtaaatctccctggatctcctataatatcatgtttatttaaattaatagtcacacttccaacagtagcatgtccatgagcacttccatgtcttccattaaataatgttattaaatggttatcatctttatatgctagaaatccactatctatttgtttaaagcatccattaatcgaactattttcataacttatatacttgtccttatacatacttccaacaaataatattcctttttcattttcagaattaacttcatttgctaagcccaaacatctatatatgctatatacatatgaaaagtcaacattatcactatcatgtaaagaaagaagatcttcattatgatttttgtaaaattgtgatgcttccactaaaggttttaacttttctctaatattaattggaacatgatgatttgtgtattcagcatgcatcataacatatgtactgcttaatacaacttcatgatgatacatagggctctgttcccattgtattccatcttgataaaattggatgtcaagttgatcttccaataagctccatgaccattttctatgctcttcatctactaattcagggaacaaaatagatgctgaaagtacacctgtgataagtaaaactccccagttacttagtaattgctttggtgtgtacgctttatataaaaattctacatgtatcttcagtgattcttctaacatctctatttcttgttcagttaaatttaaatcacttcctaaatatacaagacttctcatccaattagataatcttataccagtatcaagactacgccacgaatctttattatattcagaaggagttccattatatttaataaatttaaaaagatactccttccatttttctatatattttttattttcagtaaccctataagcaattgctaagtcaaccataaatccattacggtttaacatatatatccattccggatctgaattagcgcttctattccattctacgccatcgaatttataaggaatagaagttgcttccatatccataggatcgttataaattattatgttgttacaaagtaaatcaccttgaaattttgctctttttatttcttttttgcaattctctttaacaaagcttttccaatcatttgataaaaattcattgctatatttattaattagatcaaaagttatcataatttacactcaacctcttcctataatactagatgacaaaacctttattacagtacttttgcttatctcaacagaataactatctttatttttatcttttaaagttccaaaaatcccagagtttaataatactttatcaccaatattaagttcattaagaaactttaaatgcttctcattattttccttaattcccttatacctaataatagtagagataacaatgtaacaaataaatactactactattaaggatataaaaagtatatttttagcatccatcttcattacatcctattagataataaagtcattgtttctttgctatcattaacagaatctaataacattgtttcaagctcttcttcctcaacctcactaaagcaacatttcattgctaagtctacaactaaagcaagattaattcctgaaataatatattgattcattttgcctgattctaatattaatcgagcagctatttgatgtggtgctccaccagttaaatcagcaacaactataaccttatcattattatctaataactcttttattttttgttcgaatccttcatgtgtttcgttcttatctaaatcaaaagcacatatattttcattatttcctactaataaagatactgctgataaaactccacttggaaaattaccatgccctacaattactaatttacacatttaaattcctcctaaactaaaataccaaaatatgaaagtccaatacctaatacaaatagtaaagctaataacttatatgttgaccatttgtatttctttactaatatgaatactattatagtaataacagcaggtaacatgtttggaagtattttatctaaaattgtttgaatagaaacaacttgctcttcacctgatgcaagagtagtagcatattgaatacctatttttgcttttacaaaactaactgataatgcagatataactgtaacacctactataccagcagcatgagaaacttgacctattttctcactcaatgtatcgattacacttgtacctaatttatagcctaaatatcccattaataacttaatagttaacatagaaattatcatagttatccagaaagccataggagcaaaagttaatccgttcatagctaatccagcaaatatagttgaaaataatggtgctaaaccaaattgtgcaattgaatcacctattcctgccaatggtcccattaatgccatctttatactacgtgaattttcaatatcttcaccatgatcatacattgccatatgcatactagtttcaaatggtaatgtatgaggatttatattgtaaaattctatatttgaaattgcaacttcttttaatttttctggatcatccttatatatctttttcaagactggtaggattacaaataaatatcctgttccttgatatgaattatagttaaatccattttgtaaaaaataacttctaagggttgtatttaaataatctctttgttttaatacaggttttctagattccatttgaaaaatcctcctcatcagaaacattaacatagctctcagctactaccttctgagcattactagagtttaaattataaacaattaaagcaaatactgtaccagctaacgcaatagccatagttggtaattgtaaatatgatacgcatatataacctaatagaacatatggtataaattccttcttaagcataactgacattatcattgcaaatccgattgcaggtataagtcctccagctattgataatccttttatcaaccattgaggtaaaacatttacaaacgattgtaatgctggtaaacttactgctgaaataattcctataataaatccaactactaaaaatgcaattactgtactatttgcaagtaaattaaatttaccatactttccttgtcttaataattttttagcattatctgttgtacctgataatgcagtatatatagctgtagtaactaattggaataatactgcaaatgggaatgatagagataacgctgattcaggagtaactccttgattctttaatgtaatcgccataattgtccctactataccaggtcctaattgatttggaggaactgttccacctgcacctacaccaaatcccatgaatgctaattcagctaaagctccaaaagttagtgctgtaggaatatcccctaaaacaagtcctacgaaaaatgccataataattgaacgatttgtatatataccaagtaattgtcctgcataacagaatgcagtaattaatcctattaaaattgcctgagttaatgatatttccatcttttcttcctcctactatagagcattatttaaagcttctatggacttaactccatcatctgatacaggtgatgtcttcgtattaaacttcacattatatttatctcttaatatacgcaatgcttctttatcattttctcctaaataaataaattgagaaattttttctttgccttctgctgcatgaacattacctatgtttaactcttctatagggaatccaccctctactaatctaagagcatcttcacaagatttaacaactgtgaaaatagtttgatgtggagctgctttccaaattacttcattagttctatcaatagtccaaaaacgtactccaatatctttagatacaatcgatttcattaaggtttgttgaatattatctgttgacaccttatcatttgcaactattactaagttagcacctaaacttttaatccacaattgtccttgtccatgtatcaatctttcatcaacacgtaccatttttatatttggtttattttccatagttaattcctccatttataaaataattaattattttttaccaatacatttcccaacttttataaaatctaattaaagattccatatagaaataatctccccaaatattaccttcatctacacctttacctgaatgccaagaatatactccatgatttataagtgctgtagctccatcagtcaaatcatcagtataattatttattaaactagctaacattgagtgctgtacatatctataaacactcttcatttcatcagtttctaataggaacttgtccattaaattaaaaccacaaactgctattgctgctgaagatgaatctcttgattgtccagaaccatcattaaaaattaaatcccaataacatataaaatcttctggtaatctatttataaaataatttgctactgcttcaaaagtatttatattctcttcatttatattgtgaaaatgatttaatgctattccgtaaattaaccaagcttgacctcttgcccagctagaatcatctgaatatccttgtctagtcttaccaccaacaggatttccagttgaaggatcaaaatagaatgtgtgatatgcagaagcattatctctaaccgcatttgcaatcgttgttttaaagtgtttttcagcaatttctttatatttttcttcttctgtcacttctgttgcccaatataataaaggaatatttaaaaggcaatctacaattaatctataattgtcagcaacacctagttcaccccatgcttgtatgaattcacctttttcttgataacgtttaataagtgcatctgcagccataattgctgcatcatacgccatcttatttcctgttaatttataagcactaacgcataatggtatataaagaaatcctaaatcatggtgactaacttcaatattatttacaattctattataaaatgactcaacatttttctctgccaattccttgtatttattgtcttttgtatattcatatgccaaccataaaattcctgtccaaaatccattggtccattcagtattatccatgacaccataagtgttatctttagttgctggtgttggaaaattctctccaaatatttctatatttctatctatttttcttatacatttatctaatgctacttcaattgtttctttagttaagaaaccacgattaaaataacgttcactacgaatcaacggttcttttataatattgcgcatattttacaaaactccttaatgttaatttttaattaaacattatcttcagtttgaatttctatagagtaaaatttataatgtatatagcttcttataaattcaaatggtatttgagcaggataataagtaattctttctaatttatatagtggtgtattttcatcaacttttaatacatcacataaactttttaacgaaattggaaactctacttgtattttttgtttcataggtaaagtcattaagtttatatccaaagctttttttatttcatcagaaactctatcattttcatttaaattattataatcaaatttctttaaatacttctttggaatatagctattttgaacttgccatggtgtatcattaacataactcactctacaaaatttaactaaagtctcattagctctaacttttaatttttcagcaatctccgcatcttctatttcttttacaattaatattttttactttctattatctttttctcattatactcattcttaaattcttcaattattggacttccctcatcaaagaaagcacgtctatgcttaaatgatttccttacataagttccttctccttgttttctaataaggtatccacttaaaactaaatcttgaagagctctaacaacagttgtactactaacattgtaaattttttttaactctccctcagaataaattttatctccaggcttaaactttttttcttcaatcatctgaataatgtcttgttttataatttcatattttgcaagcatctctatctctccctaatcatataacacgttaatgtattaagtatattattataattatatgttatatcattatggctttcaagtgtaatgaaacttataacactttaccttaattcattcatagaaaccatatccatatcatcatatgtgatattttctccacacattgcccatatgaatgtataattacttgtccctactcctgaatgtattgaccaacttggagatataacagcttcttcatttcctactataatatgtttagtctcatccggtttacccatcatatgaaaaaccttcgtttcttcattcatatcaaaatacagatatgtttccatacgtctttcatgagtatgacacggcattgtattccaagcactgccttcttcaagaattgtatatcccatttgcaattgacaactttcacatacattgggatgaatatattggaatattcttctcttatttaacgtttttccttcaccaacaattcttggtgttatattatctatgcttattttaacatttggatatttataatgtgcaggtgttgaaacaacatagaattttgctagattatttaaatccttagatttaaatattacttgctttgtttcttttccaatgtaatatccgtcttgttttttcatttcttcttctttaccatcaataattattgttcccggtccacctatattaataattccaagctctctacgctctaagaaataatctactccaagttctttcgaaaaaattatttctaaaggcttgtctttaggtgtcactcctccgaagatctgacgatcataatgcaaatacgtcaaacaaatctcaccaggtgaaaatattcttttttgtaaaaattcattgcataattctttagttgaataatgctctatatctttaggactatgtgcatatctaatttccatttctcctcctcctctccatttataaggttaaccacttaacatgttaagatgttaatataatattactactttatgaaatcgtagtcaataaataaaaaaaatattttctataaatttctatggataaaatagacctgattttaatattaagatacgaatttaaatgctggctttcttaactgcacacataataaaaggcctaaccttgacggttaagccttttattattactttggtactcccagcgggaatcgaacccacatctatcccttaggaggggattgttctatccattaaactatggaagcatattaaatttactttaaatgtctattaaattctattataattaaccccaattgtcaaattttaataaaaaattttactatttatgaaatcctttttgaaaattatacttacacaaactcttcacaaatataattttcaaaaagaataaaaaggttgtaatatatattacaaccttcaacaatctaaaattatcttctattttgttcttttttagctcttctacaatctgcacatcttacaggttcattttcaaatcctttttctttgtagaattcttgttctcctactgtaaatatgaattcattcccgcaatctctgcatactattgtcttatctgtcataattattcctcctaaaattaaagattctaaattgatataataatctctaattcctgagaaactatttacctaaatgaaactttttttattagcatttctgctattcttaaataataacataatttttatttaattgcaagctttatatatattccattaacaaatatactttatttttttattttaccaaatttgtaatctgtcttctggttttatatacatcttatctttttcagttactccataagttgtataaaattgatcaaactgtggtaaaacaacattaactcttatcttatttggtgaatgtacatcaaattttaaagccatatcttcatactcaggtgtagctatctcacgccatatccttgcattgctttcaaagaaatctttataattaggattttctttttcttttaagatatctaagacacatgcaatccccccaatatcagctatgttttcgcctacagtagcatcaccattaacatttttcccattatcagtttttactttattataataatctcttactttttgagtcttttcttggaatttacttagatcttcatctgtccaccaacagtttaaattaccattactatcaaacttagcaccagtattatcaaaagcatgacttatttcatgacctattacagctccaattgctccataatttctttcttccgatgcatttatatcataaaattcatcttgaagtattcctgctggaactgttataccgttagatgttggattataaaaagcatttaccatttgtggagggcatgcaaattcatttctatctacagtactattcaatttttctaactgcttttcatataaaaacttgcttatattaagtgcattttgtaaaagtgatccaccttcatcatatgacttaatttctactgatgaataatcttcccatttttcaggatatcctatattaacatttaaattatttaatttttctattgcattagcttttgttttatcgctcatccaatctaatttttctattcttttttataagtttctataatcttacttgtcatattttcaacatttgttttgatctgaggattaaaatatctgttaatatataatctaccaaaaggttctgataataacgaattaacgacagatattgctttttcatcatcaggaatatctccctttgaacccatatattcattggcaaattctgtactcgcctttgtaaaatcttcacttaaaactgctgccattccagctatattgttaatttctatataatctttaaataactgaagattttcttctttatatatatcatttaaagcttttatccatttttcttcgcctaatattatcttatttgcagtatcaacctttaaattttccatatatttttttatatttaaattaggagctaaattatcaagttgatcaatacttactacattatatgattcatcaattgcgttctcatttttagtgctctcttcttttccaattatcgatggagcaatcatgtattcaagtttaaacatattttcaactttttgttttgcttcatctgctgtataaccagttaatgttaaaagctttatataataatttgttataagttcctttgtatgtgctgtactttctgtaggttttgtatattcatcagaatctcccaatgaaagccctgtttgttccacataaagagcatatttagttgcatcctttaaatctacactacatgcaaatccgattaaaggattactaatattgtatttatttaaatcattaagttcatcaagactttttatattttttattctttcaagaatttctcgtgctggctctataccttgtttatttctttcatctttatttaaataattttcatataaatttatgatttttttctcatcactattttcaccatacatctttttatttgctataagttcactcataagattcttcttttgttctgttaatgaattatttactgaatcaaatgcagaattagatgtttttccatccgcaattttagcagtatttaaccaatccttattaacagcatcatagaaatcatcctgctctcttacatcattatttacagttttattggtttgattattattatctacttctgctgctttagcatatatactttgagagaaaagcatcgcacaagctactgtaaaagcaataaattttcttttttttatcatttaattgtcacctcttccttcttgtaatattataccttatttttctttatatgtaataaaaagtatgatttatattggtttagtaatatttatatattttgcttaaacaaattataattatccccacataaaatcaacagataaatatatagcttattcttattaaacttaactacataaatctatctgttgattgtacatttttttatttttctaaattgttctaactttatattttttattaactcttattctaaagaagtcaacaaatctagttataagaggacctgataatactataaccgctaaagatattgcccaatatcttaatttaattgttgttaaactgaatatatatcgtcctataggagtaataaacgcaagaatcattataccaaacatacttaagcataatactgctttgaaattagttaatggttttgcaactctaaataatatcaccatactaattccagcaaacattaacaatgctaaagtcctactttgttgcattccaacacctaaagccaaagatattaaaaaagtacctactgtgaatccagcaagaattattccatttggtatacttactgttattactcttgttaaaaatcccttttttaccccacctgtactaggaagcatcgctaagaaaaatgctggaatccctatagcacaactaccaactaatgataactgtattggtaatataggatatggtaaaaacattaccgaacaaacaaatgccaataatattgagtatattgtttttgataaaaataattcagaaactctctcaagattattaatctgctttcttccttcttctaatacctttggaagtgctgagaaatctgacttcatcaatacaagctgtgctactgcttttgtagcatctgacccatttgccattgctataccacaatctgatgcttttaatgctaatacatcattaacaccatcaccagtcattgcaacagtatgatccatttcttgaagggctgtaacaatttttttcttttgatgtggagtaactcttccaaaaacagttgtatcttttactaaatttttaaattcattatcgtcttcaggaagttcacgagcatcaacatatttgttccacgactgtactcctgcccttcttgcaacttcagatacagttacagggctatcaccagaaataattttcacttcaactccctgtttattgaaataatcaagtacatctggagctgcttctcttattatgtcctctattaaaagtaaagctacactttctatctttcctaaaagactgtcgcttaattcttctccatgaaacttagctaatagtaatactctcttaccctttttagcttcttcttctacaatgttcttaataaaaacatattccttacctaatataacctctggtgctcctaaaatccatgaaccaagatcaccttcaaaagttaatccccccactttctttttgacgaaaatggaatcttgtctatacattttaaattttgatcatactctttatatttatctaaaatagctttctgtgttggatttttactaggtaaattatgaactaatgccgctaatgccctgtctacctctaatttatcagtatcgcctattactttgatttctgataatttaagatctccttgtgtaagtgttcctgttttatcaagacacaatacatctactctagctaaaacctctgttgcacaaagctcttgtacgagtgtatcaaactttgataattttattatagaaacaataaatgttgcacttgttaataagactaatccttcaggtatcattccaattattcctgaaacagttccaattgctgcactctgccatgttgcatcaggcacccttaactgtgttactgtaagaagtattgtaagaggaataataatccataataatactttgaatatcttatttattgctgattgtaattcagaattagtaattttaaactgttttgcttcttctgcaagacttgatgaataagtttctttaccaaccttattaactctggcataacattctcctgcaactataaagctacctgaaagaagtgcatctccttctcttttgcctatagcatcagattcacctgtaagcattgactcatcaacttcaagtccattattttcaataacttcagcatcagctaatacctgcatccctgtttcaagatataaaacatcatcaagaacaatattatctataggtatttcattaatctcaccatttcttagaaccttagcttgagccatacttattacagatagcttttcaagtatatctttcgctctcagttcttgagctactccaattaatgtatttaccaatataactcctacaaatatagcatttttaggtgatccggctaatattataataactgcaagaacaacattaatagcattaaaacttgtaaaaagatttgccctaagtatctgtccaaatgttcttgctggagcttttggtacataattaacttttccttcttttattcttatattaacttgttcatcatttaatccagtaagcttcttttcttcatctgattcatttatcttcttatcagatactatcttatttttaatatccttacttttcatatgttcagcctctccattacatactaaattcttaaactccattataactatctcacctatctatattttttattaatagcaacattaaaatacatacaaaatatttcaataatagataaatattttcataacattttagcaaaattattattatccatataagtcaaatcttatttttacttatattcctttatttatgcatatttaacaatcacttgataaatatattataatatcaatcttattaattacctatataattccttaaatttatataaagaattctcctttaatttcataaattatataaatgttttattgactataatttaattgtaaattacgtaaagtattttttatttaatatggaaattagtagaaaaatatatacttaattattcttgttaaaattcaattaatccattacattgagaatataaatacttttaaaaactaatcttttataatatactgaataatagtgataatataaaatataaggatgtgtaacattgtaatgagaagttttattttttacccaggtattattcttgctttgataattaccaatctatatagaattaaaataaatattttaacgaaaaaaggcgactcaaagaaaagagaagcttacattcacaaagtcactacacaatgggcaaaatttgtaatgaaattatctggtgctaaaattactgttattggagaagagaacattcctaaagaccagactgtattatttattgcgaaccatcaaagtaactttgatattcctttaataatgagttcaatcgatgtacctaaaggatttattgctaaaaaggaactggaaaaatggcctatgataagtacgtggatgaaatatatcaattgtatattcatggacagaagcaaccttagaaaatcagctgaagcaattgttgaaggtgctaaactattaaaaaatggatattcaatggttatattccctgaaggcacaagaagtaaaggcggtccagttgaagactttaaggctggaagctttaagcttgctacaaaatcaaagtgtcctatagttccagttactatagatggaacatataaacttctagaagctaataagaattggataaaggctgataatgtaagacttatcatacacccaccaattgatgttacttctttgtctaaagaagaatctgagaatcttcacaatactgtgcgttctattataagcaaggattgtacaactatataataaaaaaataatcttaattttaagttttcttttaattaagattattttttatattattataaatatttttctatataactaaaaaatattataggggtttcccatttaatattacttgctcaatttaacactacataaaatagataatatcaatctttaattaaagcacatgttttatataaaattaatttattttttagttattttagaattactctataaatatggatttaatcgcctaattactattttaattatttcatatataataagatatgattttacacaaattgtaaagttaaaaaatatctttacaatgtttgttgatttctgttataataattttatttgcttatatgaaaaatattaattaagattttaataattattatttaaataaaaaaattttcaattttaaaaataaagaaacgaggatatttaatgagtgataatcaatttgcaactttaggtcttaaagagagtattgtacgtgcaatatcagacctaggttttacaaaaccatctcaaattcaagaacaaagtattcctgtaacattaagtggcgctgaccttattgggcaggcacaaacaggtacaggaaaaactgctgcgtatagcttacctatactaactaaaatgagcactaataaaggaattaaagcccttattttagctccaacaagagaacttgctgttcaagttaaagatgaaatgaacagattgtctaagtacgaaaaagcagaaattttagctgtttacggtggtgactcaatagacagacaaataagagcattaagaaaaggtgtagacgtagttgttggtactcctggaagaatgcttgatttaattaaaagaaaatgccttcatttagatagcgttgaatttttagttttagatgaagctgatgaaatgcttaatatgggattcattgacgatatagaatcaatcttaagtcatacaccagaagaaagacaaactttattattctcagctactatgcctgatccaatagcaaaacttgctaaaagatacatgaagcctgatgctaaacttgttagtgttaagaaaagttctttaacagtatctaaaatagaacaaagctacttcatgataaacaataagcacagattagaagcgctttgtagactactagacttagataatccaagttcagctataatattctgtagaactaagagaggcgttgatgaattagttcaagaattacaatcaaaaggctacatggttgaaggaatgcatggtgacatgacacaagctcacagattaactactttaagtaaatttaaagaaggtactttaaatttattaatagctactgatgttgctgcaagaggtatcgacgttgatggcgttactcacgtatttaactatgatttaccacaagatgttgaatcatatgttcatagaataggtagaacaggtagagctaatagagaaggtactgcttattcattagtaacacctaaggatttctcaatgcttaagcaaatccaaaaagttactaagagtgctataactcaaaagccagttccaactgctgaagaaattaagaataaaaaattcaatgatataataaaagaagttactgaaactataacttctggagatcttactaagttcatgcctaatgcaattgaattagtagaaaacaatgatccattatcagtagttgctgcattaatgaaaattaaatatgataatgaaagcgtatttgattatagttcagataaattagaagcacctaaaaaagaagatattcgtttattcttctctgtcggtaaaagagatggattaactcctaaagttttaattaattatattaaagatagaactagagttaatgcttcaacaataggtcaaatagaccttatggaaaacttctcatttgtaagtgttgatgaaactgtatctaaaaaaatattagataaatgtccaggtggaaaaatcaacaagaaaaaagttaatgtagaagttgctaatagacgtaagaaataattaaattaactttggagttgtggcataaagcctaagctatcctgtgtatattatatacagtagctatagtattagatgtaacaactcctttttattttacctttaactatcatttctcaattatatactatctatgtaccctagggaacaaattcaatccgtgcttatataaccccagggggaattgtgataacttttttaaaataaaaagatatccacattcgaaaaaaataatccacagatttttttatatttatctacattttcttgataactttatcattttcattatccacagtatagttttccacttctataattttagatgcactatccaaagcatatttttttggcatcctcattgtaaatatgccattatcaattgactttaatactctatctgtatctatttcttcaatattgtcaaaactagtattatatttcttctttacaatattattagtgtatcccctatatgaattattgtcatactcagatcttttaaggtttatatctaaaattcccggatcatatcttatacttaattcccttaaatctatgccatttaaatcgattctcagtatatacatatcatcatttcgttcaaaatcaataaaatcacagtcatcttctattgaattttcttttatagtatctgatatagctgtataatattcctctgcaagcttttctatatcaacattatttaatacagatgttactgcactttgtatatgatctagtaagttcattccattcatattattcatattttgattaaagttatttgcttgattaggatcaaagaaaccactatacccattagttacattaaagccattaataccatcctttgtacttgtgaaactcgtaaaactagtaaatgaaatcatattacccattccaaaaggaaacattccaaacatagtatcctccttataacctttattatatatactatttaaatgtgaattaaaatgttaatacagtataaaaaattatacaattatagttttatagtaaaagaaagtaaagagaatacttatattatatgtattgaaccaaatataagacgtttgtaaaaaaataaagccacctaaaatggcagctttatttttcaagtttgtgtgaattgtagtctaaaaattaaaagtatttaaattatattaaaatagaagttattacgtattgttatgtattattttgatgctgtatcagcttccttatactctctactaacaacaatctctactcttctattttgagctcttccttgttcagtatcattagatgctttaggcttaagttctccccaagcttctattgatgttttttctggatcaagtccattttccgaattaaccaataagcttcttacatttatagcacgttctgcacttaaatccatatttgaatgaaattctgaattatcaataggaacattatcagtatgtccaacaatttttatttcattttctaatccattcaacatagcagaaaccttcgataataatggaattacattttgatgtatatcggctttaccagaatcaaaaagtgcaacatcctgtactgtaatatataatccttcttcgttaatgtcaacgttaatggcatcactatatccttcacttgtaatttcttcttccataactgctttgattgcaaccatcttatcttgttcaagttctgcatcacttttgccagtcccatcagatattgtatccataggaataatcgaatttccatcactttgcatcatagatgttccaccagaaaatatttgattaaaagatttgctcatagcctgaaattttgccttatctgtttgtcccattgcaaacattacaataaataatgctaataacaaagttaacatatccgaatatggaagaagccaagcttcatcaacatgctcttcatgatgttgtttttttctactcatcagctttctccttttgaattaattattgttattcttttcaagtttaattctatccttaggttccaacattcccactaattttctttcaatacttttaggattatttccagcttgaatagctaaaaccccttcaagtataatattcatattttttatttcttctagggactttctttttaatctatttgaaaatggatggaatattaaatacccacaaaaaataccataaacagtcgcaacgaatgctgaagatatactctctccaagtttatcaatatcattaagatttccaagtgcaccaattaatccaataacagctcctaaaacaccaagtgttggtgctgtaccacctgctgttgaaaaaacagtagctcctagacgatgtctttcttccatactttcaatttcgatttcaagtacttcttttattatatcggattccataccgtcaactaccatttctaatccttttttcataaacctattatcaagcccttgtatagtaccttcgagtgataataatccatctcttcttgttctttgagacatttctataagctgctcaatgatttcaacaggatcttgacgccctttattactaaacaaaactccaagaattttaggaattttagtaacttcgttctttggaaaagaatttaaaataccaattatactaccaacaataattaccattattgcttcaccactaaacaatatgcttggactagcgcctttcattaataatcccgaaagaacaactgcactacctccaattagtcctataactaaaaatatatccattttttcctccaattttgttaattttttattaaatatgtttttattatacaaatttataataccataataatcaacattatttaactaattattttatttttaaactacaatttttgtgtttttttttaagtaaaaatttatacttagatttcttagcattcccactaatagcctcatcttatcaatatactcattatactttaatcgatattattattagagtttttcattaacttttttactggtaaaacacattaacttatagcgttttattatctatatacaaatataaaaagagaagacaagaattacaaatatatgtaattcttgtcttctcttttttctataattaatactataattattatatttattaaaattataaatactaaattttatattattttttatactttataagcttttcttcaaaactattaatttcattaattgtttcttctcttgcaaaattatctaaattacctcttccaagtctatctgcaagagctactaaaacaatctcattcacatcaacatcttttagcatctcatcgatattctgaaatttcgaatcttttgttacaaacaaactctgcatatgccatcttacaagaccaataactttatcaacaaaattcttatcctgattgaaatactctaaaaatttttccgccatatcctttccaaccctatcatgatcataagacgtaagtcttcctcttctcatttttgtagttggtttttttccaacatcatgtaataataatgaccacataaatgctcttttatcattacttttttctctatttatagcaccttcatcaataaccatcatggtatgtataaaaacatttccttctggatgatatttaggattttgctcaacatcttgtagatctccaatcattgaaagtggataattattgagtaatttttcatctgctagctttttcaaaaaaagtgatggtttatcatcatttaataaatgcttttctatttctaaaaaaatctcataatctttatctttcataatattctcctataataaacactaaatttagcaacttataataacaataaaattataatgtaaatcaatcttagtttttatattaattaatctacctaaattatcttaatataataatatttaaccttaccccaaagaaatattattattaagtttatatagtaataattaaattaatacatatatctattatatcaaatattaaaaattataatcagataacatcttgaaatactaatttatatattaatctattcccactctgtagtattttttaaaccttcaatagatgaagccttaaatacaggttcctttattccattctttttctgcttacggtaatcatctaatgctttatatgcatactttcctaatgctgttattgcaataagatttaatatagccattccagccataaatacgtctgctaggttccaaacaatatctaagcttgctattgctccaaaaagaaccattgaggcaactgctgctctataaatacctatgtatactctcttattagttaaaaattcaatgtttgactccccatagtagtaatttcctacaatagaactaaaggcaaacaaaaatatacatatcgcaataaatgtgcttcctatacttccaatctgagaacttaaagcattttgagtaagctgaattcctgtcaacccaccacttaaatcaacatcagataataaaataatgaaagcagtacaactacatattattatagtatcattaaataccgctaatgtttgaattaacccttgcttaacaggatgtgaaacatttgctgtagctgctgcatttggtgcactccccattccagcttcgtttgagaataaccctctcttaatccctataagaattactcctcctaaacttccaccaacagcttgctctacaccaaatgcattttcaaaaattaatagtaatattcttggaacctctccaatattcttaaatattacaaataatgcaactaatatatatagcactgccataacaggaacaataatacttgaaaccttagcaactctttgaacgcccccgattattattactattgttaaaattgttaatacaattccaacagttaatctatcaaatccaaaagcctcattcatggcaattgaaattgtattagattgaactgaattaaaaatcaaaccaaaactaacagttataagtattgagaataaaatccccatccatttcttgttaagacctttttctatgtaatatgctggtccacctctaaatgcacctttgctatccttttctttatatatctgtgctaatgttgattctacaaagcttgatcctgcaccaattaatgctataagccacatccagaatattgcacctggtcctcctattgaaatagctattgctatacctgctaaatttccagtacctactcttgaagctgtactgatacaaaaagcctgaaatgatgatacgtgtccatcttctttattactagttgccccatcacctaataatctgaacatctctttaatgtatctaaattgaacaaattttgttttacatgtaaagaatatacccaacactataagcatagccacaagtatatatgtgtataaaaaattacttaaccattccacattccctgcaaaattactcatttttcttcctcctttgatatttatataaaaatatacttctaaaatttaaacatttatttaatattaatccttaaatattaaataaatgtttaagtattttgtaaactaaatacaattttaaatgtattttatattttttgcaattttgaaaaattttcattcatattcttgtaatctactggggatttcatgtaatttaaaccttattttttaccttacttttttaatttatctacaatattctctagtattcattcaaatacactgtattgtttttaattcaaataataaatcgcaaaataaaaaatgcaatttataatattataaattgcatttttatagtatttttttgtatttattcaaattaatgtatcatattttactatattttcgataatcttaactatttaaatctcaaaaactaattatttcaataattatatacagtttaattaatttaattaagtttattgtctcttaaacaatatttttttaacttatagtgcctcatttcctctttctccagttcttattcttacacaatcacatatatctataacaaatatcttaccatctccaacttcaccagtcttagctattgaagaaattatttctattacttcttcaactttactatcctctattaccatttttacttcaattttcggtaatacattagtaataagttcagttcctctatgatattctttccatcctaattgtttaccacatcccattacttggcttatagtaactccattaatattattattctttaacgcttcttttatttcttcaagttttgaaggccttatgatagcttctattctcttcataattatctatcacctttcactttaatattttaattaatctaaacctgtaaatgcagggtaagcagattctccatgttctgcaatatcaagaccatcagcttcttctgatgcttctactcttatatccataaataaacttattaccttaattataacaaacgtcataattcctgcaaatgctgctgtaataactatacttaaaatctgtgctcctaaaagcttaaagtctccgaaaaataaaccattccattttgctcccgaattaattgaagtctgagtaaataatcctgtggcaatgcctccccatattccaccgactccgtgacatccaaatgcatctaatgaatcatcatatccaaatttattcttaagatgtcccatgcaaaaataacatattggagatactaatgctccaatgattatagatgcccatattgaaacaaatcctgctccaggagtaattgcaactaaccctacaacagccccagttgcagctccaagcattgttggttttccatgtgcaatcttttctataagcatccaagaaagcattgctgttgctgctgatgtgttagtagtcataaatgcttgtactgcaagtggttctgctccaagtgcacttcctgcattaaacccaaaccatccaaaccatagtagcccagctccaagtactacaaatggaatgttgtgtggtttataagatatcattccataacctcttctttttccaagcattatacatgccactaaacctgacactcccgagcttatatgaactacatttcctccagcaaaatcaactgctccaagttcttttatcaatccaccatcaccccaaaccatatgtgccattggatagtacactaatattgaccatacggctacaaaaacgaataatgctgaaaatttcattcttcctgttaaagaaccagttataagtgctggtgtaattattgcaaacatcatttgaaacaaagcaaataataattcaggtatactatttgaatatgcagaattaatatctgcaccaactccatttaaaaataaatgattaaatccaccaacaattccatgaaagtcattaccaaatgacaaagaataacctataattacccacaataatgatgctaaaccgcaacaaaaaaacgaagccataagtgtatttaatacattctttcttctaaccatcccagcatagaaaaaagcaagtccaggtgtcataaaaaataccattgcagagcaaatcataataaatgcactatctgctaaatttatttccatatataatccccttaatattaataataaaaattttattctttattatattaaaactaatattattttttttacttttttcatagtactaagaaaaattcattacaaaacgaaatggagctcaataaatttaccaacctcttggtacctttattgaactccattgttcttgtagactagtatattattaaattttaccaatgtcaacatcattttgaaatttttttatcatatattaataatttttttatcaaagtttttatctccatatacttattgggcatatcctcttcaaagttcaataattgaattaaattcgctaaatcccttatcttgctaagtttataccaattatcaggtaatatataatctgatttttttctatattcatcttcaaatattgaaattaattgtttattgaaatattcctcatatctaaatagttgacctatgtcagcaagtggatgccccgccattgcgaattcccaatctataataccagtaattttgttatgatctactaatatattagttccttgaaagtctccatgaacgagtctagggtcattatctaaacttaataaatcctctatattttcgttaattacttttcttatcttttgaataatatcttttcctaatcttttttcaactttatctgtaataaactgatcataccatttgtttaatggaggtaacttatgataaacttctaattcatcatttaaaaatccaacactactgaatcttttcttatgaatattagctaaaatattagctgcatcacgaataatatattcattagtcatatctccattatttaatgattttgatagtgtcacaccttctatatatttgtatattacataatatttatcattaatcaaattagatttatcaaatttacaaatttcttgaacacatattttatcttttagtatacttaaaatttcacattcttttctatattgctgatcatctgaaaaaaatatttttaataaatatttcttattgtccgttgaatatataatgtagttactagttctacagccctcatcaactggtttaacactaattatctcatttttttttataattcctttaaaaagtttatttatagtttccctatctacataaagaaaaggtaacgttctttcccaatttttttccacaaattatcccctatatatttgtatctttaattctacaatattacattactatatatcttaacataaactcttttatatttttaacttaatttatataaaaattaagaccgatttaatgctataagccctaaaccagtcttaataaataaaaaaattatactttttacaaacaaatcctattattaaatatttattattaaataattatattctaaatatctatttatgtatttacttatacttgatgtatgatttttatatattgtctatgctaaattcttcacataatcataagcatcttcaattgcttctgttttagtatcatatatattcttgtgtccaacttttattgcaaatcccatattgtctaggacctttctaggctgctcttgaacatgagttaaatataattttatgcctaacttttcacattgcttaagaagctttgtcatggcatcaatagctgaagcatcaacagcatgagtatgtctcatatcaagtattactacctctgtagtcgactctaattccttcattttgcttataaattcttgaactactccaaaaaacattggtccattaacttgataaacatttatttttccgtctgctttttctaagactttagtgatttcatcatcaaatacatcttcatctacaagatcccttatttcagttgtatcacttactctcttcataaatagagccatagttattatcatcccaaatcctatagcaacaactaaatcaaagattacagtacagctaaaagttattaataaaactgcaatgtcgctctttggtgcctttaatagtgctttaaatgttctccattcactcatattatatgctacaacaattaatattgctgataatgcagtcattggaatcatttttgctaatggcattaataaaagcatagttataagaagtgttattgcatgtaccatacctgaaattggacttcttcctccagatttaacatttgaagctgttcttgctatagctccagttgctggtattcctccaaatagtcctgatgtaatattagctaatccttgtgctacaagctccatattagaatcatgagtatctcctatcatttcatccgctacaactgctgataatagtgattctaatgctccaagtatagcaattgtaacagcaggaacaaataatttatttatagttcctatactaaatgaaggtaataccggtacaggaatagctgaagaaatttctgtaaacctacttccaatagtatctataggtatattcatgaactttaccataagtgttgcaactattagagcaatcattgaacccggtatagtcttatttatttttggccataacactataatagcaatacataataatcctattgccattgaccacatatctattgtattcatatttgagaaatagctttcccattttggaataaattctgatggaacatcctcaattttaagccccaaaaaatctttaagctgtgtagaaactaatgttagtgctatacctgctgtaaaacctacagttatagttttaggtatatattttattagtgttccaaactttaataatcccattataacaagcataaccccagccattataactgccgttattaatccatctagaccatgctcctgtattatagaataaattatagttacaaatgcagctgttggcccccaatctgaactttgctacccctaaaagagatattacaaatcctgcaaatattgccgttataagccccttttctggagaaactcctgaagatattgcaagggctatagataatggtaatgctataacagcaacaataatcctgctattatatctttcaccatctgttgtttagtaatttccttgttcttaatcatagaaaagaacttgggcatcattattatccactccttatttagtttttatcagtttttatattactcttaaatattatcctagtcaaagtaattttttccatattcagtcacatttattggtttttttctaaatttgtttaaagaaaacgtttttttaatattttttattaaattctttaatattcttttttaaaataaaaaagaagaagcttattttgcttcttcttaattacttaaatttaaatataatgtaatctaaattaattatttcgtatgataataaaaataatattacattattattcaatataatttacttattatttattgctaaagtcgctattccaatgccccaaatcgaaataaacctttagtttattatataattaattatactagaaatattgttttctagttcttaataaataccttgcttttaattaaaaaaagtatcaagtttttcctctaattctttacttatatttactaatggaagtcttacttcatcagattctattaatcctaatttctttaaacaatattttactggtgtaggattaggctctgcaaataatagtggtatcatattgtaaagatccttccatttctcaaatgcatctttatttttattattttttattaaattataaatttctacaaattcctttgttttaacacttgcagaagctagtattcctccatctcctcctaaagcaagagttgtataaaaatatgcatcttcacctgttaatattgaaaaattttcaggtctgttgattaataaatcagtagtctgtttcatatccccagaacaatcttttactccaactatattatttatttgtgataattctaatagtgtttcattttgaatatttgtccctgttctatatggaatgttatatataataatattcatatctgttgattctgatatacatctaaaatgctcgtacaatcccttttgattaggtcttgaataatatggcgcaacagataatattccatcaatatcatacttttctaatttctttaatttatttgcaacttctattgtattatttccaccaagcccagtataaatagagactttcttttttgtatattctattgttttcgataatatttcctcgtattcatattcagaaattgtaggtgattcacctgtagttgcaagaggtattattccactgacaccttcttcaatacaatgatcaattatatttctatatgactcataatcgacttttccatttttgaatggtgttactaatggtaccataactccttgtagattcattaataaattcactccttgaaatttaatttattaaataagaaaacccgttgggtaaaaccaacgggtagagttaatcacttaaagttagaacaaaattgaatactattataataaaattacatatagtatatatagttaaaacataataataaatataaatcatttactatttaaatcaatcctgttaatccttgtagctctccactaacgtgacagtcatgtatatattttatacatgcccagaaataatatatgcctaatttatctcttcggctgctatacctttcactatctatcaaagcttgccagctccttatagttactctttataaacagcacctctaccataggtttccgtattaaattaagtttattataccactaatataaatttttgtaaaatattttttagaattatattttaatagaaaatttaaattcttccctttaatcaatcgatacatctttaattgtttaaataaaactatatataacttttcccaataacatgaaaacaactaataaaataatgggcttaatcactctagctccatttcttattgccatgtgagcaccaatataattacctaatactgcacaaatagcagctggtattcctatactaagccatacttttccattaattgtatatgcaattagagctgcaaaatttgatgctaaatttactatttttgcattgccagaagcagttattaaattaaagcctagtaatgaagtaaaagctaatactaaaaatgttcctgtacctggtccaaaaaatccgtcataagcccctataactaatcctataataaaggataataaatttgctttcttatctgatatatccttacttttattgttagatccaaaatttctattgaataataaaaatacagctacaatgggaagtattatcattaaataatattttaaatatttttcatcaagtattaaaactaattgcgttccaaaccaagaaccaataagtgctcctaaagcagataataaaccagatttaatttttatatttccacttttaagaaatttcatgcaagctacaaaagtgcctgtacaattagcaaacttattagtgccatatgctacatgtataggtactcctgcaaaaatatatgctggtaatgatattaaaccgcctccccctgcaacagcgtctacaaatccagcacaaaagactagtgggcaaataattgccaacattaattgatatgaatacataagcccctccttgttttttcaatgtgtctattttatatgtaatattataaaatgtcaattttagataagtttcaatttgtcctttgaaaaatctatcactattttaatagtacataataaataatttcatttaaaaacatttaaattgtatctaattattcaaatttaattcttcattttatataggaaaataaatctgtaattaattatatttttatacgctaaaaaggatagttatttctaactatccttactcttacctggcggtgtcctactcttccacacagtctcccatgcagtaccatcggcgctatagaccttaactgtcctgttcggaatgggaaggagtgttacctctatgccatcaccaccagatcctagttctttctaaatctatgatttagctaaaagaactgtactcctcagctcgtctgagcgagtttccttattaactttttgaaaaacttttgttctttcaaaattgcacatagtttttaatgtatttacaactcgattatattggtcaagccctcgacctattagtatcagtcagctaaatacgttaccgcacttacacctctgacctatcaaccttgtagtcttcaaggggtcttactagcttatgctatgggaaatctcatcttgaggtgggcttcacacttagatgctttcagcgtttatcccttcccgacttagctacccagctatgcttctggcgaaacaactggtacaccataggtcagtccatcccggtcctctcgtactaaggacagctcctctcaaatttcctacgcccgcgacggatagggaccgaactgtctcacgacgttctgaacccagctcgcgtgccgctttaatgggcgaacagcccaacccttgggacctacttcagccccaggatgcgacgagccgacatcgaggtgccaaacctccccgtcgatgtgaactcttgggggagatcagcctgttatccccgaggtagcttttatccgttgagcgatggccctcccacgaggtaccaccggatcactaagcccgactttcgtccctgctcgacttgtaggtctcgcagtcaggctcccttatgcctttacactctacgaacgatttccgaccgttctgagggaacctttgggcgcctccgttacattttaggaggcgaccgccccagtcaaactgcccacctaacaatgtcctgtcaccagtttcatggcatccagttagaacttcaatactatcagggtggtatcccaacaacgactccattaaggctgacgccctaatttcccagtctcccacctatcctgtacagacaataccgaaattcaatgctaagctacagtaaagctctacggggtctttccgtccaatcgcgggtagcgagcatcttcactcgcactacaacttcgccggattcacagttgagacagtgcacaagtcattacgccattcgtgcgggtcagaacttacctgacaaggaatttcgctaccttaggaccgttatagttacggccgccgtttactggggcttaagttcacaccttcgcttgcgctaagtgttccccttaaccttccagcaccgggcaggcgtcagcccctatacatcagcttacgctttagcagagacctgtgtttttgttaaacagttgcttgtgcctattctctgcggcctaccaaatggtaggcaccccttctcccgaagttacggggtcaatttgcctagttccttaactgtgattcttccgtcggccttaggattctctcctcatctacctgtgtcggtttgcggtacgggcactacttctctttctagatgcttttcttggaagcatgaaatcagatacttcggttccgtagaaccttccccatcacgccctaggattgttagaacggatttgcctgttctaactccctcaacgcttagaccagcatccaatagctggcacatcctatccttctccgtcacaccatcgataataacgattatagtggtattggaatatcaaccaattgtccatcgactacgcctctcggcctcgccttaggtcccgactaaccctgagaagacaaactttactcaggaaaccttagatattcggcctgtaggattctcacctacatctcgctactaatgccaacattctcactcgtaatcagtccaccgctccttacggtacgacttcagcccgattacgacgctcctctaccgctcatacaaagtatgaacccgtagcttcggtggtaagtttgagccccggacattttcggcgcaggatctcttgactagtgagctattacgcactcttttaatgagtggctgcttctaagccaacatcctagttgtcttagaaatcccacatccttttccacttaacttacactttgggaccttagctgacgatctgggctgtttcccttttgaccatggaacttatctttcatagtctgactgccgtgctgatagtatctggcattcggagtttgataaggttcggtaagcgctatgccccctagcctattcagtgctctacctccagtactcacatttcacgacgctagccctaaagctatttcgaggagaaccagctatatccgagttcgattggaatttctccgctatccacagctcatcccatgctttttcaacagcaacgtggttcggtcctccacgaggttttaccctcgcttcaacctggccatggataggtcacccggtttcgggtctacagcatgcaactagtcgccctattaagactcggtttcccttcggctccgtaccttaagtacttaacctcgctacataccgtaactcgttggctcgttctacaaaaagcacatcatcacacacataaggtgctttgatcggttgtaggcacatggtttcaggttctatttcactcccctcccggggttcttttcacctttccctcacggtactgcttcactatcggtcatcaggtagtatttagccttgggaggtggtcctccctgcttcccacaaggtttcacgtgtctcgtggtactctggtgcagaactgatcattatgacttttacttacaggactattacctcctacggtccaactttccagttgtgttcggttaatcataatttcacgttatgttctgtccgcaaccccagagataaatctctggtttgggctctttccttttcgctcgccgctactaagaaaatcgatttttctttctcttcctctaggtacttagatgtttcagttccctaggtgttccttcataaagctatgtattcactttacgatgcatgaggtttctcatgcgggtttccccattcggaaatctccggatctctggctatgtgcgcctacccgaagcttatcgcagcttatcacgtccttcatcggctcctgatgccaaggcattcaccatgcgccctttgtagcttgacctttttaagttttgatatacaaaactggttatattaatcattcacaaagaatatttattcttggctttgttgtattatatacattaatctatgtgcaattttcaaagaacattgaaagacctagtctttcaaaattgaacagaatcaatactcattaagtaacctttgagcaagttgtaatttttatagatgctttgcatctttgtactagtcaaacgccatgtttgctagatttctccatagaaaggaggtgatccagccgcaggttctcctacggctaccttgttacgacttcaccccaatcgctgaccctaccttaggtcgctgcctccttgcggttagctcacgaactttgggtattgccaactctcatggtgtgacgggcggtgtgtacaaggcccgggaacgtattcaccgcgacattctgattcgcgattactagcaactccagcttcatgtaggcgagtttcagcctacaatccgaactgagatcggttttatagttttgctcactctcgcgaggttgcatctcattgtaccgaccattgtagcacgtgtgtagccctagacataaggggcatgatgatttgacgtcatccccaccttcctcccggttaacccgggcagtctcgctagagtgctcaactaaatggtagcaactaacaataagggttgcgctcgttgcgggacttaacccaacatctcacgacacgagctgacgacaaccatgcaccacctgtcttcctgccaccgaagtggcttcctccattacagagtaattcaggagatgtcaagtctaggtaaggttcttcgcgttgcttcgaattaaaccacatgctccgctgcttgtgcgggcccccgtcaattcctttgagttttaatcttgcgaccgtactccccaggcggaatacttaatgcgttagcggcggcacagaggtcatgacaacccctacacctagtattcatcgtttacggcgtggactaccagggtatctaatcctgtttgctccccacgctttcgagcctcagtgtcagttacagtccagaaaggcgccttcgccactggtattcttcctaatctctacgcatttcaccgctacactaggaattctcctttcctctcctgcactctagatatccagtttggaatgcagcacccaggttaagcccgggtatttcacatcccacttaaatatccacctacgctccctttacgcccagtaaatccggacaacgcttgccacctacgtattaccgcggctgctggcacgtagttagccgtggcttcctccttaggtaccgtcattatcgtccctaaagacagagctttacaatccgaagaccgtcatcactcacgcggcgttgctgcatcagggtttcccccattgtgcaatattccccactgctgcctcccgtaggagtctgggccgtgtctcagtcccaatgtggccgatcaccctctcaggtcggctacgcatcgtcgccttggtgagccgttacctcaccaactagctaatgcgacgcgggtccatctcatagcggattactcctttaattgctgtaccatgcggtactacaatcttatgcggtattaatcttcctttcgaaaggctattcccctctatgaggcaggttacccacgtgttactcacccgtccgccgctaatccactcccgaaggagcttcatcgctcgacttgcatgtgttaagcacgccgccagcgttcgtcctgagccaggatcaaactctcaataaaaagtttaatcttagcttactcaaaataaagaattgctggtttacttaaatgtttatattatattctgttcaattttcaaagaccattttctttcacaactttacgttgttattatgttgtcaccctcaagcgacttacttagtatatcacttggtttgacatgtgtcaacaactttttttaaaacttattttgctttattaatttcagcttttatcaagttttaatttgttgtttgccgctctcagcgacgtgttttatagtatcatacatctgattctatatcagcacattataagtcatttaattaatttattcctatatttctttatttttctccatttatctctataatctttcgattgatacgcctggttcgatatactatccataattacatatttatccaatcaatggcctatataccatatattatagttctttttatatttattgttcgatttttgtaattctaaataattagcatttttatataattttatattaatcaccttataaaagttttttctccgtataaatattataaaaattttatttaattattcacatgatcaacatgtttttagctataacaaaaacaaattgtgtataaattgaaccatataaatttatttttttctagaaatttatccattaagtaaatatttattctaaattcttatacaatcgtaccttgaaaagagctatcgctcgattcggtaataaataattaaatgttaaatgataaatttcatttaaaaacatttaaattgtatctaattattcaaatttaattcttcattttatataggaaaataaatctgtaattaattatatttttatacgctaaaaaggatagttatttctaactatccttactcttacctggcggcgtcctactcttccacacagtctcccatgcagtaccatcggcgctatagaccttaactgtcctgttcggaatgggaaggagtgttacctctatgccatcaccaccagatcctagttctttctaaatctatgatttagctaaaagaactgtactcctcagctcgtctgagcgagtttccttattaactttttgaaaaaacttttgttctttcaaaattgcacatagtttttaatgtatttacaactcgattatattggtcaagccctcgacctattagtatcagtcagctaaatacgttaccgcacttacacctctgacctatcaaccttgtagtcttcaaggggtcttactagcttatgctatgggaaatctcatcttgaggtgggcttcacacttagatgctttcagcgtttatcccttcccgacttagctacccagctatgcttctggcgaaacaactggtacaccataggtcagtccatcccggtcctctcgtactaaggacagctcctctcaaatttcctacgcccgcgacggatagggaccgaactgtctcacgacgttctgaacccagctcgcgtgccgctttaatgggcgaacagcccaacccttgggacctacttcagccccaggatgcgacgagccgacatcgaggtgccaaacctccccgtcgatgtgaactcttggggagatcagcctgttatccccgaggtagcttttatccgttgagcgatggccctcccacgaggtaccaccggatcactaagcccgactttcgtccctgctcgacttgtaggtctcgcagtcaggctcccttatgcctttacactctacgaacgatttccgaccgttctgagggaacctttgggcgcctccgttacattttaggaggcgaccgccccagtcaaactgcccacctaacaatgtcctgtcaccagtttcatggcatccagttagaacttcaatactatcagggtggtatcccaacaacgactccattaaggctgacgccctaatttcccagtctcccacctatcctgtacagacaataccgaaattcaatgctaagctacagtaaagctctacggggtctttccgtccaatcgcgggtagcgagcatcttcactcgcactacaacttcgccggattcacagttgagacagtgcacaagtcattacgccattcgtgcgggtcagaacttacctgacaaggaatttcgctaccttaggaccgttatagttacggccgccgtttactggggcttaagttcacaccttcgcttgcgctaagtgttccccttaaccttccagcaccgggcaggcgtcagcccctatacatcagcttacgctttagcagagacctgtgtttttgttaaacagttgcttgtgcctattctctgcggcctaccaaatggtaggcaccccttctcccgaagttacggggtcaatttgcctagttccttaactgtgattcttccgtcggccttaggattctctcctcatctacctgtgtcggtttgcggtacgggcactacttctctttctagatgcttttcttggaagcatgaaatcagatacttcggttccgtagaaccttccccatcacgccctaggattgttagaacggatttgcctgttctaactccctcaacgcttagaccagcatccaatagctggcacatcctatccttctccgtcacaccatcgataataacgattatagtggtattggaatatcaaccaattgtccatcgactacgcctctcggcctcgccttaggtcccgactaaccctgagaagacaaactttactcaggaaaccttagatattcggcctgtaggattctcacctacatctcgctactaatgccaacattctcactcgtaatcagtccaccgctccttacggtacgacttcagcccgattacgacgctcctctaccgctcatacaaagtatgaacccgtagcttcggtggtaagtttgagccccggacattttcggcgcaggatctcttgactagtgagctattacgcactcttttaatgagtggctgcttctaagccaacatcctagttgtcttagaaatcccacatccttttccacttaacttacactttgggaccttagctgacgatctgggctgtttcccttttgaccatggaacttatctttcatagtctgactgccgtgctgatagtatctggcattcggagtttgataaggttcggtaagcgctatgccccctagcctattcagtgctctacctccagtactcacatttcacgacgctagccctaaagctatttcgaggagaaccagctatatccgagttcgattggaatttctccgctatccacagctcatcccatgctttttcaacagcaacgtggttcggtcctccacgaggttttaccctcgcttcaacctggccatggataggtcacccggtttcgggtctacagcatgcaactagtcgccctattaagactcggtttcccttcggctccgtaccttaagtacttaacctcgctacataccgtaactcgttggctcgttctacaaaaagcacatcatcacacacataaggtgctttgatcggttgtaggcacatggtttcaggttctatttcactcccctcccggggttcttttcacctttccctcacggtactgcttcactatcggtcatcaggtagtatttagccttgggaggtggtcctccctgcttcccacaaggtttcacgtgtctcgtggtactctggtgcagaactgatcattatgacttttacttacaggactattacctcctacggtccaactttccagttgtgttcggttaatcataatttcacgttatgttctgtccgcaaccccagagataaatctctggtttgggctctttccttttcgctcgccgctactaagaaaatcgatttttctttctcttcctctaggtacttagatgtttcagttccctaggtgttccttcataaagctatgtattcactttacgatgcatgaggtttctcatgcgggtttccccattcggaaatctccggatctctggctatgtgcgcctacccgaagcttatcgcagcttatcacgtccttcatcggctcctgatgccaaggcattcaccatgcgccctttgtagcttgacctttttaagttttgatatacaaaactggttatattaatcattcacaaagaatatttattcttggctttgttgtattatatacattaatctatgtgcaattttcaaagaacatttgcttgctactacagcaattacttcgtcaacttcaaaattattcattcatgtacattagtactactcatttcataatttttgcttcctcgtacttgtcattattagacttcgctttgaaagacttagtctttcaaaattgaacagaatcaatactcattaagtaacctttgagcaagttgtaattttatagatgctttgcatctttgtactagtcaaacgccatgtttgctagatttctccatagaaaggaggtgatccagccgcaggttctcctacggctaccttgttacgacttcaccccaatcgctgaccctaccttaggtcgctgcctccttgcggttagctcacgaactttgggtattgccaactctcatggtgtgacgggcggtgtgtacaaggcccgggaacgtattcaccgcgacattctgattcgcgattactagcaactccagcttcatgtaggcgagtttcagcctacaatccgaactgagatcggttttatagttttgctcactctcgcgaggttgcatctcattgtaccgaccattgtagcacgtgtgtagccctagacataaggggcatgatgatttgacgtcatccccaccttcctcccggttaacccgggcagtctcgctagagtgctcaactaaatggtagcaactaacaataagggttgcgctcgttgcgggacttaacccaacatctcacgacacgagctgacgacaaccatgcaccacctgtcttcctgccaccgaagtggcttcctccattacagagtaattcaggagatgtcaagtctaggtaaggttcttcgcgttgcttcgaattaaaccacatgctccgctgcttgtgcgggcccccgtcaattcctttgagttttaatcttgcgaccgtactccccaggcggaatacttaatgcgttagcggcggcacagaggtcatgacaacccctacacctagtattcatcgtttacggcgtggactaccagggtatctaatcctgtttgctccccacgctttcgagcctcagtgtcagttacagtccagaaaggcgccttcgccactggtattcttcctaatctctacgcatttcaccgctacactaggaattctcctttcctctcctgcactctagatatccagtttggaatgcagcacccaggttaagcccgggtatttcacatcccacttaaatatccacctacgctccctttacgcccagtaaatccggacaacgcttgccacctacgtattaccgcggctgctggcacgtagttagccgtggcttcctccttaggtaccgtcattatcgtccctaaagacagagctttacaatccgaagaccgtcatcactcacgcggcgttgctgcatcagggtttcccccattgtgcaatattccccactgctgcctcccgtaggagtctgggccgtgtctcagtcccaatgtggccgatcaccctctcaggtcggctacgcatcgtcgccttggtgagccgttacctcaccaactagctaatgcgacgcgggtccatctcatagcggattactcctttaattgctgtaccatgcggtactacaatcttatgcggtattaatcttcctttcgaaaggctattcccctctatgaggcaggttacccacgtgttactcacccgtccgccgctaatccactcccgaaggagcttcatcgctcgacttgcatgtgttaagcacgccgccagcgttcgtcctgagccaggatcaaactctcaataaaaagtttaatcttagcttactcaaaataaagaattgctggtttacttaaatgtttatattatattctgttcaattttcaaagaccattttctttcacaactttacgttgttattatgttgtcaccctcaagcgactacttagtatatcacttggtttgacatgtgtcaacaactttttttaaaacttattttgctttattaatttcagcttttatcaagttttaatttgttgtttgccgctctcagcgacgtgttttatagtatcatacatctgattctatatcagcacattataagtcatttaattaatttattcctatatttctttatttttctccatttatctctataatctttcgattgatacgcctggttcgatatactatccataattacatatttatccaatcaatggcctatataccatatattatagttctttttatatttattgttcgatttttgtaattctaaataattagcatttttatataattttatattaatcaccttataaaagttttttctccgtataaatattataaaaattttatttaattattcacatgatcaacatgtttttagctataacaaaaacaaattgtgtataaattgaaccatataaatttatttttttctagaaatttatccattaagtaaatatttattctaaattcttatacaatcgtaccttgaaaagagctatcgctcgattcggtaataaataattaaatgttaaatgataaatttcatttaaaaacatttaaattgtatctaattattcaaatttaattcttcattttatataggaaaataaatctgtaattaattatatttttatacgctaaaaaggatagttatttctaactatccttactcttacctggcggcgtcctactcttccacacagtctcccatgcagtaccatcggcgctatagaccttaactgtcctgttcggaatgggaaggagtgttacctctatgccatcaccaccagatcctagttctttctaaatctatgatttagctaaaagaactgtactcctcagctcgtctgagcgagtttccttattaactttttgaaaaaacttttgttctttcaaaattgcacatagtttttaatgtatttacaactcgattatattggtcaagccctcgacctattagtatcagtcagctaaatacgttaccgcacttacacctctgacctatcaaccttgtagtcttcaaggggtcttactagcttatgctatgggaaatctcatcttgaggtgggcttcacacttagatgctttcagcgtttatcccttcccgacttagctacccagctatgcttctggcgaaacaactggtacaccataggtcagtccatcccggtcctctcgtactaaggacagctcctctcaaatttcctacgcccgcgacggatagggaccgaactgtctcacgacgttctgaacccagctcgcgtgccgctttaatgggcgaacagcccaacccttgggacctacttcagccccaggatgcgacgagccgacatcgaggtgccaaacctccccgtcgatgtgaactcttgggggagatcagcctgttatccccgaggtagcttttatccgttgagcgatggccctcccacgaggtaccaccggatcactaagcccgactttcgtccctgctcgacttgtaggtctcgcagtcaggctcccttatgcctttacactctacgaacgatttccgaccgttctgagggaacctttgggcgcctccgttacattttaggaggcgaccgccccagtcaaactgcccacctaacaatgtcctgtcaccagtttcatggcatccagttagaacttcaatactatcagggtggtatcccaacaacgactccattaaggctgacgccctaatttcccagtctcccacctatcctgtacagacaataccgaaattcaatgctaagctacagtaaagctctacggggtctttccgtccaatcgcgggtagcgagcatcttcactcgcactacaacttcgccggattcacagttgagacagtgcacaagtcattacgccattcgtgcgggtcagaacttacctgacaaggaatttcgctaccttaggaccgttatagttacggccgccgtttactggggcttaagttcacaccttcgcttgcgctaagtgttccccttaaccttccagcaccgggcaggcgtcagcccctatacatcagcttacgctttagcagagacctgtgtttttgttaaacagttgcttgtgcctattctctgcggcctaccaaatggtaggcaccccttctcccgaagttacggggtcaatttgcctagttccttaactgtgattcttccgtcggccttaggattctctcctcatctacctgtgtcggtttgcggtacgggcactacttctctttctagatgcttttcttggaagcatgaaatcagatacttcggttccgtgaaccttccccatcacgccctaggattgttagaacggatttgcctgttctaactccctcaacgcttagaccagcatccaatagctggcacatcctatccttctccgtcacaccatcgataataacgattatagtggtattggaatatcaaccaattgtccatcgactacgcctctcggcctcgccttaggtcccgactaaccctgagaagacaaactttactcaggaaaccttagatattcggcctgtaggattctcacctacatctcgctactaatgccaacattctcactcgtaatcagtccaccgctccttacggtacgacttcagcccgattacgacgctcctctaccgctcatacaaagtatgaacccgtagcttcggtggtaagtttgagccccggacattttcggcgcaggatctcttgactagtgagctattacgcactcttttaatgagtggctgcttctaagccaacatcctagttgtcttagaaatcccacatccttttccacttaacttacactttgggaccttagctgacgatctgggctgtttcccttttgaccatggaacttatctttcatagtctgactgccgtgctgatagtatctggcattcggagtttgataaggttcggtaagcgctatgccccctagcctattcagtgctctacctccagtactcacatttcacgacgctagccctaaagctatttcgaggagaaccagctatatccgagttcgattggaatttctccgctatccacagctcatcccatgctttttcaacagcaacgtggttcggtcctccacgaggttttaccctcgcttcaacctggccatggataggtcacccggtttcgggtctacagcatgcaactagtcgccctattaagactcggtttcccttcggctccgtaccttaagtacttaacctcgctacataccgtaactcgttggctcgttctacaaaaagcacatcatcacacacataaggtgctttgatcggttgtaggcacatggtttcaggttctatttcactcccctcccggggttcttttcacctttccctcacggtactgcttcactatcggtcatcaggtagtatttagccttgggaggtggtcctccctgcttcccacaaggtttcacgtgtctcgtggtactctggtgcagaactgatcattatgacttttacttacaggactattacctcctacggtccaactttccagttgtgttcggttaatcataatttcacgttatgttctgtccgcaaccccagagataaatctctggtttgggctctttccttttcgctcgccgctactaagaaaatcgatttttctttctcttcctctaggtacttagatgtttcagttccctaggtgttccttcataaagctatgtattcactttacgatgcatgaggtttctcatgcgggtttccccattcggaaatctccggatctctggctatgtgcgcctacccgaagcttatcgcagcttatcacgtccttcatcggctcctgatgccaaggcattcaccatgcgccctttgtagcttgacctttttaagttttgatatacaaaactggttatattaatcattcacaaagaatattattcttggctttgttgtattatatacattaatctatgtgcaattttcaaagaacattgaaagacttagtctttcaaaattgaacagaatcaatatcattaagtaacctttgagcaagttgtaatttttatagatgctttgcatctttgtactagtcaaacgccatgtttgctagatttctccatagaaaggaggtgatccagccgcaggttctcctacggctaccttgttacgacttcaccccaatcgctgaccctaccttaggtcgctgcctccttgcggttagctcacgaactttgggtattgccaactctcatggtgtgacgggcggtgtgtacaaggcccgggaacgtattcaccgcgacattctgattcgcgattactagcaactccagcttcatgtaggcgagtttcagcctacaatccgaactgagatcggttttatagttttgctcactctcgcgaggttgcatctcattgtaccgaccattgtagcacgtgtgtagccctagacataaggggcatgatgatttgacgtcatccccaccttcctcccggttaacccgggcagtctcgctagagtgctcaactaaatggtagcaactaacaataagggttgcgctcgttgcgggacttaacccaacatctcacgacacgagctgacgacaaccatgcaccacctgtcttcctgccaccgaagtggcttcctccattacagagtaattcaggagatgtcaagtctaggtaaggttcttcgcgttgcttcgaattaaaccacatgctccgctgcttgtgcgggcccccgtcaattcctttgagttttaatcttgcgaccgtactccccaggcggaatacttaatgcgttagcggcggcacagaggtcatgacaacccctacacctagtattcatcgtttacggcgtggactaccagggtatctaatcctgtttgctccccacgctttcgagcctcagtgtcagttacagtccagaaaggcgccttcgccactggtattcttcctaatctctacgcatttcaccgctacactaggaattctcctttcctctcctgcactctagatatccagtttggaatgcagcacccaggttaagcccgggtatttcacatcccacttaaatatccacctacgctccctttacgcccagtaaatccggacaacgcttgccacctacgtattaccgcggctgctggcacgtagttagccgtggcttcctccttaggtaccgtcattatcgtccctaaagacagagctttacaatccgaagaccgtcatcactcacgcggcgttgctgcatcagggtttcccccattgtgcaatattccccactgctgcctcccgtaggagtctgggccgtgtctcagtcccaatgtggccgatcaccctctcaggtcggctacgcatcgtcgccttggtgagccgttacctcaccaactagctaatgcgacgcgggtccatctcatagcggattactcctttaattgctgtaccatgcggtactacaatcttatgcggtattaatcttcctttcgaaaggctattcccctctatgaggcaggttacccacgtgttactcacccgtccgccgctaatccactcccgaaggagcttcatcgctcgacttgcatgtgttaagcacgccgccagcgttcgtcctgagccaggatcaaactctcaataaaaagtttaatcttagcttactcaaaataaagaattgctggtttacttaaatgtttatattatattctgttcaattttcaaagaccattttctttcacaactttacgttgttattatgttgtcaccctcaagcgacttacttagtatatcacttggtttgacatgtgtcaacaactttttttaaaacttattttgctttattaatttcagcttttatcaagttttaatttgttgtttgccgctctcagcgacgtgttttatagtatcatacatctgattctatatcagcacattataagtcatttaattaatttattcctatatttctttatttttctccatttatctctataatctttcgattgatacgcctggttcgatatacattcataattacatatttatccatcaatgcctatataccatatattatagttctttttatatttattgttcgatttttgtaattctaaataattagcatttttatataattttatattaatcaccttataaaagtttttctccgtataaatattataaaaattttatttaattattcacatgatcaacattttttagctataacaaaaacaaattgtgtataattgaaccatataaatttatttttttctagaaatttatccattaagtaaatatttattctaaattcttatacaatcgtaccttgaaaagagctatcgctcgattcggtaataaataattaaatgttaaatgataaatttcatttaaaaacatttaaattgtatctaattattcaaatttaattcttcattttatataggaaaataaattgtaattaattatatttttatacgctaaaaaggatagttatttctaactatccttactcttacctggcggcgtcctactcttccacacagtctcccatgcagtaccatcggcgctatagaccttaactgtcctgttcggaatgggaaggagtgttacctctatgccatcaccaccagatcctagttctttctaaatctatgatttagctaaaagaactgtactcctcagctcgtctgagcgagtttccttattaactttttgaaaaaacttttgttctttcaaaattgcacatagtttttaatgtatttacaactcgattatattggtcaagccctcgacctattagtatcagtcagctaaatacgttaccgcacttacacctctgacctatcaaccttgtagtcttcaaggggtcttactagcttatgctatgggaaatctcatcttgaggtgggcttcacacttagatgctttcagcgtttatcccttcccgacttagctacccagctatgcttctggcgaaacaactggtacaccataggtcagtccatcccggtcctctcgtactaaggacagctcctctcaaatttcctacgcccgcgacggatagggaccgaactgtctcacgacgttctgaacccagctcgcgtgccgctttaatgggcgaacagcccaacccttgggacctacttcagccccaggatgcgacgagccgacatcgaggtgccaaacctccccgtcgatgtgaactcttgggggagatcagcctgttatccccgaggtagcttttatccgttgagcgatggccctcccacgaggtaccaccggatcactaagcccgactttcgtccctgctcgacttgtaggtctcgcagtcaggctcccttatgcctttacactctacgaacgatttccgaccgttctgagggaacctttgggcgcctccgttacattttaggaggcgaccgccccagtcaaactgcccacctaacaatgtcctgtcaccagtttcatggcatccagttagaacttcaatactatcagggtggtatcccaacaacgactccattaaggctgacgccctaatttcccagtctcccacctatcctgtacagacaataccgaaattcaatgctaagctacagtaaagctctacggggtctttccgtccaatcgcgggtagcgagcatcttcactcgcactacaacttcgccggattcacagttgagacagtgcacaagtcattacgccattcgtgcgggtcagaacttacctgacaaggaatttcgctaccttaggaccgttatagttacggccgccgtttactggggcttaagttcacaccttcgcttgcgctaagtgttccccttaaccttccagcaccgggcaggcgtcagcccctatacatcagcttacgctttagcagagacctgtgtttttgttaaacagttgcttgtgcctattctctgcggcctaccaaatggtaggcaccccttctcccgaagttacggggtcaatttgcctagttccttaactgtgattcttccgtcggccttaggattctctcctcatctacctgtgtcggtttgcggtacgggcactacttctctttctagatgcttttcttggaagcatgaaatcagatacttcggttccgtagaaccttccccatcacgccctaggattgttagaacggatttgcctgttctaactccctcaacgcttagaccagcatccaatagctggcacatcctatccttctccgtcacaccatcgataataacgattatagtggtattggaatatcaaccaattgtccatcgactacgcctctcggcctcgccttaggtcccgactaaccctgagaagacaaactttactcaggaaaccttagatattcggcctgtaggattctcacctacatctcgctactaatgccaacattctcactcgtaatcagtccaccgctccttacggtacgacttcagcccgattacgacgctcctctaccgctcatacaaagtatgaacccgtagcttcggtggtaagtttgagccccggacattttcggcgcaggatctcttgactagtgagctattacgcactcttttaatgagtggctgcttctaagccaacatcctagttgtcttagaaatcccacatccttttccacttaacttacactttgggaccttagctgacgatctgggctgtttcccttttgaccatggaacttatctttcatagtctgactgccgtgctgatagtatctggcattcggagtttgataaggttcggtaagcgctatgccccctagcctattcagtgctctacctccagtactcacatttcacgacgctagccctaaagctatttcgaggagaaccagctatatccgagttcgattggaatttctccgctatccacagctcatcccatgctttttcaacagcaacgtggttcggtcctccacgaggttttaccctcgcttcaacctggccatggataggtcacccggtttcgggtctacagcatgcaactagtcgccctattaagactcggtttcccttcggctccgtaccttaagtacttaacctcgctacataccgtaactcgttggctcgttctacaaaaagcacatcatcacacacataaggtgctttgatcggttgtaggcacatggtttcaggttctatttcactcccctcccggggttcttttcacctttccctcacggtactgcttcactatcggtcatcaggtagtatttagccttgggaggtggtcctccctgcttcccacaaggtttcacgtgtctcgtggtactctggtgcagaactgatcattatgacttttacttacaggactattacctcctacggtccaactttccagttgtgttcggttaatcataatttcacgttatgttctgtccgcaaccccagagataaatctctggtttgggctctttccttttcgctcgccgctactaagaaaatcgatttttctttctcttcctctaggtacttagatgtttcagttccctaggtgttccttcataaagctatgtattcactttacgatgcatgaggtttctcatgcgggtttccccattcggaaatctccggatctctggctatgtgcgcctacccgaagcttatcgcagcttatcacgtccttcatcggctcctgatgccaaggcattcaccatgcgccctttgtagcttgacctttttaagttttgatatacaaaactggttatattaatcattcacaaagaatattattcttggctttgttgtattatatacattaatctatgtgcaattttcaaagaacatttaaagattatttaagttaaatcttatgtagataagagattcgaactcttgaccctcgtcaagcatgctctccaactgagctatacccatatttcttgaaagactagtctttcaaaattgaacagaatcaatactcattaagtaacctttgagcaagttgtaatttttatagatgctttgcatctttgtactagtcaaacgccatgtttgctagatttctccatagaaaggaggtgatccagccgcaggttctcctacggctaccttgttacgacttcaccccaatcgctgaccctaccttaggtcgctgcctccttgcggttagctcacgaactttgggtattgccaactctcatggtgtgacgggcggtgtgtacaaggcccgggaacgtattcaccgcgacattctgattcgcgattactagcaactccagcttcatgtaggcgagtttcagcctacaatccgaactgagatcggttttatagttttgctcactctcgcgaggttgcatctcattgtaccgaccattgtagcacgtgtgtagccctagacataaggggcatgatgatttgacgtcatccccaccttcctcccggttaacccgggcagtctcgctagagtgctcaactaaatggtagcaactaacaataagggttgcgctcgttgcgggacttaacccaacatctcacgacacgagctgacgacaaccatgcaccacctgtcttcctgccaccgaagtggcttcctccattacagagtaattcaggagatgtcaagtctaggtaaggttcttcgcgttgcttcgaattaaaccacatgctccgctgcttgtgcgggcccccgtcaattcctttgagttttaatcttgcgaccgtactccccaggcggaatacttaatgcgttagcggcggcacagaggtcatgacaacccctacacctagtattcatcgtttacggcgtggactaccagggtatctaatcctgtttgctccccacgctttcgagcctcagtgtcagttacagtccagaaaggcgccttcgccactggtattcttcctaatctctacgcatttcaccgctacactaggaattctcctttcctctcctgcactctagatatccagtttggaatgcagcaccaggttaagcccgagtatttcacatcccacttaaatatccacctacgctccctttacgcccagtaaatccggacaacgcttgccacctacgtattaccgcggctgctggcacgtagttagccgtggcttcctccttaggtaccgtcattatcgtccctaaagacagagctttacaatccgaagaccgtcatcactcacgcggcgttgctgcatcagggtttcccccattgtgcaatattccccactgctgcctcccgtaggagtctgggccgtgtctcagtcccaatgtggccgatcaccctctcaggtcggctacgcatcgtcgccttggtgagccgttacctcaccaactagctaatgcgacgcgggtccatctcatagcggattactcctttaattgctgtaccatgcggtactacaatcttatgcggtattaatcttcctttcgaaaggctattcccctctataggcaggttacccacgtgttactcacccgtccgccgctaatccactcccgaaggagcttcatcgctcgacttgcatgtgttaagcacgccgccagcgttcgtcctgagccaggatcaaactctcaataaaaagtttaatcttagcttactcaaaataaagaattgctggtttacttaaatgtttatattatattctgttcaattttcaaagaccattttctttcacaactttacgttgttattatgttgtcaccctcaagcgacttacttagtatatcacttggtttgacatgtgtcaacaactttttttaaaacttattttgctttattaatttcagcttttatcaagttttaattttgttgtttgtcgctctcagcgacgtgttttatcttatcatttaatattcatatatatcaatatatattttgcagaatatataatatataattaaatttctacattttactctaattttctctaatattctcatatggatacgccaggattagttatatacttttttctaatatatatacatttattaatgatacatttcattatggatattcatataactagtatacttttgaataaacatcacactatttaacatattaattaacttaatctgattatgtaccacaaatcaatttgcgcatagtatatatacgcaaaacaaaataaatttccacacttgcttaatttattgcggaaatttattttatatttattcatttattatagagccactaaattacctctactattactagctttaactatcttctctataaagtactttaaaaatcttaaatcctctgttaattctggatgaaatgatgttgctaacatgtttttttgttttacagcaactatattattattaactctacatattatttctacattatctttcacttcaactaccaatggtgctctgataaatacaagttctatttcagcatcacttacttcttctataaccttttttgttctaaaactatctatttgagttccaaaagcatttcttctaatttttatatccattatccctaaatgtcttctacagtcattttctatatcctttgcaagaagtatcatccctgcacaagtcccccacacaggtaatccttctaatattttattttttagtggcttcattaatcctgtaacatttagtaattttcccatagtggtactctcaccacctggaagtattattccatctataacttctaaatcactttcctttttaacttctattggttcatatcctaaaagtttaatttgattaatatgctctataaacccaccttgtaatgataaaacaccaattttcattttaccatcctctttctgcataccttgttaaaacttctttagcatttataccactcatagccccacctaaatcttctgacacctctgcaagttttttaggatcattataataagttgttgctaaaacaatagcccttgctcttttttctggattatcagatttaaatatacccgatccaacaaaaactccatcacatccaagttgcatcattaaagctgcatctgctggagttgctattccacctgctgcaaaattaaccacaggaagttttccatttttccacacatatttaactaaatcatatggtgctccatgatttttagccattgtcataagctcttcctttgacgccttttgaatatccttaatctgttctgtcattgttctcatatgagtaacagcattaacaacatctccagtaccagcttctcctttagttctaatcattgatgcaccttcaccaattcttcttaaagcttctccaatgtttgtggcaccacatacaaatggcactttaaaactctccttatctatatgatacttatcatctgccggtgtaagaacttcactttcatcaataaaatcaatatttaaagcttctaatatttgagcttcaacaaaatgccctattcttaccttagccataacaggtattgatactgcatcttgaatttcttttatcattttaggatctgacattcttgcaactccgccttcttttctaatatcagaaggaactctttcaagagccataactgcacaagccccagctctttctgcaattattgcctcttccttatttgttacatccattattaccccgccctttaacatttgagcaagatttttatttactaattctctttccattaatatagcccccttttgttttaatacaaatatattaatatatatatccatacatttcaaatgtatccatacaattgaagtatatacatacaatatccattatctaattaaatcttacgagctccaatgattgaattgatatttttaaaagttgcactttaatttaaataaaaataataaaacggcccacattaagcatgaaccgttttattgttctatttgcatatattctacctaataaaatatattattatcgactataaattttcccctcttgtttcaataacttttttataccagtggaaagatagttttttctttctatcataattatttttatgatctacatatataaacccatattgcttcttatatccatttaaccagcttaataaatctataactgaccaagcataatatccctttaaatttattccttcacttatagctgctttcactacttttaaatgttcctctataaacttaattctaggaatatctacaatttcatcctctattataggatcttcatctcctaatccattttcagtaatatataactttacatcaccgtatctagctttaagcattctcaacccatctaaaaatccttgtggagagatttcccaaccccattttgtataaaccttatcttccatcataacagtcttataaaaaccatcaaaagaaggattccctggtgctccagtagaattttctctagaagcaactaattgctgaccatctgtatttttcattattctttgaggctgatagtaattcaaacctataaaatcatttttatcagcagtattcttcaataattctaattcttcattagtccaatcaggcactaagttcttttcttttaataattctactacatattctggatattcaccctttaatataggatcataataccaatatgtatcataataatttgcatgttcagttgctgcaatattttcttctttattatcaaaactatatgccggattaaaaacatgtgttattccaatttctccatactgttttagattcttatatatctctacacattttgcatgtgctacaaatacattgtgggtagcttgaaaatacttcttttgatcatttaccaaaccaggtggatgtgctccagtaatatatcccgatttacaaaacactatcgcttcattgaatgttatccaatgcttaactctatcaccaaaagccttaaaacatgcttctgcatatttaacaaatccattgatagtccttttattagtccaaccaccttgttcttctaacacttgtggcatgtcccaatgatataatgttacaaaaggtactatgccatattttaaacattcattaattaagttgttataaaactcaagtccctttttatttatctctccatctccatctggtattatcctaggccatgatactgaaaatctatatgattctaatcccatttcagccattaacttaatatcttctttatatcggttgtaatgatcaaccgctacatctccatttgttccttcaaatgtcttgcctggtatttttgaaaatacatcccagttgctaatcccctttccgtctttatcccatgcaccttctacttgatacgctgcagatgctgctccaaagaggaaatcgtttgcaaatttcatatgtaatcccccttaccttttcttttgaatgttattttattaatatctacatctaaacatagatttatttcttttaaatttattggtatgaatatagtatatactaataaatccacgttgtaaatgttttcttaaattttaaattatactttgtaaaacagttggactaaggagctttatctttctataattatatctttctattgatacgtcaaaaataactcctgtacttaaaaatacagtattctcaagctgtaatgttggttctcctttttcaacttctaaaagttcgcactcctcatcagttaatacatcacaacttataatcttatctgcaaaacctatatttaatttcagatcatttgtaatataattaaatatagaagaacggcaaatttcttcatttagatatggaattatttctttgttataaaaagattcctctacctcaataggttctccatttacatatcttactctcttaatatgataaatttttgtatttagagcacatttaaatttttctgctaatttttcatctgcatcaataattgaaaattcaataatcttgctttctatgcgcttatcatcaaactcttttgtaagtccattcatttcttgaagagaaacgcacttccccttttgcgaatcccttaaaaatattccactaccttgaacttgatatacatatccatgattaaccaaaatttcaatagcctttcttattgtgtttctactaacactgaatatattcataagttcatcttccgtagggagttttttatctttatcgtatactccatcttttatattattcattaatttgttaataactatttcgtatttagttgtcactttacccctcctattcttttaatcaataataattatattttaatacattatttatttaatacaatatttattgtattaaatatacccaattaattctatatttttatatttaataaggccacttcttactaaaatcatctttttgtacgaagtagccttattttaacttattaaattctattgattttgagctgcttgttcattcttatagttcatactatcaactttcttaaagaatgggaagtatattgcagttgatattgctattacaactacttggaataaagcagttctccatccacctgttaagaatccacttattattggtggtgtagtccaaggtactacaacccctgtatataatggaattaatcctgttgctattgcaaaatattgaagtacaccaattgttactggagttaatataaatggtatagccataaatggattcattactattggagtaccaaagatgactggttcattaatattaaagcatgctggaactacagctaattttcctaattgcttagattgagctgatttagctaagaataacatacatataacaagaccaatagttgcacctgaacctgaaagattaactacacaatctttaaattgttgagttactatacgtccaccattttctattgttaaagccattcctgaatctaaaatgttttggtttgctgttgcatttgaaattaagataccatccattactccacctattatagtagaaccatgaactccaaaccaccataagaaaggaattaagaaacacattacaataactccacctaatgaatcagataacccttgaagaggtgtttgtataactttatatatccattcgataaatgttgtattcattccatatttaaatatagtgtacactactgtagcaccaacaatcattactgcccctggaattaaagctgagaaagagttagcaactccttgtggaactccagctggcatctttattcttatatctttcttcataaaccaagaatatattgcccctactaataaacctataataatagcagtaaccattccttctccaccagtccaagcctttggaataacattctctgctatttcacctgattcaagtgttacataagaattagttgttaaaagaaatattacaagtgatataattcctgctgataaaggttcatgcccttcatttttagcatatgtatatgcaatacctattgccgctactaaagcaattatcttaaacgatgcgccatatgcttgcattaatggctctgtccaattcgctcctaatgtactagccatccaatcattgaatggttgatatggtatttgagctagtaataaaaacactgaaccaattagtgttaatggtaaaataaatagaatcccatcttttaatgcaataactggttttaagtttacaaatttcattacttgcggtataagcttttgacttaatgtattgccgattgacataataattccccctataatataagttaacttttgttgaaagatttgatataatataggtaataataatctcgtaaattattattactgaaaaattccatgcaattttcaaagcaaattcataatgtaattgcatggaatctttattaaacgttttcttaaaatatactattaactattttgctaaatttaaagcaaaatctaaaactttttctccattcatcattccatagtcaaccattggtataacatcaactggaaccccttttgctccacacacttcttttgcattagctaatctgtatcctacttgtggtccaagtaatgcaacatttacaccatctaaatgtttatccatttgtccttctggaaacgctgcaatatctgcttctattcctctctttgttgcactttctttcattttatttactaataagcttgttgacatccctgctgcacaaaataatctaatagttaccataataaattcctcctaaatactcttatatttttgttatcgtttactttatctttataaatttacgtattatttattaattaatgtatttacaatttttcttaagtctataatttgtgtaattaaattcttttcagtaattgctgtcattaaatggtcttgagcgtgtacaaatagtactgaaaaatctacactctcaccagctgcttctttttgaaggaaagtagtctgtccatcatgtgcttttgccattgcatcttctgctaactgcatttctttatcagcttcttcataatttccgtcatttacatgatttaaagctgcatatgcatgatttttacaatccccagcattaattataatattcattatcgccatttctaattcttgcatgtttcttccccttttcatattttctatatttcatatttaataattctaattcgttggtatgaatttattatataccaatatttcctctttgtaaatgttttcttataactttttctatatttttttattcgttttgttgatttatttatctaatcctagtgtctatcaagtttaaaagatattctcttccaaatatataaatataaaaaataatacccatgttataattttgaaaattataacatgggtatgcctatatacaaacacttatatatcttttaaacttaccttttgctacgtgtccagtatcaatgatgttaaaaccagatttctttattacttcactcatgtcttcaaatgttactattactaatctatttgttattctacgtgctgaatttattatagcaacttgctcttctttagtaattggtgtaaaaagaccgtatggcatatctattatagcaacatcaaatttgtcctttatagttgtcatattaccatttacaattacattatcatatccaaaaaactcaaggtttttttgtgcattttcagctatattatcgttgatttcccatccacaagcattaattcccatagataaagcctctattataacagttcctatcccacaacatggatctataaatttttgatttatattatttcctactgatatgttaactaaagctctggctactcttaagcttagagaattagaatatgaataaggttttttatcatgtatatgccacttaaaatcatttctataatattctccaaatatccatttatcgccaaccttacttaatccaaaaatgatttctggattatggatatctgcctcaccttttattatatatcctatttcttttatactatttattctctctttataaccaaccgtattatcttcgcttttcataaaacatactttgaaattttcataagcaagattatcagatttaatatttaataatatttcttctattgaattttccacatattttatttttataacttcctttataaaaggactcctagatggattaatatatttatttgcaaagaattgttttttaaatggtttcatattgaaaaacgaatccatctccatcatgcacaactcctcttcaaactccctattataatttattatgtaaaagtattttccaaattctttttcttctttaacgtcaccactattcaaacttcatacctcttttttacttatattaatcctattataccaaaacttaatttttttactcagttaatattcactcactatctataatcaaaattatttaaacaatacttactttaattacttcgagtaaaaaattatactccttttatatgagacaatataatctgatataaaaggagtatagaaaaagttatttattttcttcaataatcttttttaatttattttgaactaaccaaagctttttttgctttctattgtatgcaactaatttattcttattagatttgctttcatccattattcttatatattctgaatctgcaattttcaatgcatcttctattactaaaagttcttccttagtaaacatatatatctcctccatttactaaatcttaaattccaatatattatatcacatatttacaaacagttaatacattctatttcttactataagcctatatatgtatttattattatgttgtttctctaatatttgattatattttaaatgaagataatatgtacttataaattttacttaaaaatataagtctaatagttcttttatagactattgaaatattccattatgaagccatatatgatttaattcatcaccagcacaatttaaattatttctttctctaacaaatttacctgggattccagcaactaatgaatttacttctacatttttatctattattgctccagcagccactatagcttgcttttctatttttacacctggaagaatcgttgctctacagcatatctttgcataatcttctattataactggactatatgttctttcttcatgattatcctctgaatgagaatgagtaaatatcattactccttctgttaatgctacagaatcacctaatttaactccaccttttgaatctatgtacacatctctatttaagaatacgttatctccaacttcaatattatctggaacattaaatcttacattttcttctgcaataaaattttcaccacatgatttaaatagtttttttgctaaaattcttctatataaaattgaaaaattagcaactaaacacattggagatttatctaatacatcccataaaaaatgtaggtatcttttttcatcagatactcctatttcattgtttttaggaagataatctccataaagcttcatttcatctaataatttaacaggaaatgaaatctctaataaatttaatattgatgatacaccatctttagtcagacccgtatctattatatctgttatctgacttaataatttttctaattcactcatccccaataactatagttacacttggtaactatatacctccttttcttttctaaatttaatacagttattattactgcattaaataatatttccaaactattatattattgcactttaaattataaatttcaacaataatctatatttttccatataattgttatcattttctcaatatgtgttatttataaatgcaaaagaaccatcacttatttttaaccttctagatgattcttcttcatgatatgtagcagtatatgtgttatttaaaaaaagcttgtaactcttccttttctaatataattaaccgctctcattttaaatctttctaattcttttgaattataaaaattaagtaaatctatagataaaaataaaccgtctactatagagtatttaacatcctttaaaaataatccttcttcttcttccttttcacaaatatcagtgtcattcataagtttttcaaatttcatttttccatctacaagtttatttacaatttcatcttctttaaaattagtaaaatccttatttagaagttcattaacaaaatctacgtattgcttatttactttaatatactcttcaaatatactagataacattatagttcctccctttaattataatttatatataaaaagctggaagttatccagccttgatttatgtaatattatatttttttaacaaattcagattttaagctcattgctccaaatccatcaatcttacaatcaatattatgatcgccatctactaaacgtatatttttaacttttgtacccttttttaatgcagaagaagcacctttaactttaagatcttttattattgttacagagtctccatcttttaaaacatttccatttgaatcttttacaattaattcatcactattttcattttcacttcctggagcccattcatgagcacattctgggcaaactaaaaaacttccatcttcataagtatattctgaattacattttgggcaacttggtaatttatccataatttcatttcctccattcgtttatatctataagttttacattatatattctgtacactatatagtatcataatcataaaatattaacaaatatcatgaataacagtcccttaacaaacctaaaatacttatatttcaaataaatatgctaataaataaaaagtgctgaaaaatcagcactttttatttattatatgtatcttttgtgtttatgattatataaacaatttgactattaaaataattacccctgagaatacagctgttattggaattgttaaaacccaagcccaaactatttgttttgctactccccattttacattcttaattcttttagatgcaccaacacccattatgcttgttgttattatatgagttgtacttactggtgcatgaaataatgttgcacacaatattacaaatgctgctccagtctgggctgcaaaaccattaacaggagtcaattttgccattccactacccatagttttaattatttttttaccacctatagaagttccaagagccatcgataaagcacaaaggaaaattacccatacaggtacttcaaagctacttattaatccgccactcaatagtgccatcgttattattcccatagacttttgagcatcatttcctccatgattaagcgccataaatgcaccagctaatacctgtaacttcaaaaacagcttgtttacaaccgatctcttatgtgattttaaaatacaatttagtattaacattaatatatatccaactataaatcctattaatggagaaagaattaaccacaaaattacactatgaaaaagattgtaccaattaacaacatcaaaagtcatagtatatgctattccacctccaataagcgctcctattaacgcatgagatgaactacttggtattccaaaataccatgttaataggttccaaattatagatgaaattaatacacacataattacccattgtggtattgatgtatgactaactatattgtcccctacagttttagcaactgctgttcccatgaaagcaccaataaaattacatatacagcatattattatagcttgtttaggagttaatgcctttgttgttattgatgtagcaacagctgtagctgtatcatgaaatccatttataaaatcaaatgctaatgcaagaaatactattaatattgttattattaatgaactatgcatttttaattacaactctttctactatatttgctacctgttcacatttatctactacattttctaatatctgatatatttccttccacttcatgatttctataggattttcttcgcacttaaataatttttgaacagtctttctaaatatttcatcagctttactttccattttacttatgctaattattttttcatttatattttttgatctacacccatgtatttttaattcattcattaatgccataagctcttgtgtaacttgtactaagatatcacatacacattccaattcatctgtgctttctcttatatcaaacattataaatctgtgaacaagggaatttattaaatctaaaatattatccatttcttttacaatttcatatacatcttctctgtctataggtgttataaatgcatcgtctagttccttaattaaagtacgaactaagtcatcgcccatattttctaactctgcgatctttttcatccattcctctgtaacgtctagacatttcaaatcattttttaattctacagctgcttcattaacaatttcagctgattttaataacatgttgaaaaacttatcttctttcctattattaaacattaattcatctcctatactattctaaaaaatattagatattattccccaaataattatattacttttgttaatattttttaaactatttttaacaaaagtttataaatttaacatggatttaataatagctgtaatgaaatggcaatatcatttacctcttttatatatgaaaaatggaaaacttacttacttcatttgataaaaagttcaacttaaaaaggataaaatttgatttttcaacttttaaattactatattttgagacatatctttcgaaaaaagcaaaaaaatagtagctccaagttaaattggaaaactactaatttttaagtactattctaattataataatttcataagagctatacttattgtctcttacattattatattaattattcattatgagttagtttaagaattatttcttcatattgaggatatttttctaacaagaagcttcttttaaataactcaaagtctctaaattcaaatcctggtgagaccatacagccaactaatgcataaccttcattattcatagcagaaccaaatatataatcttttggaactaatacttgaggtttttcaccattttcaatattaagaccaagctgttctgttataaattcgccttcagggctaatcatataaatagttaatggtgatcctgaatgataataccacatttcatcagattttaacctatgaaaattagaaacctcaccatctctaagcaagaaatatatactagtccaaagtattcttgacccctcaaagttaacttttaaatcttttgatgttatattctcttctgatgaataaatttctttataaaatccaccttctggatgtgctatcatatttaagtttttcacaaaataatctgctgtatacatatggatactcctttcaaattgctttaatttgttgttgttacttatagaaaaaatctagtgatactagttgcctaaacaactactaccgtatatattcacctattctcatttatttatggtacggttctccgtaacagtagcaagtgaggtttttttatttcttcttaaaagttttccaatataaccaccccattattaaaacacaaattacagcaccaacacaaagctcttcccctccatacttttgatatatattatatataattggtgaaatactaatcacaccaattataggcgctacgatattaattataaatagatttttatttaacctacttacattattctctttcctagtagaaccaatagcttctactatttgaatagtatagtcatagttattttgaatttgttctattagtctagcaattatataggttctatctactttttttattattatttttttattatttgctaaagttagatttccatgtttattaacaagctttctgaaatccttaattccatccttacttgtattgctacatataatttcataatttattactttatcctcatctatacttcgtatcaaagaatgtttaatattatccctatctctcataataacataattaatgtcatctagtttataagctttaattagattttcattgaattctcttcttttagttcttataaattcaagtgattctacaatcaattcttgaatttcttcacttaactttatgctttctactataacttcatataacacttcaaatccttcattaaactcaatattactttcatcaaatactgtatctacagaaacctcatcataatgttcttttgaatgtttattagataatttttcttctattttaatatattttttatttaatatacttatagactcaacatattcatccatagttgtattattgtcattacaattatatttagaatcaagcgtgacaaatccatcaaaaatttcttttatagagtttacaagatagtaatcttctcttaatctttgatgaatcctccaaaaatcccttattacatctattttttcatgattctcatgaataacttccattctgccatcccctttttctaatatatttaatatttgtttaatcatattatacagtattaaatatagctcatctatatagcaatatctaagctcaatacattcattccaatatttcttaacataaaagaagaaggaatatcctttatagatactccttcttctttatttagatattctactaggctattatttatctttagctttatagaatctacttctcttaattcatttattgttatttctgatattatcatatgaaacaatttcttctgttgctctcttgttgcacttcctgttaatactttactgaaattctctagcatactatttatgaattcatacggtatttcttcacttacataatctgaaagtgtaattagaaatggttccttctcatcttgaatactttttgctcttttatttagctcatcttttctttattctatatagttatattaatttatcttatttatgatacggtgttttcaaccataaaacagccctaaccaagtaatttcaacggttaatactaaaaacctcatttacttatgatacggttctccgtatcttactcaagtaataacattatttatctcactaatccctatcatacgcgattgcattagcagaatttaatgatttttttaactcttgtaatttcttctcatcttctttactactatcaccttgattaattttagcttgaagtagttctatttgtttttcatactctttagctgtattcatattattttgcctggtttcttgatctctcttcatactatattcagaactaagtttatttatattttttgtcatttttattttacctctcttcataaataattttatatatacttgtacatgcatttcactaataatattaccttaatataaatcattattcagtacgttttttcacaagtttatatacaaagtcttatattcataggacttatcctaatttttttatacaagtaaaaaagaagaactacttctatctggtttttagtttttctacattactgcaatataacattaagttataatcactattgatctatattactttatatagcataaaagttctttaactaagatatcaacagatgttcctggattcatatccgatgccttattctgtttttgatttttgtaatactcacgtaatttttcacttctacgtattgcataatcaactttatctaaagttatatcaaatatattttttatattcttgttatatgttccatcatttatattattatcttttagatgtttactcaaattgctaatatattgtcctcttgttataggtgtatttaaatcttgaaaatgcagtaatatccataactcaaaactttcattagaccatgcaacttttatgtcattatcctcagctaacttaattgcatcatcaaaatcagtgttatcatctttatcaaaaacaacccaaacttcactaaaactttctctatttttcttttttatagcttcattaactagtacacttgtacttcttgctttcccctctactttcataggataattatcttgtatttctcttcttctatatctactattgataatacttttaatattttcaaaatagtttacttcagtttcagttccttctgttaatattaaacatgtagctggtttttcatctctagtatcagttcttctcgattttcttcttccttctctacctaacctactcattttcattttctccgataatatcaaataaatttagtataggtattgccccatattttcctgctaaataatccttattataactagcatcatttctcacctttttatcttttaatctatactcagctaatgaatataaattagcaactgcattaatatctttctcaacgaaccatatttgatctcttctaaatatatctttatttagtgtatactcatcatgtgcagtgtaaattaattgagcaccatttttatttatttgctcatcatggaatatacttaatatatatttaattaacaacggatgtaatttagcatctaattcatcaataaatatgggcatacctaattctatagcatttttaaataatccatataatgcaaacattttttgtgttccacttgattcttcataaaacggtattcctactaactcatcacttccctctatcttatgatatgaaaatattctatacttattattttcgccttcaatattaattttctcaacttttatatcaactatatttatatcaatcgcatttaaaaacttaaccaattctttctggtaatttctattttcaattcttgatgatacgcctcttgtaataagtccttctatttcacaatctcccatatcaacaatagtagtattattaaaccactccattatctctttaacatatggaatcttagcatttgcacaaattgataaaaatagagtattatcttctgttattgtagctaaactattagcttctttcaactgtgactcgcattctatttttcttccatctctttcgaataatggcttgtactttacaacctttttacttctaaaatctcgcttatataaccattcctctataattcttttattatctaatttaaatccatattgatactcatcttgtttatatttaataaatacttcaaattctgcaggttcttgttttgaattattatcaaaggcaaatctttttaacggtatatcaatgttacttgttgaatatttaaatgattttattacaaaatcagccataaatccaaatgcctctataactgtactttttccacttgcatttgcaccatatatagctgcaattttaagtatcttctcaccattaatattaattaaattatatttatgctcctttaatgccgtagcagtcatatctaatgttgtatcatatttaaatcctttataatttttaaaattgaattgaatcagcatatttctcacctcttactatattttattatttatcaatgcttttgtgaatacattttgagattttttctcatatttaattctatccactattcaaagtaaatattcattaattaaaattattattacttatgctatggtatttcagatcataaaaataaccttaaccaaataaattcaatgattaaggctacttttctcctttatttatgatacggttccccattacttattctaaaagctctataaatctgttctaaaagcattactctaaataactgatgtggaaaagtcatcttactaaagcaaagactataattagctctctttaatacagcatcgcttaatccaaggcttcctcctataacaaaacataaattactatctcctcttactccacaggtatctataaacttagatagctcttctgatgacaacatcttgcctttaagatctagagtaataacaaacatagtatcctttattgaatttaaaatcttttgtccttctttatcctttattattaactcatccttttctgatgcattatcaggtgtctgctcatcggacaattctattatatttagtttacagtaacgtgataatctttttgaatactcatctattgctagtttcaaatatttttctttaagttttcctactgaaataatcgttatgttcatatttaaacacattctccttgcctttttgtttataagtttaatttattaatactatctttccttagtctataaatactatttccaacttccatttccctggaaattaattcttgtactttatattcatatcaagagatctttacaattatttgagatgcacaaaaaagccctaccttaaaagtaggactttcttatgtatcagaaatattactttccttgtccgcaacatttcttatattttttaccgcttccacatgggcatacgtcgtttctaccaactttatctaagtttctaactatcttagattctttgtattgcttttggatttcttctctcttttcttcagagaatattccatcccattgtggtaatgtatataaatattctgctttagcatctaacatgttgtagtataaagtttctaaattaatatctaattctaactttgaatcagcttcaagagtttctaaatcgtattggttctttaagctgtcattgattccatcaatgaatcccatgataaattctattgttgaatcgtattcttttgctaaatcatttatagtagttgttttaacagtcttatgatttgctaataaatccttgtatatagccttctctaatttgctgtattctgcccagaaagcattttctcccttagttttcacatagtcaacaaccatgtcagtccattgtgtatataaactcattataaagtcctcccttaaatttcatatttataatagtattttaaattatactctaaactaaatttttatgtagctactaggattatgcctatttgccatagttaatattatgtcttcattgttcttaattccattatcatttaagacatctaatactgttgcatatgctaaatctggttgattattagtattactcaaatgccctaaaataatctttttattatttccacatttaacaagttctacaatagcattaccgcagtcatcattagataaatggccaatttcacttaatattctacgtttaagctgataaggataagggccaaatttcagcatatttacatcatgattactttccaaaagaataacttcagagtcttttacattatcatatatctctcttgtgaatgtaccaaaatctgtagcaacacttatatttttctttccatcactaacagtatatcccatagggcctgctgcatcatgaggaatattaaaagctttaatatttaaatcaccgatttctgtaacagatcttttatcgattactttaatattatgttctttaatttttccaagtgagccttccatggcactccaagtatctccatttgcatatataggtatatcgtattttcgtgatattactcctacacctttaatatgatcactatgctcatgagttataaagattccatcaatattctttgtttcttcatcaatcgcctttagcgcctcatcgatttttttaccagggagtcctgcatcgattaatatcttagctctatctgaggtaataaacatactgtttccactactaccactgtataaggaacaaaataccatcagttcccttcccccttacattttctctattcttctacttcaattcttcttatattagcacctagagctctaaacttatcttctatatgagggtatcctctgtctatatgctctatacttgttatctcagtttctccttcagcaactaatccggctataaccatagcagctcctgctcttaaatcagtcgctttaactatagcacctgttaatctgtttacaccatcaattatagctactctgccttcaactttgatatttgcacccatcttctttaattcatcaatatgtttatgtctattttcccatatggattctgtaatcaagcttctgcctggaacaatacttaataaagtagacattggctgttgaatatctgtagggaaacctggatatggtgttgtttttatgttaacaccttttagtggcttatctacagtgactcttatagaatcatcattttcttctactgttacgcccatttctattaatttagccgaaatcgattctaaatgttttggtataacgtttcttatataaacatctccacctgtagcggctgctgcaatcataaatgttcctgcttcaatttgatcaggtattacactataagcacacccttgaagcgattcaacacctttaattctaattacatcagttcctgcgcctctaatatcagcacccattgaatttaggaaattagctacatcaacaacgtgtggctcttttgcaacattttcaagtgtggtaattccttctgcaagtgttgctgcaatcattacattgattgtggcacctacagaaactacatcaaaaaatatatttgcaccaataagtctatccgctttaacattaactgcaccatgttctattgttacgtctgctcctagagcttcaaacccttttatatgttggtctattggtctcacacctattgaacatccacctggaagaactactcttgctcttttaaatcttgataataacgcacctatgaagtagtatgaagctctcattcttcttacatcttctgtacatgcatcgaaattgtctacatttgcgctgtctatttctaaagtgttattatctattttgttaatattacaacctaagcttctgagtattctttctaagcagtgtacatcttcaatatctggtatgttatcaattatgcatttgcccttacttgccattattgctgctggtaaaattgctactgctgcatttttagcaccatttatatcaacagatcctttgagcaagtatcctccgtttataactaatctttccattgaattcaccctatctataaaatatatcctatctaaaatttatttatctaaactaatctattaaaactaatatcttttattgtatataaaatcccatttacgtctatatataaaatatacatattatttatatttattttaaaacaaatatttaattaaacgttaaaaatttgctattattaaaatctaccttaattattatatcataaactaaatttatttaaacacattttttcagtcaagcactacttttttaagcatttatgagatttctacgaatttacatatacattacaatattcttattttatttacatgttatttttagaaaaaacatccttattttttgttaaatattatattattttacatttttattatttgcattcaaaatttaattattcctatattcttttattttctctaatatgttataatttattaaacttcgattaatactaattaaagattgtgaggggtatcatgaagtattatgtagttgcattatttgacgaagatacttatcaaataattgcgccaattcaacgaaatatgtcaaaaaagtttagagcaaataggaattctcctgctccatacataccactagctattattgataatccaaatttagataaattaaatcctatattaaataaaataatttcaccttataagagtttcagaattgatgctaatgacttagtttatttatctgaaccaacaaaaactgttaatttaaagttagataataaaggttatataaaaagactttctcgctctatttgcgatacattatctttacatggctttaacattaagactttaggtgaaaactttatatctcttgcaaatttaggttacatacctaaagattacaaaaagcaagatgttaaattaaatttccctgatatttattgtgacagtaatatcgtaaaacttagaataaaaagtattgaaatatggaaacttccaacggtgaaaaagaacacacctgttcaatcatatcctttaaaaagtttttaattaacaatttgacaactatttataacttaattgttaaggattactacattattaaatctaaatgtttttaataatgtagtaatccttattttaatttttgaaattttttaaaaattaaatatttttaaaaaatttatttgtattcgtttactgcactttcatttattttaaagattttgtaaaatagtattaattgttaaaattgtaggaggatgtgcaatgaatgttcaaccaatgtttgaaatacaaaaaaggtttaataatactctaagtatcaatacagaattggattcttacaaattaagggctcgaaaaaatttactattccaaattactcttggtgagttagctaacgaaacaatttgctttaactttttattgaaaacaccaaaaaccatagatttaaataagattttcaataaatttatagtctgtatttctcaagttttaacattaggaattgattatagatatgataaaataaactctatagatatgattccaaacgattattgcttaagtgatcaatttttgaatttatatatagatattaatgatttaattgcttcaccatctatggatcattatcaaactttatttgaagatttattaagtctaggattaacattaggtttttctgaagatgaaatctcaggtcagtttgaaaaagatttagatttaatctcagtataattacataaatatacttaaaagagttatctttgtttgaataaaaaaattcttacataaaagcatagctcttttttatttatttttaattatgtaacctgtattattaataataatttataacttcggggaataatatctttgaggtgataatatgttaggcataatatgtgcaataatttctggaatagcaatgagcatacaaggtgtgttcaatactcgtttaggagaaaaaataggtttatgggaaactacagtcctagttcaagcaatcgctttaatatgttctctaataatatcatttttttatggtgatggaagctacagtaatttaaagacggctaataaactctatcttctaggggagtgctaggtgttataataacttttaccgtaataaaaagcgttggaagtatgggaccgactcttggaataggaataattctagttgctcagttacttgcagctgctttgattgatgcctttgggttatttggaaacgaaaagattaagttttcattaaataacttcataggtattgctattatgattattggtattgtaatatttaaatggaaacattgagaaaggatgtataattttgaatatattttctaatgccatttttttatacaatttaactgtcaataatataaaagaatattttaaaaagagttcttctataaaatctgatgaattaataacaaactctgttaattggtttggtcatgctacaactataattaatttatataataaggtaattataactgacccagtattatgcaacttactcggttattttaaaagagttgtagaaaaaccttcatatataaaggatttaaatatagattacatacttttatctcatggccacatggatcatcttcactttccttctcttatgaagcttaataaaagtgcaattgttatagcacctaaaggatataaaaaactcttaaaacttattggttttaaaaatgttgttatactgcatccaggtgatgtgtatgaagacagctttataaaaataactgcatttgaagccaatcatgatggaagacgtttttattttggtatagatgatgaaagcatatcttatcttattgaaagagaagataaatctgttttttttgctggagataccgcattaactgaaaattttaaaggtattcaatgcgatattgctttaatgcctgttggctgctataaacctgatagattttcatatatgcattgtactccagaacagagttacgaaatgtttaaaatgatgaactctcctattatgattcctattcactataaaacattcagaatatctttagagaacttcaacgaaacagaagaaatattattaaacttaaatgataattcaataaagcttcttgatgttggagaaacttttagtttttaaaatctatttattctcattaacaatattactcttctccgtataatatatattaaagcaaaaattatcggagaatgagtatgttttcaaataaaaacaaattagattacaatttaaagtactacatgtccaaaaatatttataaatcttatcgagtactcattaaatataaagactttcaatcttcaattgcgaaaaaaatcaattcctacaagggaaatgtatatcatataatagaatcttctaatattataagcgctcagcttaatggacgaagcattgagagaataattgaatatcctgaaatagaagaaatatttcttgatgaatacttatttttatgtggtatgagtgtagcttctgccaataaatctacttatattgaaaaaactaatttatctggctcaggaattggtattggagttgtagatagcggtgtatatcctcataaagatttaacttccccaacaaataaaatttcactttttgaagatttaataaacgatatacaatatccatatgatgataacggacatggtacttctgtaagtggaattttgtgtagtagcggattttcttctaataatatgtacaaaggcatttgcccaaaaagtaagctttattgttataaagcctttgacaaactcggtaagggatttgcttctgatgtacttttcgcaattgaaagtcttattaatctaaatctatctgaagaacataacataaagatattgtgtcttccttttgagcttttaagtcataatgtctttataacaaatgcatttgaaaaattatttgatcgcgctatagaaaatggtatgattcctatagtttctgcgggaagcagtcttaatagtaaatattcagttatgggaattgctacattgcaaaactgcattactgtaggcggtctggatactacaaaatcaattattaaaccttatccttattctgcatgtggcccattatctaaatatgacaaaccagatttatgtgcctcatgcgtaaatatcgtatctctaaattgtgataaaaattatatttctgaaaagaatggaatcaaactttatccaaaacaacttgatgtatcatataagacatttacaggctcttcattagcaacagcttatatttctggaatatgtgcattaatctgcgaaaaaaatcctaacatcatgtttaaagatatgcattcacttttacaagttgcttgtaattccattgatgatatccctaaatatattcaaggtgatggtgttattaattttaaaaaacttataacctaattttcttttatatgtgcacttcttatatacagagtcattttttgattaaaaagattctgtatactttttttaatttaggagttaattatttattatgctataattataatactcatagattaaggctttaaatttctgtcacctataattgacttaacatatacgataaaattgaaaggtaggtagcaaataaaatgagtacattcatgttaaaaagtaaatctgtaggatttactcctgtaagcaatatttttattgaaaaatatatgactcaagctagaggcgaatttataaaaatttacttattgatgttgaaatataatgtttctggtgaattaggcgtaagctcatcaatattagcctcctctctaaatttacttgaatctgatataatgaatgcattacattattggaatgatttaggtgttattaaattaacatctatagataaaatgggaaactttaatattgaatttttagagttagccgatgaagttaaatctccagcgaagcaaatcgatttattagaggcattggatagcaataatacaaaagatatgcttaaagatatagaagttctcctaggaagacctctctctccaaacgaaatgtcactttatttaaactggcaacacgaatttggtttttcatctgaattaatattaatcttaatagaatactgtgtttcaaaaggaaaaagtgatcacagatatattgaaaaagttgctttagcttggcatgatcaaaaaatatcaactgttgaacaggctcaaaatcttattaagaaaactgaggataaatggattaacataagaaaaattctatcttatcttggtatcactaatacagatataatgaagccacaacaggatatgattgaaaaatggatattaacttttaaatttccaaatgaaattattttcaaagcatgcgatgtatgctttgaaagattaaatagagctgattttaaatatatcgatggaattctttcaaactggaacaaaaataacataagaactcttgatgatatagcattaaaagataataaaacaactcaaaattcatcttttaaaaagaattcatacaataataacacacaaaactcaaaggttcctcataagtttaataactttgaaccaagacaatatgattatgactctttagaaaagaaattattaggatgggataatgatgattaaaggatatcaaagtgaaattttaaaaatatacgataatattagagataaagaatcaaaagcactaaagaacagaaaagctgaaattgctgataaatatcctgaaattatggaacttgataatcaaatacaaaaactttccttaaaaatggctttatctgttattaaagctaatgatgaaggaaaaaccttaaatgactttaaagaaaatataacagatttaagaatgaagaaatgtgaaatgcttgtagaaagaggatattctcctgaatatctcaatatgcattatcattgtactaaatgccaagatactggctttataggaaatataaaatgtaaatgctacaaagaaaaattaatacgcctttactacaaggattctgaacttgagcaggttattaaaacaaataattttagtaattttgatttaagtttatatccagtgcatagaataggagatgaaaaatattcttcaagaaaaaacatggaaaatattttagagtatattcaaaatgattatattccaaattttgcttcattacatactaacttattgttttatggcaatccaggtagcggcaaaacatatttatcctattgtatatcaaaaaacatattagacgatggatatcttgtagtttataaaacttcagatgaattaatacaaaatcttcgtgatatacgatttaacaacaatactaatcttgaatcacttctatttgactgtgatttacttataatcgatgatttaggtgcagagcatcttaatgaattttccattgcagaattatttaatatacttaacagaaaaatattaaataaaaagaaaatgataatatcaactaatttaactttacctgatatagtgaagcgatatagcgagagaatatcttcacgattaattggtgattttaaattatttaaattttattctgaagatataagaatcaaaaagaatttagaaaagaatagatgagtagcacaatgaactactcatctattttttaattacaaatttatattagttattataattagaacgataataactaatataaattcatcatgacctataattgtatataaaataaaacaagcttcagaaaactaaagcttgtttgcactatttggcgactcagaaggggctcgaaccctcgacctccggcgtgacaggccggcactctaaccaactgagctactgagccatcttatggtgggcacaacagggctcgaacctgtgaccccctgcttgtaaggcaggtgctctcccagctgagctatgcgcccataagatagaaatataagtcatgattactcataacttaaatattaaattaaatggtgactcctaggggaatcgaacccctgttaccaccgtgaaagggtggtgtcttaaccgcttgaccaaggagccataatgttatgttgcttcatttaaaatggagctggcaataggaatcgaacctacaacctgctgattacaagtcagctgctctaccgttgagccatgccagcattttaaatggcgactcagaaggggctcgaaccctcgacctccggcgtgacaggccggcactctaaccaactgagctactgagccatctcatggtgggcacaacagggctcgaacctgtgaccccctgcttgtaaggcaggtgctctcccagctgagctatgcgcccataagatagtttggtctatgatttctcataattttaaatattaaatttaaatggtgactcctaggggaatcgaacccctgttaccaccgtgaaagggtggtgtcttaaccgcttgaccaaggagccataatgttatgttgcttcatttaaaatggagctggcaataggaatcgaacctacaacctgctgattacaagtcagctgctctaccgttgagccatgccagcattttaaatggcgactcagaaggggctcgaaccctcgacctccggcgtgacaggccggcactctaaccaactgagctactgagccatcttatggtgggcacaacagggctcgaacctgtgaccccctgcttgtaaggcaggtgctctcccagctgagctatgcgcccataagatagtttggtctatgatttctcataattttaaattattaaatttaaatggtgactcctaggggaatcgaacccctgttaccaccgtgaaagggtggtgtcttaaccgcttgaccaaggagccatgctatattgtcttcgctttacactcttgcgttttgcactgtgtcgcgctgaccacatagactataatacagaatttctgtttatgtgtcaacacattttttaatttttttttattttttttaatttcatcttatttttcttattttcaagtgcttttttaactaatcttcatatgagtttttaacatcagtaatagcatctctaaagctagtaataaccttgtttttcatgtctatttccttctctaaattttctatctcagttctgcatatttccaaaaaaatatctttttctactttattgataattatattatatccatctcttttaaagttttgtcctgatgcctgtatttccaagggaaacctattgtttacatttactagaatttctttatcccatattcctcttttgtttattttgtatttgtctctcaaaacattcaaggattcaatttcttcttcaatttcatcctttattgaatcataaatagcattataaagaactattgaaattcccctttttaattttatttttaaaaagtctctattatttatcaaaaaatcatctatatcattttctcttatacattcaacatctttaaatgaaaaatattttaatccattgcctgatggataattaactattatttcattataattcatccttctaactttaaatgttcttccaaaatcctctgatttttcattaataatttttatttgcactttaactcacctctgtattttagtattcctttcttttaaccttaatattactatgataaaatttatttaacgaaaaaatatatttctatttcttattggataaaaagatgattattataatgattttaagataatactttctttataaattagtaagttaaacttttcttttactaaataattcatggagataaaataatttatatttttttactcaaataaaatagggagtgatcaataaaatgatttatcacgatttaatagttgttggcggtggtgcttctggcctaactgctgctattatagctaaagattttggaatagatgtagccattgttgaaggcacagatagaataggtaaaaaaattcttacaactggtaatggacgatgcaatatatcaaataaccgaatttcttatccatataatacttatcatagtgaaaataaagatttcttcgtagaagctttaaacaaccttacagttgaagatacaaaaaatttatttttatcattaggattgcctttaacagaattagataatggaaaaatgtacccaaaatcacttcaagcctcatctgtagtggatatatttagaatgacacttgaagataaacaaattcctttgtatacaaattgtaaaattaattctataagcaagaaaaaaaactttaatctttctacaaataatgatgaatatgatggtttttcatgtaaaaaattaattttaagctgtggtggaaagtctgctgttaagactggctctgatggtactggatataaattagcaaaatccttaggacacagcactacagatatggttccaggtatagttcaattaaaattagattatccttatttaaaatcaatatctggagtaaaattcgatggaaatgtttctatattaatagatggtgaagtagtccgaactgaaaccggagaagtcttgtttactgattatgggatatcaggaccaccaatcttacaactttcttattatgcttccaaggctttaaataataaatcaaaagttacaataagaatagatatgtttccaagcgaaactaaagaagatgtagaaaactttttttcaagtcatttttcaatgttcagctatagagaaatttcttctgctttagtaggaactatacataaaaagttaattcctacattattaaaggattcaggaataaaagacatccaccttccttgcagtaatgttgaatggaagtatataaataaacttatttcaaaatttaaaacttgggatttcaactgtattgatacaaatgggtttggaaatgctcaagtgactgttggtggaattaatacaaaagaaatcaacaatttgactttagaatcaaatctagttaataatctatatttctgtggagaaatacttgatgttcatggtgactgtgggggatttaaccttcaatgggcatggagttctggatatctcgctggtaaatcagcttcagaaaacaaatagttcaatatatattaataaaacctctatagtaaaattcaactatagaggtttttagtacaattaaacattataaactagtatctttttcccattcagcttctaacaaagttagttcagtaccatcatcttttctaattgtatgataagaatttattgtattttcattaacttctttaatcgctacagatgaagatatagtctcaccatatctactttctttttcaaacgtaaccttaattctctttattctataatccttaacaacttcaattggaactgcttcaattgcccattcaatatattttacattattgacatgattattagagtctatatcgctatatcttatatggaagtctactgagtaatcttcataatcaactctttctaatttctccatacttacatcataatcaatatcaccatctactccataaaaatcatattgttccttctgaattcttgtaggccttcttttttcaatatttataagaaaaaataatgctaaagcttcacctattatattttcttcactgtctttaataatatattttcttaacccataaaactttttgaaacctactggctttgtagttatacttatagtctctccaaacataggatatttgctcatttttatatcgtatttgtaaaaaacccatgcacaattattttctgtacaatatttcattcctccgccaactgattctgattgttgagttcccacatcacatataaaatcaataattgatgataacttacatctcagtcttgaatctacctcataataatgtatctcataatttttagtgaattctttagtcatatacttttgcaaaagctatttctttatttatataaactttgcaattctcctcccttctgtctgttaatttataccttatattatatattatcatatatcttaagttaaatataaccattagtttaaatgtttttacaatatattattttactctccaaaatttcttataaaaataatcaacattaaccataaaaaacaaaggactactataaaaatagtaatcctaaacaatataaatactaatatgaaaaattattcactaatggcttctatatctgatatttgattcttatctttcttttcatcaaatttagcatataatcctgcaagtattgttcccgaaattgaatgccatacacatgatactgcacatgcaactgctgcttgtggtgtagctgcaaagtgagctgttgctaaattagtagcaagtcctgcattttgcattcctacttcaatagatattgtacgtttcttagctgtagacatttttgtaagaactccaactccatatcctaacaaatatcctaatccattgtgtaataatactgctatgaatatcaatactcctgatttaaagaaattttgaccttgcaaagaaataactcctccaactataaacgcaagccctgtaacagaaacccctggcataacctcttggatatctttaaattctctcttttctccaaagaaataatttaaagtaaatcctattacgattggaattattactgattgaattattgatttaaacattccaatagcattaacttcaatttgtgcacctgctaaaaataatactaaaactggtgttaatattggtgacaaaagtgttgaagccgttgtcatgccaacagaaaaagggacatcacccttacataaaaatgacataatatttgatgaaactccacctggacaacatcctaccaaaactaatccaatcttaatttcatttggcaatcctagcaaagtgccaactgtatatgccaacagtggcataactgtatattgagccaaagcacctataaatatatctaaaggtctttgtgctaatattttgaagtcctgagtagtaagcgttaatcccattccaaacattattattccaagtattattgtttgattggtgcctctaacccatgtaaataattctggaataaaaaaagttactattgctactgcaataacaaacaccgatgtgtttttagataataatttacttattttttttaatgcattcataatataatagccccctaaatctaatatgaatttattttaaaacatcatcttatttaatttacagcttaaaacaatgatgcttttttgcataaaaaaatacctcaccccaaacaagggacgaagtaaatccgcgataccaccctacttctataaaatcatatttaaagaataaaaatataatttaatagctctcgtatcacatactaaacatatgtgtttcttttaacggtgaaataccgttgaagcttactttatttctgcttcactcctccaagatgattttcagtaaaatatgtacattagttttcatcaaccactaactttcttaagaacataataatacctactttttcttttctcaggatttattattaatatattatcaataataacacatcaataacaattcgtcaataaatcagctatttaattgatattaaattataatttcaaattaaattattacattttagcaatttaattcgatacactattgaatcttatatttttaaacatatctaaattacaaatttaaaatcttataaatagaatatatttttaatttcaaaaaataaaagtaggattttcaattttgaaaatcctacttttatattatttatttaatgcttctaataaatcgtctaaattaattccgtgaactgctgcagcttctgctattgtttcagcttgtgctgatggacatccaacacatcccataccaaagcccattaaaacttctgctttagatgcatctgcatgaactacttcaccgattgtcatatccttagttatcattgtacttcaccttcttctgcacataacataataatattgtatacaaaaaattatattttatgacacagtaaaagtcaatacccgaccactttactagactatagagattttactctcatagtttgatctctcttaggtcctactgaaactattgatatcttagtatctgtaaattcttctattctctttaagtatttctttgcgttttctggtaattcatcgtagcttcttgcatttgctacttcttctccccagccttcaaattcttcatatataggttcgcacttagctaaatcttctaaacttgctgggaagtaatcaataacttctccattaaatttatatccaacacaaactcttaacttatctaaaccagctaaggtatctatcttagtaacagctaatgaagttaatccactaactctacatgcagttttaactataactaaatctaaccaaccacatcttcttgatcttccagttgttacaccatattcatgacctttttctcttatccagtcaccagtttcatcaagtaattctgttgggaatggtcctttaccaactcttgtagtatatgcttttgtaatacctactgcattagtaatcatgtttggtcctataccaacaccattagctactcctcctgcagttgtattagatgaagttacatatggataagttccgtaatctatatctaataacataccttgagcaccttcaaataaaactgttttatcagccttaatatcattgtaaactctaactgaagtatcttgaacaaatggtcttaacttcttagcaaactctaagtattcttttaatatttcatcaaaacttacaggttctccacctaaaactttagttatataagcatttttcatttcgatgttttctttaagtttttctgtgaatacatcttcatgcattaaatcacatactcttattccacatctttcaaatttatctgtataacaaggtcctatacctttaccagtagtacctatatcatttttccctcttgcttgttctttaagcttatctaaaactttatgataaggcattataagttgtgctctatcacttattattaatttttctggtgttaccttaactccaacaccttctaaataatctatttcttcaaataaagcctttggatcaacaacgactccatttcctattacatttaatttatcttcatataaaatccctgatggtattaagtgcaatttatattctttgtcaccaactactacagtgtgaccagcattgtttcccccttggaatctaacaacaacattagcctcttctgctaagtaatctgtcatcttaccttttccttcatcgccccattgagctcctaaaacaataaatgctgacatctattttgcctcccttaaaataaatactctttatttctttaataatcttgtatcttgtggagttattcatagataagtaatttaaaatgtctacttaacgacaaacattttagaaattttattatgaattaaataaaattatatttaagttatctataaattatttttatatctccctttaaatattagcaaagtccatgtcaacggtcaactatatatcgaatatttttttgcatttttatgaaataattcgtataattattgtatatgagtatatattatgctaattattttcaaattaatatacatttaaactattaaggagtgttttctatgaatatttatgaagaagctttgaaattccatgaggaaaagagaggtaaatacgaaatcaaaccaacatgcgaagtaaaaaacgctaaagatttaagtttagcttacacacctggtgttgctgaaccatgccgtgaaatacacaaggatccatcaaaggtttatacatacacacgtaaatggaatactgttgctgtaatttcagatggaactgcagtacttgggcttggagatatcggacctatggctgctttacctgtaatggaaggtaaaagcgttctatttaaggaatttggtaatgtagatgcattccctatagttcttgatactaaaaatgttgatcaaattgttgaaacagttgctaatattgctccaactcttggaggaataaatctagaagatatttcagctccaagatgctttgaagttgaacaaaaattaaaagaaagattaaatataccagttttccatgatgatcaacacggaactgctattgttgttttatctggattaataaatgcattaaaggtagttaataaaaaattagataatattaatgtagttataaatggtgcaggttcagctggtactgcaatctgtaaattattactttcttctggcgtaaaaaatatagtaatgtgtgatataaatggcgtaataagcagagacaaagattttagcgataataaatatatggctgaattagcggagataactaatccacacaatgttactggaatgcttaaagacgctatggttggcgctgatgtatttataggggtttccgctccaaacatagtttcaaaagatatggtaaaaacaatgaataaagatggaataatattcgctatggcaaatccaactcctgaaatcttccctgaagatgcaaaagaagcaggaattgctgttatgggtactggacgttcagattatccaaaccaaatcaacaatgtacttgcatttcctggagtattcagaggtgcattagatgttagagcatcagaaataaatgaagaaatgaaagttgctgctgcttatgcaatttcaaatgctattgctgaaagtgaattaactgctgaaaatataattccaaaagcatttgattcaaaagttcaaaaattagttgcagaagctgtaaaagaagctgctattaaaagtggtgtagctcaaatataatgtagctataaaaattcatagtaataatataaaacatcgtgcttatctattcataagtgcgatgttttatttttaataaaatatcactctatacaaaaaaataataattttttgtttacctttttacatagttaattgttatatatacgtggtaccactagcacatatgcttaagaagggggcaaagcatattaatagcgaaacactcttattaataaagggatttatgtccttaatttttaaatatttaatttcaataggagcttcaaaagaagatgctgaagatataatacaagaaacctttgttaagacatatgagaatatagatgttttaatagatggcaatttaaaagcatggatgtttaaagtttcacttaataaattctatacattatataaaaaaagtaagacaagtatttctctaactgatgaactatgttcaaatttgaaaacggattttcaaatatctaatattgatatgtctttagatatcaaccatatactatcaaaaatgaatgaaagtgaaaaaaacctactgatattaaaatacaaccttggattgtcttattttaatatcagcaaattactaaatataaatgaaacttctgcaaaaacattatgttatcgtgctagaaacaaatttaaaaaaatctgggagtgtgaaaaatatgagtaatgaaattgatgatgtgttttcaaatgaatttgaagatacattaaaaagaacagtaaaaaaaagcagaaaaaaattaaatttaaaaattattcttataacctttatttctactctactcattatctttttaggtaatttaggattaacatttttaagtgataaatatataaaatcacaattttataaagatttaaatattaaaaccatggaatatcaaattaaatacccaaatgaatacattacacatcaaaactatcttgaaacaggatattttaagtttcaaagtacgtatgatatttcaaaaacaataggaagtagacttcttctcgctaatataacaaatactcttggcggattaaataaaaatagcttcattcatgacagttacttgatttctaaaccgttcccatcattggataatgatataaacaacagaccttctagctcatatggtttaagacatttaaacttcttgtatccatatgtcaactatgaaaatactataaatgattttaaattattaaatgaaatagataattctaaaacattagaaatggcattatcatttgacgatggatatagttatgatcaagtaaatactttaattgatagtagcttaataactttctactgggtagatatatctaatgaggaaaatagaacttacgaaattcaaaacaaaacttatgaaaatgatacttctgctataggcataaaatctattaactacaacggtaacactatcaatgacgtaaatgatagattaaataaatttaaagatagtttacaatatttaagagcaaatggggaatatggagtagtagataatgatttcaatgcagacaatataaaaattaatggtgttgtagttgtagggcatccaaatgaactaaaaattcttgaaaataataaaataattaaacatgctatgatcggaactgtagttgataaatattaattaaaattattaacaataatttttcactaaagttatacacagtttaaatttaaaaacttatccacattctaaaaaaataattttatccacaatatttttttattaagttttccacaataaaataaaattcaaattttccacataaaaacagagggagcagaaaaattttaattttctgctcccaatttaattatccacaactaaataaaaattatgaaataatttttatttagtaaattataaatttaactttaaaaatatgtttgtaagtatttcatttaatccttactttttaccaattcacaaactacatattcttagatttttctgcacacttatccatagcctgaatcacactatttctaaatccaagcttttcaagttcaactactgcatcaattgtagttcctgctggtgaacaaaccatatcctttaattcacccggatgctttcctgtttctaataccatttttgctgaacctaaaacactttgagctgccattttatacgcttttgctcttggtattccaagcttaactgcaccatctgccattgcttctataaacataaatacatatgcaggtgatgaaccagccacagctataaatccatcaaaatatttttcttctaaaacttcacattcgccaaagctttcaaatatatttatacaatattttaattcttcctcacttacatttttgttaggacatacagctgacatcgcctgacctacaagtgctggagtatttggcattgttcttataatctttaaatcatcaccaagccactcttccatattttcaatacttatacctgcagcaattgttattattaacttatcttcagttaattcagactttatttcttcaactacagacttatacatatttggcttaacagctaaaattatagtctcactttcttttgcaactgttttactatctaaagttgttgccactttaaattcatcacgtaatttctttgaagaagcctctgttttcgtagaaacaattatttcttcagatttcaagaaacctgatttaattaatcctcctaccatagaacttcccatatttccacatcctataaatcctacttttttaatcatgctttagcccccaatttaaaaattttttgttattaattcattttttatgtttttctataaatatttttaatttccaccactacaatcataggatagcttggattacaacttcacaaactataagtagttgaagggaggaatttatatgacctgtacttctatagtatacaataacaaaatttcagatcttgatactttcataactaacattttatgtaatgatataaaagccgaaagaattcctatttctgatataaaggaattttctgatcattatgtaataacaatagatccattttatcaaaaatacaatatatttgaagtgtattacaaaaacagctttttaatattacaaatcaaacatagagattcttcagtaaaaaccttagctacaaaattattttatttacctaatgtaaatataaacaagatttcacatgtttactataatgatagtttatcactaaaaattcctaaaatctattttaataatttttaaatgattttttaattataatagcttttaaaactctaaaaggttgcaccatttatagtttataaataaatttagatataagaaatatttaaataaatatttcttatatctataaataataattttttattcattgtgaacaacatctaaattaccaaatttactgaattgtccaagccatgctaatttaacagtaccaactggaccatttctctgcttagccataatacattcaccaatattcttatcttctgtttctttattataatattcatctctatacaagaacataacaatatcagcatcctgctctattgatccagattctctaaggtctgataacattggtctatggtcagctctctgttcaggtgcacgggatagctgtgataatgctattacaggacactccatttcctttgctaaagccttaatagatctagaaatttctgatacttcttgttgtctgttaccatctgaatttgctcctccagacataagctgcaagtagtctataacaataagatcaattccgtactccatttttaatcttctgcattttgatctcatctccataacagtaacaccagcagtatcatctatgtaaatcttagctttcgaaagaggaccacttgccatagctatgttttcccaatcctgatcatctaaagctcctgttctaagctttaacatatcaacattagcttcagaacaaagaagcttataagctaactgctccttagacatttccagtgaaaatattactacactcttatgttctctaagtgctacatgttcagctatatttaaagcaaatgtagtttttcccatagatggtcttgccgctataagcaccatgtcaccgctctgaaatcctgatgttttagcatctaaatcagtaaaccctgacggaactcctgtaacttcacctttattattaaaaagtttctctatctgcatgaaacctctttcaagtacatcacctaaagattcaaagtccttcgaagttctattttcagctatgttaaatattttcttttcagctacatctaccacattttctacattactttgattgttataactctcttctatgattgtagtagatgctttaataagttttcttaatgttgatttatctgaaacaatttttatatatgaacttaaattagcagtagatggtacagatgaacttacctctgttatgtatgttacaccacctgctctttcgagcatttctgtactttttaaatattctaaaagagtgaccaagtctacagccatatcatttctaaacatttctaatattgctttatatatgactttatgtccatctctataaaaatcttcttcatttaggctttccagaacctttgcaatagcatttttatcgattatcatggaacctattactgactgttctgcttctatactttgaggcagacttctcataactggtgcatccaaaatttttcctcctctcattcttaattattatcaatactaaaaattatattataaaatctgttatttgaaaacaaaaagaaaaatgcacaccaaccaataaacattagtaaattgcaggttgtgcatttcctatctaattaaatgcaatatccataagttcttctattgtttctactgtttttacttggatatctgtattgtttaatggaatttcatgttcattttcttttggaattaaaacaagatttattcccattctctttgcaccatatatcttttcaaaaatacctccaacaggtctaattttaccttgaagagatatttctccagtaattgctatgtcctgccttaaaggtttctttaataatgcacttattatacatgttgtaatagctgcaccagctgaaggaccatcaatttttcctccaccaataacattaacatgaatatcgtaatctttgatatctttatctgttaagcttcttattactgatgctgcattaaatacagaatcctttgccatagaacctgctgtatcattaaatctaactactcctgcaccctttttctttgctggaaaaacagctgcttctatttcaattgtagatcctaagaatccacttacaccaagcccataaacatgacctatttctcttttactcatatcttttaatctttcaaaaggagtatatcttccaattgatatgatttcatctaaatgagataattttatttctaaatctttttctgaattctcacatgaatgtaatgcatatccatatgcatccgtaagcatattaatagcctttcttccttcaaatgtataactacttattttttcagcaactccatcttctaatttaacattcaattttttagctgcatcataaattatagctgatatatcctttgatgaaagtggttcaaaataaacttctgtacatcttgatcttaatgctggatttatttcactagggcttctagttgtagctcctattaatacaaaatctgctggagctccattatcaaataaatactttatatatttcggtatcatttcatcatctggatcataataagatgacgagaattcaactctcttatcttctaaaacttttaataatttgttttgaagcattgaatctagttctccaatttcatctataaataacactcctccatgagcctcagtaactagtcctggcttaggctctggtatacctatttcagctaaatctcttttacttccttgatatattggatcatgaactgaaccaagtaatggatttgttatttctcttggatcccatctcagtgttgttccatcaacttcaacaaattttgatttgtcatcaaatggagtaaacggaatttccttaaccttatcaagagcaagtcttgcagctgtagtctttccaactcctggaggtccataaagaattatatgttgaggatatggcgaagaaagctttgatatcaaagattttatcgctctatcctgacctattacctgactaaactcctgaggtcttaaaaagctcattatatttttacttgtaactttgctatctaactcaattaaattatttaattttccaagagtttttttgttttcaacacccttttgcttgttaataacagaaagtcttacttcatctatatacttttcctgcttttccattatggactgctcaacttgagcttcaattttattctgaacatatttctttgccaactcatcagaaataagacctattgtttcttcaacacatttttctaaatcatcttctttaggtacaacttttaatcccttaccttctgaaagtattgtatttaatgcaaaaattctgtcacaagggtttgatgactgtatatacttatctaatttaaatcttatagttcttgctctaaatgcccctttatcaagaacattttttgttattccatacaatgcatctatttttgactcaagagataaattacttgaaataacctcttctaatatattagagttttcatatgaattcaaatttaatcctccttatgcttgtggcacaataattaccttcatctttgtgcttacttcaggatataacttaacatcaatttcatatccaccagctacttttattgtatccataactattttctttttatctacttctactttatattgttcctttattaatcctgcaatatctttacttgttattgctccaaataactttccattttcaccagtcttagcagtaatctttatttctttaccttttaattcacctgctaatttttgagctgcttctaattcagctaatttttgttttctttcattttcttttttattatttaaaatgtgtaagtttgaagctgttgcctcttcagctaatttccttggaaataaaaagtttcttgcatatccatctgaagcttctataacttcacccttcttaccaatttttttaacgtcttgtaataaaataaccttcataattattcacctatccttaagtatttttctattaattcttttaatttagtaacaacttcatctattgttgaatttgatactttagccccagcaatattcatatgtccgcctccacctaaggattctaaaacaatttgaatatttatatcgccaagagaccttccactaatatatatatcattttctatctttcccaaaacaaagcttgcggaaatacctgatatattcagtaattcatcagcagctttagccacaattacagtatctatgttttctggagtaattgcaatagcaactttattagttacttctgctgactttatagtatctgcaatttgtaaataactatttaaatcatcagtaaacatctttttaacttctatagtatcagcacccaatgattttagaaatgatgctgcttcaaaagttcttacaccagttttaaaagaaaaaccttttgtgtccataaagatacccgctaaaagtccttcagcttcaatcctagtgagatttggtctgtctaccatatactgaattatctcagtaaccatttcagaagtagaagaagcatatacttctatataattcaaaatatcattttcaatcatgtctggacttcttctatggtgatctataattactttacgctccgctttatatactaatggaaggtcacatatataacctttattgtgaacatcaacaataatgactaatgtttttttatttatattttccatagcgtattctacacttgtaaataaatcattatatttagaattatctttaagtttttctaaataataatctattgcattagtgtctttatttaatacaatattacaggtcttacctaattgctttactacacttgataatcccattgctgcacctaagcagtccatatctggatttttatgccctaaaatataaacattactgctttcacaaataagttcgcttaaagctcttgctataactcttgctttaactttagtccttttttctatttccttagtattaccaccaaagaattttatatcattcccatttttaactactacctggtcgccacctctaccaagagctaattccttagcaaatttagcactattataattttcctgtggagatatacctccacatcctattccaatacttaatgtaacttctattgaatttccaaaatcaatttttgaaatttcatctattattttaaattgtttattaatttcatcttcaatatatttatcttgtactgataagacgtatttatttgtatcatatttttctatcattgcttttaaattatttgcataatactttattgttctctcgatttctgcaactaaaagaggtttattactttcatcagtctttcctaatacttctgaaagattatcaacttctattagcataatgccctcttgagtcttttcataatctataagctttgttatatcattaaatgataataaatatacatattcattttcttctttttcaattacagttgcatatacatcatataatttattattaatatttaatctttgatgattatattcattggttaatgttccttctaaatttaatcctcttgctatacttaaaatattatttcctaaagcattttcattaggctgcaaagtattaaataatttattgcaccaaattatttctccatcttctctaattaatgataaaggatatataaattgaagaacattatcctcaatccccttatcaagagtttttgaaaaataatttatatcatcttctttagtccaaaatgaattcaatgtataaaagttatcaatacaatgaaaaattaataaaattattccagctaatatatgattaaatgaaattaatattattgaagttataattaataatccaggcttaagcaaacgtttaagcatagttactttatccataaaagcctcctaagacatccctagtctgttctattaccactaatataacgttttagtctacttaaactcttaccttccttttcaacttgatcctctgctctgattcctaagtctaactttgttttcatagttttatctatgtcttcaaatggatatccaagtttttcacctaatacatataaaattattatagcacctgaaacacactccaatatagcatctttagctacattattacccttagtaagtaatctgaaaaactctcctattatacaaagaagttgtgccttcaagtcttctataattttaatgtttttcattatattaaaattatcctttttcatagacatatcccctctccctcttaaccctcgtattcttattgtaattttttttcatccttattgcaagaatttataatttccttctatattttaccacattttgtaagtataatacttattttttataataaaaataaactattatatcaataatttattttttcatcaataattttgagtttagtctaaaactcattatattatatttttacatataaataaaactgtcgcactaatagcttatgactattagtgcgacagcttctcaaattattactattactcagttgtaaatggtaataatgctatgtttctagctctcttgattgaagttgttaattctctttggtgcttagcacatgttccagagattcttcttggaagtatcttacctctttcagtaacatactttcttaacttatttatatctttgtaatcgatgaattcagctttatctacacagaaagcacaaactttctttctagatcttctcattctaccgcctggtcttctattgttgttttcttctctgctcatttctttccctcctcacctaaaaaatttcttagaaaggcatatctccgtcatcaacaggagttatatcctcttcaaagtttccaccaccaaatatatcatttgttggtgctgaatattcattgcttgcgccaaaactattgtttgatgaattacttcccttgcttccaaggaattgaactccaccaaattgatctgctactacttcagtaacatatctcttagttccgtctttagcatcataacttctggtttgaattctaccgctgatagccacttggccacccttactcatgtaatttgcagtactttcagcctgtttaccccatattactacaggaataaaatcagcttcattctggccagtctttgggttatacctatcaactgctaatgttaaagtcgttactgcagctccagttcctggcgtaaaccttagttctggatctttagttaatcttccgattaaaactactttgttcatttacaacaccgccttacgcttgttcattaacgatgatatgtctgataacaccatcagtgattctgaatattctatctaattctctaggtaattctgtaccagcagtaaagttaactaatgtatagtaaccttcgtttacttttgcgatttcgtaagcaagctttctcttaccccaaaaatcaacgttttctactgtacctccaccattttctataacacccttaaacttttcgatgttagctttaacagtttcttcatcgaatgatgggtttaatatgaatatagtttcgtattttctcatcaatttcacctcctcccctcggactaacggccatgctttgcacggcagggattacaatttatgattatatcatttaattcaaaaaatttcaagtaattattttatttttctgcttcaactactattttttttgcaccttttacaaatttacttctaggaatcattacaattcttccacatccggtacatttaatttttatatcagcgccaactctgattatttcaaattcataagtaccacatggatgttgctttttcatttgtactatatctccaagattaaaattctctaccattaaaattcccccttatcagaattaatatttattaattgagtttttggatatggtatttctatcccattttcgtctaatgttatttttattgctttcctaagctcattttccatcttccattgagttaatggtttcgttcttccaactgttcttattgtaacactagaagcagctaatgctgatacccctaatacttctataggttcattaataaaatcttcatgttctttttgaaatttatcgcagcattcttttatagcatttatagcattatctatatcttcttcataagctatatcaacatcaactataaatcgtgtattaccccttgaatgattagttacttctgaaatcataccattaggaattgaatgaatatcacctgtaaaatcttttataatagtagtccttattcctattgtttgaacaattccactgaaatttcctattgtaacataatccccaataccaaattggtcctcaaataatataaaaaatccattgataaaatcctttatcaaactttgagatccaagtcccaatgcaactccacctatgcttgcaaaggtaaaggatattccaccaaagagcactgacaaaatacttgtaattcctaaaaaatatacagaatactttaatatacttttcataaccccaccaagggttttagctctttgtggatctaatgataatgcggcattactcttcacttgtttatctactgctttttttattaagtattttcctatctttattgataaatacataataattactattgagataatttttatacccttattaaacattacctcaaagtcttcaagacttataattacttttcctatttcaagctcagtcttatctaatgacaaatgtactagataatttataccatgcacttactgctctcctctcaatattactactcaacaacaatatatccgttttcttccttaaaatagatattcttatactctattatattattctttaatattgaatcgatatgttccttatcatccattcttacacatataccacagctcatagttatcgacgttggagtcggcattattctgaatttgtaatttaattcatttaactttttttctgctgacatggcatcatgtgtatttttaaaaaccacaatatagtaattcatatactgccaccacctttcacactataatttatattatatatgtttttataagtttataaagttattacaattaaaatattttctattaattaatgaaaatatctatcctttatcttataattatatagatagagagaataaaggagtatgatatgttttcattattgactatatgcaaagctatattcataggatttcttacaggatttacagcctcaattcccttaggtccttctggtcttgaatctgttaacaggtcaatgtctaaaggattcagggaagggttcaaagtatctttaggtgctgtttctgctgatcttttatatatagttattataaatttaggtttatttacattattgagcaagcatcataattttcaaagtatattttggattgtatcaggagtcattctaattctatttaatcgtctgtcattcacagatagcaaaaagaaaactgactctaaaaatctattaaataaatatacatcaaatggatttgtgactggttttttaattacttttgtaaatccaacaacaccttctttatggattgcactaagtactactgttttgagtgtttggagatatcatggaagaatatattttttaacatcggtatcttcaatgatgattggaagtataacttggttttgcttactcaacatattagtaagtaaaggtgttcgaaaattaaaatctgattacactaaaacaacatcaaaattattaaattattttttaatgattctcggaatatctttcattattttaggaatatttaaatttataaaataatcttttttatataatgattgtatattgataattaactttagaggtgaacaaatatggacgtttatttagataattcttctaccacctttccaaaaccaaagcaagtaattgatggtatgtataactacatgttaaatgttggtggtaatgccggaagaggtaattatacaaatactcttcaaagtaatcgatttttatatgaagcacgtgaaattgtaagtaacttttttggtttttcgtcacctagtaatgttatttttacaaacaacgttacaacttcattaaatatgttaataaaaggactaattaagcaaggagaccacgttataacatcttctatggaacacaattccgttttacgtcctcttataaactgtaaagaactattaaatataaatctcgatataattgatgctgatgaatctggatttattaacgtttcagattttagatctaaaataacatctgatacaaaattagtagtattgacccaagcttcaaatgtaactggatcaattcagaatatagccgaagtcggtaaaatctgtaaagaaaaaaatgtattttttattgtagattcatcacaaggagctggtgttctagaacttaacataaattctgtaaatgctaacgctattgcttttaccggacataaaagccttcttgggcctcaaggaatcggaggattcataattgatgacaaattaaacgactcttgtaaaagtatattacatggcggaacaggaagcttatcctattctttagatcaacctgattttcttcctgataaatttgaatgcggaactcataatatgccaggtattgttggtctatcagaaggtataaaattcataaattctacaggattaaaaacaatatatgaacataatcattatcttataaattatttactagatggtctacaaaatataaaagatataataatttacggtgattcaactggtaaaaacataactacttgtatttcaataaatattaaatctttggattcctctgagcttggttatttactagaaaatagtggtataaaaacacgatgtggtcttcattgtgctccattagctcataaaaccatcggaagttatccaagtggtaccgtgagattaagtgttagctatttcaataaaaaagaagaaattgactttacactaaaaactttaaataaaatatcactaaataaatagttatttgaataaaacctcctttattggaaataaatctaataaaggaggtttattatatgtgtgataatttttctgttgattcatctttaccaactgcttatataaaaataaaagaatacttaacaaaagaattgaaatcaatagttaacaaccgccccattgtaattttgtgcatcggtacggatagatctaccggagattcattaggtcctattattggatataaattaaaacatctttcagttgataatatttatatctatgggactttagaaaacccagtccatgcaaaaaatctttctaatattctagaaaaaataagctgctacttttcaaatccttatattattgcaattgattcttgtttgggatcattaactaacatcggaaaaatatttataaaaaaaggtcctttacaccctggattagctttaaacaaggatcttccccctattggtgagatgaatataactggaattgttaatatttctggaagttttgaatttttagttttacaaaatactagactttatacagtaatgaatctggcagattctatttctagaggtatttaccattttgcacttgataataaagatacaacttctgataacattatttctctacattaaccattttatatttttccatatttaaattgtttcacgtgaaacaatttaaataaagttatgtaaactatttatgtttttcattccaaaataattagaacttatataaatttgaatcgtaatgtataaactaacaatattataaataatatcttctaataagattattaaaaaagaagaagtaagtatattttcatacttacttcttctttttattaacttcatatttattacaagcttcatttaatacatataattcttcttctgaaagatcatatcttgaaattcctttatcaactggttttgcataagttgtactttcttgtcttccatatattccagttaatataacaccgtcatttttgtcatctaataatgcaattgagaaactcaaatcacttccaacatcttcaaaagctttatatctcattatagcaaccttttgtatgcactcttccattttaacttctaatctctcacattccttgattgctttttcagatatttcttttacttcttctacactctctattctttctaacagcatttcttctagattcttactattagttcctttcataagccttctatacttatcttcaactttaccaatagttttaaataaaaataaaattattataaataataatactattattactgccattcctattataatatatggcataaattcattaatcgaattaattaatgcttccaatttactgtcattcctttcataattgtttcacgtgaaacattaaatatcaataatatctaatattctttgcaaatcatcttctgaataatattcaatttctattttacctttattatttttattagatatatttacttttgttccaaaataactttgaagttgattttttatttccttataataaggatttaattcattatttgtttctttttcttctgaagttttgccttcaagtattctttttaccaatctttccaattctcttacagataaattttcatcaataactttttgagataattcatattgaatctctttatcttttattccgagaagtgctcttccgtgtccctcagtaataattccttcaattatatactgttgaactcttatatctagattcattaacctcattgtattagtaatagccgttcgtgatttacctattcgcttacttaaatcttcctgagttaaattaaaatcactcaataattttttgtaagctgacgcttcttctattggatttaaatcttgtctttgtatattctctattaaagaaatttctaatacatccttttcgctgagctccataactattgctggtacatcttttaaccctgccatcttagccgctctccaacgtctttctcctgcaacaattacataaagtccatcatctgatttcctaaggataagaggttgaattattccatgagtttttatagattctgttaattcagctatcttatcattatcaaatgcttttctaggctgattattatcatttcttatttcatttaaaggaattagcatcttccctttttcatcctgttgttctgattctactaaatcttcaggaataagcgcacttaatcccttacctaaagcaaatttctttcccatccttttacttcacctactgtctttttaagaattctttggttaagttagtatatgcttcagcacccttacacttattatcatacaaaactatcggtaatccaaagctcggtgcttctgctaatcttatatttcgtgctattgtagttttatacactttgtccttaaaatatttctgaacttcctttaaaacttcattactaaggttagttctataatcaaacatagtcataagaaccccctcaatttcgagcttcttatttaaggatttcttaactaattgtacagtattcattaattggcttacaccttctagcgcgtaaaactcacattgcataggaattaaaactgaatcagcacaagtcagcgcatttatagttaatacacctaatgacggtgggcaatctatgaatacataatcatattcatcttctatttcctttagcttgtttttcataatattttctctgtcacttttattaattaattcaacttctaccccagctaattccattgttgatggagatataaataagttattaactaaatcactttgtactattgattctttcatagaaacatcagaaatcaatacatcatatatagaacaatctaagttgttcttatctatacctaatccacttgttgtgttcccttgtggatctatgtctattgttaaaactttgaaaccttccattgctaaataagagcataaatttatattagtagtagtttttccaactccacctttttgattgaaaatacatatcgtcttcataattataagctcaaaaagagcattccccccttcccatatattaatattatatatatatttgtcccataataaaagaattatgttataaaaaagaataaatagtcttaaattggttaaaaaatatattgtatttcacaataaaaatattattcatttttatgagaaaaaattaaggcacaattctgtgccttataaaaataaaattatctatttctttggttttggaatctttattgttagctctaaaaattcctcttcatctttatatccatactctgctggtatatcgaatttttcaaaaacctgctttatagtgttaacatataattttgctggaagtacatttttggtattttttctctttttctttaattcttcgctagaaattttaagtaattctttatttattaattcctctgtcttttttacatttaatccgtcatttattacttttttaattatttttagttgtaactcttcatttggaagagtaagtagtgatcgagcatgtctttctgttaatttattatttaagcatattcctctaacttcagtacttaattttaataatcttaacttattagcaattgtagactgtttttttcccatcctttttgctaactcatcctgagtaaaactatgatcatgtattaaattataatatgcttctgcttcttcaatataatttaaatcttctctctgtaaattttctaatagtgcaatttcagcagactctgcatctgttatgtctactatattacaaggaaccttatttaaattagccaatttagctgctctaagtcttctttcacctgcaactaattcgtaaacatcccctctttttctgactgtaagtggctgaattattccatattgtttaattgactcggataattcttcaatagactcttcattaaaatatttacgtggttgatatatattgggaatcactttatctatatctatctgtattatttcattattcatgttctaacccatccctcattaaaatactaaaaattaattatttactaacatatttattctactacagctacaattttcctttttatattttctaaaataacattttttatatgttattttattggtttttttgttattgtacctgcttttctagggtaaattttttcacatggttttattttttttacaacaacaagattatgttttaattctgtttcctctatattaacctcacatatatcaacaagctggccaccaagagttccgatagcatttctactctcttgtatttcttgttctacagaaggtccttttaaagcaataaaattaccaccaatctttacataaggtaaacaaaactctgataatacactcatattagcaacagctctagatgttgatatatcaaactgctcccttaaatccttgtttctggctccatcttcagccctagaatgaattgttgttacatttttcaaccctaattcttgaactactgtatttaaaaaattaattcttttatttaatgaatccaataaagttacttttaaatcttctctcataatagcaattggtaatccaggaaatcctgcccctgttccaacatctatcaatgtttctgcttttttaaactcatctctcttaaatgcctttatacaatctataaaatgtttttttacaacttcttcatcttcagtaattgcagttaaattaatcttttcattccattcctgaagcagtctcatatatttcataaatctctcatattgttgttctgatagctgcaatccaacatcttctgctgccttagccattaaattaaaaaattccataaattaacctccactggtccttaagattgctttccatattgatgttctaagtatataagtaaaactgatatatcagctggtgaaacaccagatatacgtgatgcctgccctatacttattggttttatattagataacttttgtactgcttcagttcttaatccacttacatcattataatctatgtctttaggtaacaattttttttcaaactttttaaattgactaacttgttccatttgactttgtatatatccttcatacttagtaagaacattgatttgttcaccaatatcatctgataaatccggtctttcaggatctaattgtgctaactgaaaatactctaattctggtctctgcattaattcataaaaactaatagcttttcttaaaggagttgaatttattgatactaaaaattcatttacttccttcttatttgtaactttcaatgtctttagtctttctaattcatcttcgatatttttctttctagttaaaaatgtattatatctttcttctgtaactaatccaactctatgacccatttcagttaatcttaaatcagcattatcttgtcttagtagcaatctatactctgctctcgaagtcatcattctatatggctcattagttcctttagtaactaaatcatctataagtactcctatataagcatctgaacgagttaaaattaaaggttcttgattttttattttaagtgctgcattaacacccgcaactaatccttgagctcctgcttcttcgtatccagaacttccgtttaattgtccagcaccatataatccatcaatatttttaaattctaatgttggtttaagttgagtaggatcaattgaatcatattctattgcatatgcagttctcatcatttcaacattttctagccctggaagagttctaagcatttttatttgtacttcttcaggaagtgatgaagagaatcctccaacatacatttctaaagtatccataccctctggctcaacaaatatctgatgttgagttttatcaggaaatctcattactttatcttcaatagatggacaatatctaggtccaacccctttaatgcttccattataaatcggagatctatttatattttctcttataatattgtgagtttcttcattggtatacgttaagtaacatgcaacctgttccttctgtagttttccactcataaatgaaaatggaactattttatcatcaccattttgttctatcatcttagaaaaatctactgatttactatttattcttgctggtgtaccagtcttaaatcttcttaacgaaattcctaaatctaataatgattgtgataaatcattagcagggaataatccatttggtcctccgctatatgatacttctccaattattatttttccttttaaatatgtacctgttgctaaaactactgctttacacttaaatacagcaccatttttagttactacaccgctcactttgccgtcttcaactattaattctgtaacttctatttgtcttatctttaaattatcttgttcttctagaaccttcttcattctaaattgataatcctttttatctgcctgagctcttaatgaatgtactgcaggtcctttagatgtattaagcattctagattgaataaatgtatggtcaatattaactcccatttctccgcccaaagcatctatttctctaactaaatgtcctttagctgtaccacctatattaggattacaaggcattaatgcaattgaatctaaatttattgtacaaactaatgtgtttaaccccattctagcagaagccagtgctgcttcacaaccagcatgcccagctccaactacaatgacatcaaattgtccagcttcataatttactgccattttttctttacctactttccacaacaaaattcactgaaaattttatttaataaatcttcctctaattcatcaccagttatttcacctaaagccctcatagctgatgttatatagattgatattaaatctagatattcattcaaattaatcttttctaatgctaaattacaatcttctaaggatctgtataacgcctgtttatgtctcgtatttgaaattattaagctttcagaatcaatttctccattaaagaaaagattctttatttcttcttttaagttttcaattccgaatcctgtttttgcagatatctctattgttctgtttaaacttgtaataacttcttctgataacttacattccaaatctactttatttagcaacgctatatactttttatcattaattgcatctattataaccctatcttcatcatctaaagctctagatgtatctagcattaatataactaaatctgcttcttcaatcttttcctttgatctttcaacaccaattttttctacagtatcttctgtgtctctaataccagctgtatctgtaatctttatcggtattccatctaaatttatatattcctcaattatatctcttgtagttccaggtatatctgttactattgctctcttttctcttaatagcgaattaagtaaagatgatttacctacattaggttttcctacaataacaatattaagaccatctcttattatttttccttcatctgcattttttaataatgaattaattcttgtaatagtcttagttatactgtctttaatctgagcaattaaatcatcatcaactatatcttcatcatcttctgtaaagtccacagcatattcgattaatgctaatacatttaaaagatattttctcaattctccaatttcttttgaaagtgcacctttactctgcatcatagctgacttcatagataattcagttttggcctttataatatccattgttgcttctgcttgacttaaatctattcttccgtttaaaaatgctcttttagtaaactctcctggttcagctatccttgctccagctttaactatctgatttaaaactctgttagtagcaacaactccaccatgacaattaacttctattacattttctcctgtataacttctaggtcctttcatataacttagaataacatcatcaattatatctttagtgtctaaatccactattgttccatatctcatagtgtatgttttcatatcttttatatcttttttgctctttggagcaaaaatcttgtcagcaatttctagggctttttccccggaaattcttattatagcaattcctccttctccaattggagttgctatagcacaaatagtatcaaattctctcatctagtatcctccttaaaaagaagcttttattattagtatatccagtttgaactaatatcaattttacataacaaaatttaattagtcaaaaatatattgcattaatttaaagtacaatttttaattgcctataaaaagagaaagcccgttcaggctttctctttaaatatttctgtttaattctataactactcgtctaaatggctcttctccttcactgtatgtcttaacatcagagttattttgaagagcagagtgaataattcttctctcataagggttcattggctcaagcttatatgctttaccactcttttttactcttgatgcacttttaagtgcaacacccttaagagtttcttctcttttgcttctataattttcagtatctaatataacttttttatgaggaagttcataatttttattaactactaatgaaactaaatattgtatagaatctaatgtttctcctctatagccaattataagccccatattcttaccgcttaaattgatttttaaagtatcattttcttcaacaatatttatttcagcacttaattccatgctattaagaatagtacttatgaattttctagcttcctcaatatagtcatatttacttgtaactttaatcttagcgcgtttaactcctatgacattgaacaatccctttgagccatgttctaaaacttcaacagttacgttgtctttagttaaacataattcatttaaagctttatccaatgcttcttcaacagttcttccttctacttctattgatttcatgtgttaactcaccacctctaaattcaaaagcaaaatttaaaaataaaaatttatattacttcttcttttttttctttttcttacttgctaaatttttaggttcttcaacttccatagcaaacttattttcttcttgtctatttactgctgtttcttctttgattttatcttttaccgctggtctatagtttaagaagtaagtttgaacagcttgaattaggttacccataatccaatataaaactagtatcgccttaaagtttaatgacatgaatcccatcataccagccatcatcaaattcatagttcccatactcattccacctggctgctgtggtgtagcctttgtcattaaataagaaggtaaatatgtagataaagctgctactatagctaatatatagtatggatctggtgcaaatacatcttttatccataagaatgatgcaacttgaccctctggtaaattaatacccataaacacccaatataaagccattaatattggtagtggtaataatgttggaaggcatccccctaccatacttacattattatctttatataatttcattacctctgtattcattttttgaggatcacttttgtatttatcctgaattttcttaatttcaggttgaattttctgcattcctctagtggattttgcagctttgatattaaatggtaatattaatagtcttactgctactgtaaaagcaagtattgctaaaacatacgatagacctagatcagttacacccatgccaacgattacgttatgaaagtaatcaaatatgtttcgcataaaatcaactatcgcttgaaacataaaaaactattcctcctattcatttattttactgggtcatatccacctttagaaaagggattacatcttaaaattctgtaaactgccataatacttcctctaaatgcaccatatttatttatagcatctaaagcatattgagaacatgtaggcctgtatttacagcacgaaggtctccctggtgaaataaattttctataaaaattaattagacttattagtagtttcttcattaatatataagcctgcctttttaattaaatttatcatagatttttctacgtcaaaataatttttgtctacgataggatttctagctataaaaataaaatcgtatccttttaatatataattgcaatttaatctaaaactttcgcttattaatctctttgatctacttctaacaacactgtttccaacttttttacttacagaaacacctaatttattataaagattattttctttatctttattccttttattttttaatatatacataactagaagttcattggcaaaagatttgcctcttctatatacaaatttaaattcaaaatttttttttaatctataaatcatagatattaaaaccccttttttccgccatttgcagaaaaaaggccactaaatgcggcccttatgctgttaatttttttcttcctttttgtcttctgttcttaagaatgtttcttcctgatgcagtactcattctttttctgaagccatgttctttttttctttgtctttttttaggttgatatgtcatgaacattacacatgcacccccttaaatatattatttatagcaaaaactatacttcatgattttaaattttacttttctattatatatacaacataaatttctgtcaaggtctgtaaagtgtccattatttgttgataaaattatcaacatgtaatttttttgtggataacttattgaataaccatatttacttatgatatcatatgtgtatattgtgaataacttatttaaaacatagtttatccacagttgtggataaagttgtgtataacttgtttattcttttcaattaaattatatctagaatgtgataaatcctgggtttatcactgtttataatttaatttttcgtgttgttactaatttttttcaacataactctatacacataattattaacatgttgatatatttatatacatattagggtataatttaaaactgttgatatatttgttgataagatgtacataatattaataaaaattttttattagatatatggaggaatacagatacatggatgcggatctaaaaaatatatgggcaaaaactttagaaactataaaaagtgaattaagcgaggttagctttaatacatggattaaaagttgtgagccgatttctatatcttctgacactataacgataagcgttcctaattcttttactcaagatatattagataaaaggtataaagatttagttgctaattcaatagaagtagtctgctcaaaattatataaaatcgaattcgtaatagcatctgaggcttctgaaaaggaagatttaaaagagacttcttctaattcagcatcaaaatccatcgtagtaaatgatgaaatgtcatcaacattaaatccaaagtacacttttaattcattcgtaataggtaatagtaatagatttgctcatgctgcttccttagctgtagcagaatcccctgcgaaagcctacaatcctttatttatatatggtggagttggacttggaaaaacacatttaatgcatgctataggacattatattttagataataatcctagtgctaaagtagtctatgtgtcatcagaaaaattcacaaatgaattaattaatgctattaaggatgataaaaatgaagatttcagaaataaatatagaaatgttgatgtacttcttatagatgatattcagtttattgcaggcaaagaacgtactcaggaagaatttttccatacatttaatgctcttcatgatgctaataagcaaattatactttcatctgatagaccgccaaaagaaattccaacattagaagacagattaagatctagatttgaatggggactaatagctgatatacaagttccagactttgaaacaagaatggcaattcttaagaaaaaagctgatgttgaaaatttaaatgtggcgaatgaagtaatgggatacatagctaccaaaataaaatcaaacataagagaactcgaaggtgctctaatcagaataattgcatattcttcattaactaacagagatgttactgttgatttagcaactgaagcattaaaagatattatatcgaaaaagcaaggaaagcatataaccattgatcttattcaggatgtggtatcaagctactttaacttgcgtgtagaagatttaaaatctcaaagaagaactagaaatgttgctcatccaagacaaattgcaatgtatttaagtagaaagcttactgacatgtcccttcctaaaataggcgaagagtttggtggaagagatcatacaacagtcatacatgcatatgaaaaaatatcagagaatctaaaaactgatgattcgctgcaacatacagttaacgatataacgaaaaaattaactcaaaattaatccacaagttgtatataataactatctaataacttgtggataataatttttcaacaatagccctgtggaatttgtggataactaagtgtatttgtcaccaacttatccacaatcttttcccatgcaattttgttgatatatctattgttgagatggttatcaacagaattaacagcacctactactattattactataaatttatatatatctatctctattcttacgcaaaatacctgtgtataaataaggaggaacttaaatgatttttacatgtgaaaaacaagaaatattagaaggtatctcaatagttcaaaaagctattactggtaaatcaacaatgcctatattagaaggtgtatacataaagactaatgaactagattcatcattaacattgataggatcagatatggatgttagtattcaaactactgtaaatgctaatattatagagccaggaagtatagttattgatgctaaaatatttggtgaaataattagaaaacttccaaactcaacaataaaaatagaaactattgaaaatcaagttataagaattacttgtgaaaaatcagtatttgacgtagtttatatgaatacgaatgaattcccagaactacctgagataaatgaagatttaaagatttcagttaatcaaaatatattaaaaaatatgataaaaggtacatcttttgcaatagctcaagatgagactagaccaatacttcaggggattttatttgaagttaaaaacaaaaatttaaatttagttgcattagatggatatagattagctataaaaagtgaatttttagatagtgatatagaaatagaagttgtaataccaggaaaaactttgaatgaagtttctaaaatacttgaagatgttgaagatattgtggatattacatttacaaataatcatattttatttaatttagagaaaactaaaataatatcaagattattagaaggtaagtttataaattataattctctgttacctcaagaacataaattatctgttcatgtaaatagacaagaacttcaaaattcaatagaaagagcatctttaatggctaaagatgggaatacgaatttaattaaacttgacatacaacaagacaacttgattatctcatctaattctcaattgggaaaagttagagaagaaatatctatgaaattgcaaggcgatgaaatacaaattgcatttaattcaagatatctattagatgtattgaaaaatatggaagaggatgaagttgttttaaaaatgacatcaggtattagtccgtgcgttatagaggaaaataataatgaaaatgcgaagtatttggtacttccagttagacttatgagataaggaggataaatattttaattaatatttatgcagaaaaaatgaataaaataaagattgaaactgaaattataaaattagatgcttttttaaaatgggctgctattgcaagttctggttcagaagcaaaattttatatacaagatgaaatggtaaaggtcaacaatgaaatttgcactcagcgtggtaaaaaattaaaagctggtgatattgtaaattttgatggtgttgattatgaaataatataagaatttttttaagaatagattgttaaatttataaaactgtattcaaagattattttctgttatcatataacttaggaataatggttagatgatttaacaatctaaaaattaaaataaactcttattttattattatgatataattattataggtgtattttttatgtatattaaaaatataatgttagctaactatagaaactatgagactttatcacttgaattaagtaaaaacgttaatgttttcattggtgataatgctcaaggaaagactaatgtacttgaggctatttactattgtgcatttgctaaatctcatagaacatctaaagatagagaattaataaattggaaaaatgacaaggcatatatcagtttacttgtaggaaaagatagacttgataaaagaatagatataaatattctaagagatggtaagaaagctattaaggttaattccataaaagttgctaaaataggtgagttatttggaacgtttaatgttgtaatgttttcaccagaagatttaaaagttattaaagaagcaccaaatctaagaagaaaattattagatatggagttatcacaaataaataaaaagtattattttaatttggttcaatacaataaaattttaaatgaacggaatattttgcttaaaagcaggaactttaatgaggacgttttagaggtatatgatcttcagctggttgactatgctgattatattatttcaaaacggttagaatatatagataaaataaacttttatggagaaaaaatacacagagaaataacagctgataaagaagagattaaatttaagtatagctgtaatgtcgatttaactaattataaaaataattatttaaaaaaattacaagataatattaagcgtgatcgagagaagggattgacatcagtaggtcctcacagagatgattttaatgtttttctaaatgatatagatgctaaaacatttggctctcaaggtcagcagagaacagctattttaacaatgaaattttcatcgctaaaaataattaaagaaattacaggagaatatcctgttttattattagatgatgttctttcggaacttgatgttaatagaaaaaaatatatattaagtacaatccatggtatacaaacaataataacatgtactggtattgaagttttaagcgattatttagacgacaatgcaaaaatatttaatgtatcaagtggaagaattttaaattaaaggaggaagatttcgtgtttttacatttaggtgaaaatgttgtggttcctatcaaggatattattggaatattcgatatacagaatacaatgtatagttcagatacaatacagttcttaagattagcagaagaagatgggtttgtagagagaattacagatgaaagacctaagtcttttatcattgcagaagttgataatatgagtaaaatatatctttcacctatatcgtcaactacattaacaaagagaactgacatggattataattattaatttaaaggatttatcaatttatcagttaattttataagtttaggaggagtctgatttggaacaaaataatagaaaatatgatgaaaatcagatacaggtacttgagggattagaggcagtaagaaaaagacccggaatgtatattggaagtacaagttcaagaggtctacatcatctagtttatgaaatagtagataacagtattgatgaagcattagctggttattgtaaaaagatagaggtaaatataaataaggataactctattacagttatagatgatggtagaggtatgcccgtcggaatacatcctaaaatgggtaaatctactgttgaagttataatgactatactacatgccggaggtaagttcggtggcggaggatataaggtttctggaggattacatggtgttggtgcatctgtagttaatgctctgtcagaagaatgtagagttacagttaaaagagaaggtgctatatggcagcaagaatatagcaaaggtaaggttcttactgatgttgaaaaaataggtgaaagtagtgaaagtggaacacaagtttactttaagcctgatgctgaaatatttgatgaagtaatctttgattttgagatattagcacaaagattaagagaactagcgtttttaaataaaggaatatacataaagttagtagacttaagagaagaaaatgaaaaagaagaggttttccattatgaaggtggtataaaatcctttgtttcatacttaaatagaaataaagtagctcttcatgaagaaccaatatatattgagggaattaaagataatgtatctgttgaagtagctcttcaatacaatgatggatatacagaaaatattttttcattcgctaataatatagatactgttgaaggtggtactcatttagttggattcaaaactgcactaacaagagcgtttaatgactatgctaaaaaatttggtcatattaaagaaaatgacaagaattttactggtgatgatattagagagggccttacagctgtagtatctgttaaaattgaagagcctcaatttgagggtcagacaaaaactaaattaggaaatagtgaagttagaggtatagttgattctattgtaggtgaatgtatatctactttcttagaagaaaatccatcagtaggaaaaatgatagttgataaagcacttatggcagcaagagctagagatgctgcaagaaaagcaagagaattaacaagaaaatctgttttagaaagatcaacattgcctgggaaattagctgattgttcatctaaggatcctaaggaatgtgaaatctatatagtcgaaggagattctgccggcggctcagctaaacaaggcagaaatagaaagttccaagcaattttaccattaagaggtaaaatattaaatgttgaaaaacaaagattagatagaatattaaatgctgatactataagatcaatggttactgcttttggtgctggtattggaaatgattttgatattgaaaagataagatatgatagaataataatcatgaccgatgccgatgttgatggtgctcatattagaacgctgttattaacattcttctatagatatatgagaccgttaatagacgaggggcatgtatatattgcacaaccaccattgtacaaaataagcaagggtaaaaaagaacattatgcttatagtgatgcagagttagagcaggtattaattgattttggtggaaaagacaattctactgatatacaaagatacaaaggtcttggtgaaatgaatgcgtctcaattatgggatactacaatggatcctgaacaaagaatcttgttaagagttaatgttgaagatgctatgcaagcagatgaaatattcacaatcttaatgggagaaaaggttgaaccaagaaaagaatttatacaacaaaatgctaaaaatgttgttaacttagacatttagtactgatatgaggtgaagtacatggatatatttaatgagggaaaagttatacctgtagatattaatcatgaaatgaaaaagtgttatatagactatgcaatgagtgttattgttggtcgtgcattaccagatgttagagatggtttaaagccagttcatagaagaatactttattcactacaggggttaggcttaactccagaaaaaggatacagaaaatgcgccagaatagttggagaagttttaggtaagtaccacccacatggtgatagctctgtttatgatgctttagtacgtatggctcaggatttctctatgagatacatgcttgttgatggtcacggaaactttggttctgttgatggagatagcgcagctgcaatgagatatacagaagcaaaaatgaataagatagctgttgaaatgttaagagatattaacaagaatacagttgattttatgcctaactttgacggtgaagaacaagagccggtagtattaccatcaagatttccaaatcttttagttaatggttcatcgggaatagctgttggtatggctactaatattccaccacataatttaggtgagataatagatggtactataatgcttatagataatcctgaattaactgttttagatcttatgactaaaattcaaggaccagatttcccaacaggtgcaactattatggggaaagctggtataagagctgcttatgagactggaagaggtaagattgttgtaagagctgatgcagaaattgaagaggaaaatggaagacataagattgttgttacagaaattccttatcaagtaaataaagctaagcttatagagaatattgcggacttagttaaagataagaagattactggaatatcagatttaagagatgaatctgatagagatggtatgagaattgtagttgaattaaagagagatgctaatccaaatgtagttttaaatttattgtataagcatactaaattacaggattcatttggagtaatcatgttagcgttagttaataatgagccaagagtattaaatattaaagaaatattaagcaactacatagattatcaaaaagaagtaataactagaagaactgtatttgaattaaataaagcggaagcaagagcgcatattttagaaggtttaagaatagctcttgataatattgatgaagtaatcagcattataagacattcaaaaactgctgaaattgctaagaatacattgatggaaaaatttgctctttctgataaacaagcaactgctatcttagaaatgagattgagaaggcttactggattagaaagagaaaagatagaagaagagtatgctgaattaatgaaacaaatagaatacttaaaatctatattagcaagtgaagaaaagcttttaggagttattaaagatgagttatcagatataaaagccaagtattcggatgaaagaagaacaaaaatagaaaaggttgttaatgaaattgatattgaggaccttatccaggaagaagatgttgtaataacgttaactaactctgggtatataaagagaatttcagcagatacttattcggctcaaagaagaggtggaaagggtattcaagctatgacaacaaaagaagatgattttgttgaacatgttatgattacatctacccattctgatgtattattctttactaatagaggtagagtgtacaaattaagagcttatgagatacctgatgcaggaagacaggcaaagggtacaaatgtaattaatttaatagcaatagagccagatgaaaagatacagactgtactaacagtaagtgatggtaaaaaagaaggattcttattcatggccactaagaatggtattgttaagaaaactcacataagtgaattcaagaatctaagaaagaatggattaattgctttaagtttaaaagataatgatgagttattaaaggttaaaaacacttatggtgatgcaaacattatgatagtaactcaaaatggttatgccgtaagatttaatgagaaaaacgttagagcaatgggtagaactgcatctggtgttaaggctattaatctaaaggatgatgatgttgctgtttgtatggatatagcagttgatggcgaagaattattggttataagtgaaaatggattcggtaagagaactcctgtctctgaatataaagttcaaaatagagggggagtaggtttaatcacatataagataagtgaaaagactggaaaacttacaggtgcgactatttgtaaggtggatgatgaacttatgctgataaattctagcggtgttgctataagaattaatgttgcagatatttcagttactaatagatctgcaatgggtgtaacattaatgagaacaactgaagacgaaaaagttgttgccatagcaaaaatattgagcagcgatgattcagaggaagatgaagaaaagttggaaagtaatacaacaccagaaactattgaagagaatagtagtgaatcaaataacgaagaataatttaatattcttatagcttttgtaattataaaaatggattagcaatgttatgttgttaatccattttttattgctaataattaaaagtaaaatataaaaatacagtaattagcttattatatgatagaataaagcacaaaatgcatataatatgagccacgtgtatcgtcataagaaaaataaagaaaaataaaggataatagagaaatataataatatttttaaaatatagaaagatataaatatatttgtattgttttatatgttaagataaaacacgtcgcagagagcgacaagaaacaacaagataagatcaaaattattaattaaaacaaaaaattaaaagttttgaaaaaagttgttgacataaatcaaatcaagtgatatactaagtgagtcgcttggttgtgacaaaataacaacgtaaagttgtgaaagaaaatggtctttgaaaattgaacagaatataatataaacatttaagtaaaccagcaattctttattttgagtaagctaagattaaactttttattgagagtttgatcctggctcaggacgaacgctggcggcgtgcttaacacatgcaagtcgagcgatgaagctccttcgggagtggattagcggcggacgggtgagtaacacgtgggtaacctgcctcatagaggggaatagcctttcgaaaggaagattaataccgcataagattgtagtaccgcatggtacagcaattaaaggagtaatccgctatgagatggacccgcgtcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggtcttcggattgtaaagctctgtctttagggacgataatgacggtacctaaggaggaagccacggctaactacgtgccagcagccgcggtaatacgtaggtggcaagcgttgtccggatttactgggcgtaaagggagcgtaggtggatatttaagtgggatgtgaaatactcgggcttaacctgagtgctgcattccaaactggatatctagagtgcaggagaggaaaggagaattcctagtgtagcggtgaaatgcgtagagattaggaagaataccagtggcgaaggcgcctttctggactgtaactgacactgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattactctgtaatggaggaagccacttcggtggcaggaagacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggtcggtacaatgagatgcaacctcgcgagagtgagcaaaactataaaaccgatctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtgagctaaccgcaaggaggcagcgacctaaggtagggtcagcgattggggtgaagtcgtaacaaggtagccgtaggagaacctgcggctggatcacctcctttctatggagaaatctagcaaacatggcgtttgactagtacaaagatgcaaagcatctataaaaattacaacttgctcaaaggttacttaatgagtattgattctgttcaattttgaaagactaagtctttcaatgttctttgaaaattgcacatagattaatgtatataatacaacaaagccaagaataaatattctttgtgaatgattaatataaccagttttgtatatcaaaacttaaaaaggtcaagctacaaagggcgcatggtgaatgccttggcatcaggagccgatgaaggacgtgataagctgcgataagcttcgggtaggcgcacatagccagagatccggagatttccgaatggggaaacccgcatgagaaacctcatgcatcgtaaagtgaatacatagctttatgaaggaacacctagggaactgaaacatctaagtacctagaggaagagaaagaaaaatcgattttcttagtagcggcgagcgaaaaggaaagagcccaaaccagagatttatctctggggttgcggacagaacataacgtgaaattatgattaaccgaacacaactggaaagttggaccgtaggaggtaatagtcctgtaagtaaaagtcataatgatcagttctgcaccagagtaccacgagacacgtgaaaccttgtgggaagcagggaggaccacctcccaaggctaaatactacctgatgaccgatagtgaagcagtaccgtgagggaaaggtgaaaagaaccccgggaggggagtgaaatagaacctgaaaccatgtgcctacaaccgatcaaagcaccttatgtgtgtgatgatgtgctttttgtagaacgagccaacgagttacggtatgtagcgaggttaagtacttaaggtacggagccgaagggaaaccgagtcttaatagggcgactagttgcatgctgtagacccgaaaccgggtgacctatccatggccaggttgaagcgagggtaaaacctcgtggaggaccgaaccacgttgctgttgaaaaagcatgggatgagctgtggatagcggagaaattccaatcgaactcggatatagctggttctcctcgaaatagctttagggctagcgtcgtgaaatgtgagtactggaggtagagcactgaataggctagggggcatagcgcttaccgaaccttatcaaactccgaatgccagatactatcagcacggcagtcagactatgaaagataagttccatggtcaaaagggaaacagcccagatcgtcagctaaggtcccaaagtgtaagttaagtggaaaaggatgtgggatttctaagacaactaggatgttggcttagaagcagccactcattaaaagagtgcgtaatagctcactagtcaagagatcctgcgccgaaaatgtccggggctcaaacttaccaccgaagctacgggttcatactttgtatgagcggtagaggagcgtcgtaatcgggctgaagtcgtaccgtaaggagcggtggactgattacgagtgagaatgttggcattagtagcgagatgtaggtgagaatcctacaggccgaatatctaaggtttcctgagtaaagtttgtcttctcagggttagtcgggacctaaggcgaggccgagaggcgtagtcgatggacaattggttgatattccaataccactataatcgttattatcgatggtgtgacggagaaggataggatgtgccagctattggatgctggtctaagcgttgagggagttagaacaggcaaatccgttctaacaatcctagggcgtgatggggaaggttccacggaaccgaagtatctgatttcatgcttccaagaaaagcatctagaaagagaagtagtgcccgtaccgcaaaccgacacaggtagatgaggagagaatcctaaggccgacggaagaatcacgttaaggaactaggcaaattgaccccgtaacttcgggagaaggggtgcctaccatctggtaggccgcagagaataggcacaagcaactgtttaacaaaaacacaggtctctgctaaagcgtaagctgatgtataggggctgacgcctgcccggtgctggaaggttaaggggaacacttagcgcaagcgaaggtgtgaacttaagccccagtaaacggcggccgtaactataacggtcctaaggtagcgaaattccttgtcaggtaagttctgacccgcacgaatggcgtaatgacttgtgcactgtctcaactgtgaatccggcgaagttgtagtgcgagtgaagatgctcgctacccgcgattggacggaaagaccccgtagagctttactgtagcttagcattgaatttcggtattgtctgtacaggataggtgggagactgggaaattagggcgtcagccttaatggagtcgttgttgggataccaccctgatagtattgaagttctaactggatgccatgaaactggtgacaggacattgttaggtgggcagtttgactggggcggtcgcctcctaaaatgtaacggaggcgcccaaaggttccctcagaacggtcggaaatcgttcgtagagtgtaaaggcataagggagcctgactgcgagacctacaagtcgagcagggacgaaagtcgggcttagtgatccggtggtacctcgtgggagggccatcgctcaacggataaaagctacctcggggataacaggctgatctcccccaagagttcacatcgacggggaggtttggcacctcgatgtcggctcgtcgcatcctggggctgaagtaggtcccaagggttgggctgttcgcccattaaagcggcacgcgagctgggttcagaacgtcgtgagacagttcggtccctatccgtcgcgggcgtaggaaatttgagaggagctgtccttagtacgagaggaccgggatggactgacctatggtgtaccagttgtttcgccagaagcatagctgggtagctaagtcgggaagggataaacgctgaaagcatctaagtgtgaagcccacctcaagatgagatttcccatagcataagctagtaagaccccttgaagactacaaggttgataggtcagaggtgtaagtgcggtaacgtatttagctgactgatactaataggtcgagggcttgaccaatataatcgagttgtaaatacattaaaaactatgtgcaattttgaaagaataaaaaaatctttcaaaaagcttgacaaaatgtaagttttgttataaaatataaactgtagtaaatctggtgatgatggcatagaggtaacactcctttccattccgaacaggacagttaaggtctatagcgccgatggtactgcatgggagactgtgtggaagagtaggacgtcgccaggtcattaaagggatctttagctcagttggttagagcaaccggctcataaccggtaggtccggggttcgagtccctgaaggtccaccatttatgggggtatagctcagttgggagagcacctgccttgcacgcagggggtcaagagttcgaatctctttatctccaccaaataaaagttatgaagtaattcataactttttttgttgtataaaaataaattacaatattattagagtgagtgttactaaaatattattttaaagtataatataaatagaagtttgtatttgggaggctaagtagaaatgaattctattgaaagaagagataatatagtaaaattactgctcaatagttctatacccattaaaggaactgatatagcagataaatataatgtcacaagacaggttatagttaaagatatagcaatattaagagcaaaaggctttaatataatggcaactccagatggatatatagttaacagaaatgacggaaaagtaaaaacaataattgctgtaaagcataaagaatctgagatgtttgatgaaatgagtactgtgataaaatatggtggagtaatagaagatgttatagttgaacattctttatatggtgaaataaaaggtgttttaatggttaagaatttaaatgaattaaataaatttatagctaaatatagtagtcaagaagggcgcttattatcggtcttaactaatggagtgcatctacataccatatcagcagaaacaagtgaggacattgaagcaattatatcagaattaaaggctaagaactttatagtttcagattaggaggaacttacaatggattatgatgtattgattttaggtggcgggataatcggatgtgcagtagcatatgaactttcaaaatataatataaatatagctttaatagaaaaggactatgatgtagcaaatgatatttcatttgtaaatactgcagtaatttatgatggatcagagacttcagactgtattatggcttctcttgagaaaaaaggaagaaaacttatagaagagcattgtaagaaatttcatataccatataaaaaggttggagctttaagaatttcaaatagccaatatggtaatgaacgtttagacaatatgtataatagagcaaaagaaagagggatatcaggggttcatattatagacgaaaatgcaataaaggatatagaacctaatttaaaggctacttacactaaggctttatattgcgaaaatacagctgtaatatgtccttataatttagctatatcatatgcagaggtagcagctgataatggtgttaattttagattagaggaaaaggttattgatataagaaatatttcaaagggctttaaagtaactactaataaaaacaaatttacatgtaaatttgttgttaatacaatacctaatgaagttttttcggataataatgaagataaccatgacgataaccaaaattctataataagcagaaaaatgaattatatattatttaatgataaacttgataatcatatgaataatatcattataaatgaaattgatgaaagtgcatttgtgattgatattcctacagcattaaatggtaatttaataggaattaaagggtatgattcattagatatggaaaagggtcttaatttatgtaaaaacataatacctgatatagataagcatacagtaacaaatatttttacggaaacttatagtaaggatagcgtttgcatagaagagaataagcttgaagaaggatatgtaaaagtaagaggcagtcattatgctaaaataactatagctccagcaattgcaaagaaaataggagaagtactaaaaactaatataaacataatagaaaagaaggattatgttgataaaaaacgtgatatgtatgtttttaaaaatatgactaaagaagaaagaaatgaaataataaaactagattcaagatatggaaatatagtgtgtagctgtaactgtatttcagaaggcgaaatagttgattgcataaggcgtccacttggagcaagaactgttgaaggagttaaaagacgtacaggaattggacttggaagttgtaatggtgcttattgtaatatgaaaattattaaaatattagcgagagaaatggataaggatgttttaagtatagttgatgattcaatggaatcgagggttttagttggcagaataaaagaattttcagaaatttagctgactgggaggagatttgtatgagtgataaagatatttttacaagcttagtaagagtaaaagggaatccagattataaagtagtgtctgttaaaagtactaaaccaatagaaaaagagttatggaaagaattatctaaggtgttaagtagaatctatattagcacacctatagatattggtgatgttatttgtacgaatataattaatagtggaattgatatagtgtgcactaaaaaaatagatagttaaatgttataataaattattggttttaaaaggattaatttatcaaataagtatatgatttaagataaaaatagaaaaatacttgtaaaaatttttaaatagatatatactactgattagataatattttaaataggcgttattataaaagctacgatttattaatatcttcagagagctggtgtatggtgcgaaccagtgattattataagtctttccacttttagagctgctgatgataaatcagaaggtttatgccctttatagcatagtttaagaggttgatgtaagtttttatattgacaatttaggtggcaacgcggattctattcgtcctattatggtctttttaggctatatatagaggcgaatttttttatacatttttatatattatttattaataaatattttggaggttattatgttagatttaaaatttgttagagaaaatccagacatcgtaaaagaaaatattaaaaagaaatttcaagatcataaattacaacttgttgatgaagtaattgaacttgataaagaagctagaaaagctcaaactgatgctgatgcattgagagcaaatagaaaaactgtttctaagcaaattggtgcattaatggctcaaggaaaaaaagaagaagctgaaaagcttaaggaacaagttaataatgatgctgaaaaattagctaatcttgaagctgaagaaagcagacttcaagatgaagttaaagaaagaatgatgaagattccaaacattattgacccatcagttccaattggaaaagatgataatgaaaatgtggaagttgagaagtttggtgaaccagtagttcctgattttgaaataccatatcatacagatattatggagaagtttaatggaattgatcttgatagtgctagaaaagttgcaggtagcggattctattacttaatgggagatatagcaagacttcactcagcagtaatttcatatgctagagactttatgatagaaaaaggatttacatatgttatacctccatttatgataagaagtagtgttgttacaggtgtaatgagctttgaagaaatgggagaaatgatgtataaaatcgaaggtgaagatttatacttaattggaacaagtgaacactcaatgatagggaaatttattgatactattgttgatgaaaaaactcttcctcaaacattaacaagttattcaccatgctttagaaaagaaaaaggatctcatggtattgaagaaagaggagtttatagaatacatcaatttgaaaagcaagaaatgatagttgtatgtaagccagaagagagtaaagaatggtttgataagttatggaagaacacagtagatttattccgttctttagatattccagtaagaactcttgaatgctgttctggtgatttagctgatttaaaggttaaatctcttgatgtagaagcttggtctccaagacaaaaaaaatatttcgaagttggaagctgttcaaatctttcagatgctcaagcacgtagactaaagattcgtgtaaatggtgaagatggaaagaaatatttccctcatacattaaataatacagtagttgcaccaccaagaatgcttattgctttcttagaaaataatttaaatgaagatggaagcataaatattccagaagctttaagaccatatatgggtgggaaaagcataattaaatagttaagagaaaatgctgtattgaattaaaattaattcaatacagcatttttattatattataccgttagttagtttacatgctttacaagcagaattttgattaataactaaaataatagtaataattaagatgaatatattcacaaacatgaatatataagtagctaataagtagtttttaatattttataaaaaaaatgtagaaaaagtgttgacagtatatattttgcttgctataataaatcttgtcgtaagacgtggagagatggtcgagttggtttaaggcaccggtcttgaaaaccggcgtacgtgtaagcgtacctagggttcgaatccctatctctccgccattttttttataaaaaaataaattggaaaatattattaggtacatggagaattactcaagtggctgaagaggcgcccctgctaagggcgtaggtcgggcaactggcgcccgggttcaaatcccggattctccgccaaaacatctagtttttactaggtgtttttttatgtgattaattataataattaactgtagttaatttaacaaatttagagatttaaaagtttgtggatattatttccaacattaaattaagtattataataaaaactaaatagatatcttatataaatagataagcttatattatcatctatttattgtattttagatagttatttatttaaatataaacagaacaaaaacctattttttatttagtttaatttatatagaaataaaataaaaaaattaagaaaaattgttgacagaattaattatgcttgctataataaatcttgtcgtgagacatggagagatggtcgagttggtttaaggcaccggtcttgaaaaccggcgtacgtgtaagcgtacctagggttcgaatccctatctctccgccattaaaatattatatattttagagggcacatggagaattactcaagtggctgaagaggcgcccctgctaagggcgtaggtcgggcaactggcgcccgggttcaaatcccggattctccgccaaaaacatctaacaaaagttagatgttttttttgttgtataaaaataaatttagcattagttaatgtatttcatcacaaaagatttattagtatgtaaatttaagtaaaaaacataaattaaaaatattaataataaaattattcatagtataattaaattggagtggtgcaatatgttaaaaggtgaaaaaatatatttaaaactattagaaagaaaagatgtaagaatactaaagaacatttgtgatgatgaaaaagtaagaagatacaatacaatatccaatgaatctaataatagtgaaaatactaattttagaaaagctcttactataattaatgaaaaggaagttttagttggatttataacgtataaagaaagtaattactgtaaagatgtatattctataggtataacaattggaagcagatattggaatcggggatatggacaagattctataaaattacttttaagttatttatttaatgacttaaatgctgtaagagtagagttagaagttataagtactaatatacgggcaattacatgctataagaagtgcggttttttagaggaaggaattaaaaaaagtaaatgttatattgatggagagtatgtagacacaataattatgggaataattaaaaatgaatttattgaaaatatagcacagtaagaaaggtgagggtatggaatgagtatcaggtttatttatggaagagctggtataggaaaaagtacatggtgcataaatagtattgcagaaaatataaaaaaagatgatgagaataaactaatcctcatagtacctgagcaatatacatttaatacagaaaatagaatcttaaaatctataggtgagcctgctttgttaagaactcaagtattgagctttaaaaaaatggctcatgaggtttttgaagagtgtggaggacgtgttaaagaaattataaaagagtcaggaagaaatatgttaattcataaagttcttaatgaaaaaattgaatcattagagtattttagaaaaatttcaagagagcagggattttatgaaatagtttctgatgttatatcagaatttaaaaaatataatgttgaggttgattctttacgaaatattgaggaaagcattcaggaatcagatttatataataaaataagagaattatcgataatatatgaagcatttaatgaagaaatgaatgaaggatatattgatggtgatgatgaattaactttgcttggaaaaaaattattagagaatgatatatatactaattctgaggtatggattgatgaatttagtacttttactccacagcagttagagattataagattacttgcaagaagatgtaagagggttaacataactttatgcatggataatagggataattcaaatggaaatcaagatataacagatgtgtttaatactataaaaaatacagaaaataaaattttgaagataatgaaagaaaataatatttcatatgataaaccaattaatctgaatatgattaatgtaaatgaaggatacaatagatttaaaaatgctccagaattggagcacatagaaaaatacttttttacatatccgtttaattcatttaatgggaaatgtgaaaatgtgaagctatataaggccaataatatttatgatgaaattgagcgtgttgcaaagagtataacggctcttataagaagtggaaaatatagatataaggatatatctgttgtatgtagaaacatagatgactatgaaaaaataacatctgttatttttaaggattatgaaataccatactttttagataagaaattagagttattaaataatccattaataattcttataacatcagcttttgaaatattgtttaaagattggtcatatgaaagtgtgtttaagtacttaaaaacaggtcttacaggaattggaaataattatatagatgttttagaaaactttgttttagaatatggtgttaagggatataaatggactgtaaaagaaattatttctgaaagttggtttaacaacaatgaagagttatcagaagagaaaatatttatttcagaaataatggatgaagtgagacgtccgcttttaatttttcataataaaattaaaggaaaacataaagttagtcatatatgtaaggctatttatgaatttttaatcgatatacatgcatttgagcgaataaatcaatggattgaaaaatttgatgaaattggattagaagataaggttaaagaatacagtcaagttgaggaatctgtaatagatatattagatcaggcagtggatgtaatgggagataaggatttagattcgtatgacttctttaaaatattaaattctggttttaataatgaagaaattggagttattccagtggctttagatcaagtgaatattggtgatgtagcaagaataaaaggtagagatgttaaggcattatatatagttggagtaaatgatggaattttaccagcttcaaaaaaggaagaaggtatattatctgataatgatagaaatattttaagcgatataggtatagaattagcatcaaatacaagaaataaagtatttgaagaacaatttttattatatacagtattaacaataagcagcgattatctaatgatttcatatcctatggctgactttgaaggtaaatcattgagaccatcaattgttatatcacgaataaaaaaaatacttcctcagcttgttgaagagagtgatttatatgatttatcaagttataaagataaactaaataaggttatatcacctatacctacattcaacgaacttattttagctatgagaaagaattgtgatgaggaaaatgttgaagaatattggagagaagtatacaagtggtataaagatagtccagaatacgaaaacaaagtaaagaacatctttaaaggtttggattattcaaatctgaaaaatcacgttaataaaaataatcttagagaattatatgcaaatgaagatggaaaattaatgttcagtgtttctagattagaaaaatatgcggagtgtcctttttcatatttcgtacaatatggtctaaaggctaagaatagaaagatatatgaatttacacctcctgatttaggttcttttgtgcatgatattttagatttgtttacaaacagagtaaaaaaagaaggcatattatggtctgaacttaacaacgaaagatgtaaagagatagtatcaaatttaatagatattagacttagtgaacagacaaattcaattttgaacagtagtaaaagatttaagtacttatcacaaagatttaaaagagtaatttctaaatcagtaacagttatggcagagcaaattggaaaaggtgaatttgaagtattcaaaactgaattcgattttggtaactataaaacaggtgaggcagttatgcttaatttacaagatgatgaaaaagtgtatttgcaaggtagaatagatagaatagacactcttgatcttgatgggcagacttacattagaattattgattataagacaggtgcaaaaaaatttgatttaaatgaattatattatggtttacaaatgcaactgttagtttacttggatgctattattaagaattctaaatatattttagaaaaacaggttgtcccaggagcagtattatattttaaagtagatgatccaattataaaaagtaaaaaagaaatgacaacagaagaagttgagactgaggttttagaagaacttaagttgaaaggacttgtacttaaagatgcaaaggtagttaaagctatggatagagatattgaaggttactcattagtaataccagcagcgtttaaaaaagatggtgattttaagtctacaagtgatgttgtaacagaagaagaatttacactattaagagaatatgttaatagaaaaatgatttctttatgtgaggatatgttatgtggagatattaaaattgaaccaacaaagcaggcaaatagaagttactgtgagtattgtaatttttcatcaatatgtcagtttgatacaagtataaaggataataaatataagattgtaggtaaaaaaagtagaactgagatatgggataatattagaagtgatgttaaaggctcaaaagaagataattaataatagataaggctaaatacgagattaaaagaaatagaggagatatgatgaatgggtgaaacaaagtggactgatgagcagctaagtgcaattaaaacgcgaaattgtaacctacttgttgcagctgcagcaggatcaggtaaaacagctgttttggtagaaaggattataagaataataactaataaagataatccagttgatattgataagttattagtagttacatttacaaatgcagcagctgctgagatgcgtgaaagaatagcagctgcaatatcaaaggctcttgataaggaaccaacatcaaaaaacctacaaaagcagcttacattattaaatagagctaatataacaacaatgcattcattttgtcttgatgtaataaaaaataattttcataaaatagatttagatccttcatttagaattggtgatcaaacagaaggaattttaattaaagatgaggttatagagacactttttgaagaaaaatatgatcaagaagatactgagtttacatcattagttgaagcttttagtacctataaaaatgacgataatttaaaagaattaataataaatatgtataattttataatgtcaggaccatggcctgaaaattggcttaaagagaatgcagaagcatttaatatagagacaatggaaaaattaaataatagcaagtgggttttagttttaaagaacagtataaaagttgaaattgaaggatatattaaaatgcttgaaaaggcaatagaaataattaatttaactgatggcttggagccttatttagaaacattttcaaatgaactatattctataaaaaatgcttataattctattgattgtggtttagatgatatttatagttcattatgttcaatatcttttggaagattaaaatctattaaaaaggataaagtttcagatgaaaatgctcaaaatacagtaaagagtataagagatgatataaaaaagaaaatatcagagttaataaacaatactttttcagtaactccagaagaaatgcttataaatattaaaggtgcatatcctactattaaaaagttaacagagcttgttttagaatttggtgaaaagtttagccaaaagaaaaaagagaaaaatattctcgattttaatgatctggaacacttgtgtttaaaaatactaagtgataaagatgaaaatggaaatataattccatctaagactgcaattgaatttaaaaatttatttgatgaagttcttgtagatgaatatcaggattcaaataatgttcaagaaactataatagaacttgtctcaagaagaaaagatgaatttcctaatgtatttatggttggagatgtaaagcagagcatatatagatttagacaggcaaaacctgaacttttcatggagaaatatattaattatacattagaagaaagcaataatagaaagattcagctatataagaacttcagaagtcgtaaagaagttatagatggagttaactatatatttaaggaaataatgtctgagacggttggagaacttgaatataccgatgaggaagctttaaatttaggtgcttcatatgaaaattcagaagatgaaaatgtaattttgggaggaccaatagaggttaacataatagaaaaaagcattgaagaatcccatttaaataaagagaaattagatgaagaagattttgaaaatgaagaaattgaaggagttaatcttgaaggaaaaattgttgccaaaagaattaaagaattaatgaccactacaggaaataatgtattcaaggttttagacaaagaaacaggtgaatataggcctattaagtataaagacatagtaattcttttgagagctacaaagaactggtctgagagccttttagatgaacttggtcaagaaggaattccagcatatgcagacactggctcaggatattttgaatcaattgaaataaggactataatgtctttgttaagagttatcgataatccaatgcaggatgttcctgttattgcagtattgaaatctccaataatgggattttcggcagaggatttaagtattataagactcaaaaataaggaaaaatatttttatgaaaatatagcagatattgccgaggggaatatttgtgacatatctgaagaactcattacaagatgtaggggctttcttgaaaagcttgaaatatggagaaataaagccatatatatgcctatagatgagtttatatggtatctatatatggatacagcttattatggttatgttggagctatgccaaacggtgtgttaagacaggcaaacttaaaaatattgttccaaagagcaaagcaatttgaacaaactagttttaaaggactattcaattttattaattttatcaataagcttacaaagtcatccggggatatgggaagtgctaagatacttggtgagaatgaagatgtagtaagaataatgagtatacataagagtaaggggttagaatttccagtagtatttttatgtggaacaggaaaacagtttaatttaatggatcttaataaaaatatactatatcatgatgaacttggatttggacctgattttgttgatcttgaaaaaagagtaagtataggaacaatagcgaaagaagctattaagaaaaaaatgaagctggaaactttatcagaagaagtacgaattctatatgttgcatgtacaagagcaaaagaaaaacttattataactggaactgtaaataatattcagaagagtatagaaaagtgggtatcttcagcttcgttagattataatttaatactgccttcagagatattaaaaggaaaatcatatttggattggattggtatgtctttgtgtcagcataatgatggaaaagtattaagggaaaaaatagctgtatcaaatgaaatatctaaagatgataactctaaatgggatattaaattatggaagagaagcgatattgtagttaataatgaagacggcaaattagaagaagaaaaagaagtaaaattatcaatattagaagaagagtatgataaagatgtttatggtgaagtagataagagattatcatataaatatccattaaaagaatcaactaaattaaaaagtaatatttcagtttctgacttaaagaaaagaaatgctgaatttattgatcagaatgttgagagcattaatattgaagaagttgaatcaaaaaataagagaacaataattacacctaaatttcttcaagaggaaaagggcttaactgcagcggagaaaggtactgctgtacattttgttatgaaaaaaatagatttagataaagtatcttcaatacatgaaattaaggatcagatacagtacctatatgaaaatgactttattttagaagaggaaatgaaagctgttaatccatctaaaattttgaatttctttaaaagtgatttgggtaaaatgatgactgaacttcataaagaaggaaaaaaaatatatcgtgaacttcctttttatactgaaataagtagtgtaaatatagataatacccttagtgaagaatatgaaaatgaaaaagtaagattacaaggaattatagattgcttttttgaatataatggagaaagtatactgttagattataaaactgactatgtatctaaggataatgaagcagaactacagaaaaaatatataaagcaacttgattactatagtgatgcggtatttaaaataacaggaaaaaaagtatcaaagagatacttatattcattttatttagaaaaagtaattgaaatataaaaaacagcttagttgttattttttaaatgataactaagctgtttgtctataacataataataagtatttctaataggaatttattttaaattagggttaagtaatttattttataattactttgctacctttaggaatattatcatatatccatttagaatcaacaattgaaagtcttatacatccatgcgatgctggttcacctaatgtataatcaacaattgtagctctatctttatcaaatggaactgaatggaagagtatatcgccaactatttggctccaatactttccaccttgattatatttatcagagaaaaaccaatcccccttttcttgaatcacaaatgaacctttaggggtttcttcaccagatataccagtagaacaagaaaaggcttttaataaagtccaagcatcttgtttacctttatatatatatgttttctgtgatgtcaaatcaacatttataaggtactgagtgctactttcaatatttagcgaatttatattttcaggagatatagtacttgttaaggcttgtgaagaagcttcgatagtagcagaagttttatcataatattcttgctgtttatctttaatttcagatattttattttgaatatcaatgttatcttttattaaagaactattttcatcaagtatagatatagctttagtgtaataatcattttcaactaactcatcacaatattcaaatatatttagttttatattattacgtgctttatccatatattttaacgaagaagtataatttagatcaagtgaagatactttttcaaaataagatagtgcatcagtataatcttgttcagaaaaacatttaacaccattgtcatagttagaactagaatcttttaatgaatctatagaagatgctaaatcatatattttatctaaagatataatatcatatctcttaatttcattaagttctagcagtatattttcatcagtattacttttgttattaatatcgctggaaagccttgaaatttcagaattaaaatataacgttaaatcattttttaatctgaatacttttaagggattgtactcctcctttgtaagtaacaaattattagctttatcatagtcgtaattactaaaataatttttgaattcactaagaagtacattgtatttgtgactttcaaaaacacatagaaatgttatgattaataatgatagaagaatatatataaatttatagttttttttgctcattttaatatttatattaaatccatttaattttttcaaattaatccctccttaattaatagagacgaatatctattaagaatatttctaatataataaaatataattaaaagagtaagttaaaacttttatctataatattaacaataaaagcaaataataaaccttgatatttcaagtattttcaatatgttataatatagaaaaatggaattgtttaactaaagaacattattggaggataaaatgaaggataatactggtttttttaaaaaatttatgacttctgtttatgatataaatgtgttttcaaagtatgctaaagagggaataataaaatcaattatttatattctaataatctgtacaggagtaggaataataaagggaggagttttaggatataagcttaatcgtggtcttaacatcattacgcaatatttacaaacgaatggaaaaaacatatatataaaagatggattacttactttagattccagtattgcaaatgttaatagtgatatatatatatattcagataaaacaattaatgaagatatcgattttaaagaaattttttatgatagtaagatagatttactaattttgaaagatggcatagcatttaataattatgggagtatatatgctctaaattatagtgatatgtttatgggagaagacataaactcagatagaataatatcaggagccaatgtattttcaattgtaatagttacagcaataattgtattgaacatatttgaagagttaagagatttagtttttaattatttaattatagtaacagcagtattgttaatatctatgtttatgaaaatggttgtaaaatataaagctttatggtcacttgttatttatgcatctacaatgcctttaattattgttactattcttaatctattaaaacctaatattaattttgatttaacctttattggcgggacatttacttatgttgtattaacattaaaacacattaaatatgaaataatacaaaacctaagcaggagaaaaatttaaataaagaatatattacggaaaaataagcaaggatttatgatagaaatttataaagcaataaaaaatataggtgtaattagaatattgtttaaacagtattttaattacacctatattttaatgttttttacatctaattaattttgaacaagtgattcatgattaattgtagtattatctaaagcttcttcacttgaagattttttttgaacaaaatagtcaataattaatgctagtgcaccatcaccagttacattagttgcagtaccgaaactgtcttgagctgagtgaagtgctatcattataggtttttctatatctccaaatcctagcatactttctagcaatcctaaagcggccataactccaccaccaggaacaccaggagctgctaccattgttacaccaagcattaagatgaatggcatcattaaaccaaaagtaggaacctgccctttcattaacataacgcctattgatgttaacacaagagtgattgtatctccagctaaatgaatagtagcacataatggaactacgaagtttgctacttcttcagaaacattattttcttttgcagaagctaatgtaactggtattgttgcagcagacgattgagtaccaacagcagtaagatatgctggaatcattgtttttaataattttaaaggattttcttttcttagtatacctgcaattgaatattgacataataaatatgcaatttgtaacccaaacaatacagcataaacacttgcaaaagattttaatgttgtaaatatttcacctgttaaagttaacttagcaaatattgcaccaatatatactggaactaaaggaattaatatattagaaataattttagaaataattgaaccaaattcctcaaatccttttaaaagtgagctattctttattcttgaaagtccaattccaaaaataaaagcaaaaactaatgctgacattatatttaatatagctggaatttctattgtaaagtaaggatcaacattaacatttgaattagaagctaaacttgcagttgtaattagcttaggtaatattgctgaacctaagaaaaatgcaacagtaccagctgtaattgttgatacataggccaaaattgtagttcctaaaagaacttttcctgaattctttccgagagtagcaatcccaggaactataaaagcaataattattaatggaattacaaatgataagaaacttccaaataatgaactaaatgttgaaaatattctaacgggaaaaactatatttgtgcttttacaaataagccctaaaccaattcccaatataagtgctaaaaaaatacgttttattaaagataaatttttcaaaattaagcccccttttaacttgatttgtactcttgtagagaacaaatgtctacctgataaatacaaatatacagtataagatatatttcgtcaatagttaactgtaaaaatttattaattatagttatatgtatttaaaattaaaaataatataatataagtaaagtaatatttaggcattaattaaaaagcaataaaaaatgtattataacgtcttatacaatatggaaaattttcgaaattaatattatacagagttgttaatatgataacaatgtgatattatgtatttatggtatatgggaaaaaaagtaaaaaagaggggcgttataatggagttagtcaagcaaaaccaacaagagaatataaaaagaaaactaaagacggagcttgaaggtttatcaaaagaagaagttattgaaaaatatatggatttgtatgaaaacaagattgcacaggaagactttattttaaatatatctcatgatttgagatctccattaagtgtaatattagggatattgcaatgctataaaaatgaatatgatgaattaaaagcagaagaacatatgaatatagtcaagagaaattgttataagatattaaagcttattaataatataattgacagtacaaaattgcagcaaagacattttaaaataaatagacaaaatatagatattataaatttaatagaatggaatatatcttcaatagataagtatgcaaaaataaaaaatatatctttagtattcgatactaatgttgaagagtgtattgttgcggttgatattagttcctttgatagaataataatgaatttaatttcaaatgcaattaagttctctaaagaaaatagttgtgtatttataaatacatggaaggaagagaaatatataactatttctgtaaaagatcaaggaataggaataccacaaaatgaacaaaaaactatttttaatagattcattcaatcaactaagaataatagaaatgaatactctggaagtggaataggattagatcttgtttttaatcttgtaaaagcacatggaggagttgttgaactgacaagtactgagggacttggaagtgaatttagaataaaaatgcctatagttaaagttgaggatagtatgaaaaaagataaacatagtatggatttaagtagtaaggtagatatttttgaagtagaattttctgatatatatgtttaaaaaattaaagttaaataataaattgaaagtaatctgtataagtaaaattactttcaatttatagtgtttttatggaaaaatatattaatacttttttaaatatgtaaattataatcttgattattattatagcttatgataagataagattgttgtaaaaattttatatggagcgttagttaaacggatataacttaccgctacggacggtacattgagggttcgattccttcacgctctgccatttatttatggaaaaggcttaatttaaaataaattaagcctttttttgtacattaaatttttactataaattataataaaaatttaatctatattacacataataccttgtgaagaggataaattaacaatagaatactaaatttattattgatatggagaatattatgaataaggtattagttaatttatttgatagacacaatcagggaagtcttcttgctatagataaaattaaaccagataaggtgatttatataatagataaggagatggaaagtttatttaaagaaatagaagcttgcgaagagaagatatatcctaaaataaaatttgaaaatcatgtaattgatatgaacaatatttttaatataaaaaatattttagaaaaattatgtgtaaatgaaacaatagttaatgttacaggaggaaaaagaatttattctctagtacttttcaatgaatctttaaatttaggatttaaaacagtttatgcggatgttttaaataaatttttatatgagtttggatctaatattactaaaaaaacttttgaatttagagatttaagtctggataacatgcttcaattaactggaacaaatctaataacagattctacaactttaagtgaaaaaagtgacatagtagcaattactaaaaagatttatgaaaatctatctctatggtataaaaataaacaaaaattatacaataataatatttttatacatgattgttataaccctaacttggtatctataaagactgataatttaaactttgaagacagaaaaattttaaattcatgtttattatttttaaaacaacaaggtggtatagaatacagcagtctatgtaatgaaatagaagtaaggtttttaaatgattatcttaagggatttatttttaaaagtggcacttggctagaagtattaactaacacaattgtaaaagagattacagaagttgatgaagttaaaagtggagttatttttttatggaaagaatgtaatagaaaagtgagaaatgagttagatgttcttgcagtaaaggattctgtttttatatgtatttcatgtaaggatagtgaaaaatatgatgaggatgccttgaatgaattagaagtttacagtaaaagacttggaggaaattcagtaaaaaagattcttgtagccacaaaagaaccatgtaagcaatgtgttattgaaagagcaaaagcaatgaatattaatttgattattctagataaagatataaatagatttagaaaatcaatcagaagtgtaattttagataattaaaaagaatgcagcttagattattaagtaatttaagctgcatttatactatttattaatttttattccgatatgttcaccacaattaactttacattcaaaacctaatttagattgatttaaaatatcagaatcaatgttaacagcgtctttttctaaaaatagaatagtagttgatccaccaaacttaaaatagcctttttcatcacctttttttacttgcttacctggagaatatgtttgaattattgatccaacacatgtagcgccaacttcaatagttaaaatatcaccaaaattatcagaatgtaatattgaccattctcttttgttttcacagaaaagttttggaacgctatttaatgcaatgggattaacggaataataatatccttttatagcattagtttctgtagggattccagagtcaacaaagtgaaatctgtgataatctgtaggacaaagtctaagaataatacatattccattagaatacttttcagcaatagaatcattattaatcagttcaaaaagactataagtcattccctttatttgaactaaattttctaaattaatgttttcgtaagctgtaagtcttccatctccaggagaaactaaaatatcaggatttttatcaataggtctagcttcatcattaagttttcttacaaaaaagtcattaaacgatttaaactcatttattttctttgttgataaattcatatcaatatcaaaatcatctacaaatgattttattttttttgaactaaattttgtatcacaatacataccatataatttagagaaaacttttctcttggcaataagttcagttatatttctaccaataggtgattcatatgtccactcaatatatttttttccagctataagttcttcctcataagattttgtttttctatcataaacttgaatcataaaaaaatctgccaaaccttataaaagaattacttttataatttctcagtctgacgattatcctccatttcttaattaatataactacaatttatcttaattttatcataaataaaataaatatcaaaaattctttattttaagttattattactcgaattataaaaaaatattatttgtgatttttgtgaaaatatctaaaatcagtatatagtttcttttatattaaatagtgtataataaaaatattagagcatatagaaaaagaggcgataaatatgaatagaacaaagaagttaatatttgaatcagctattagaatattttcagattgtggatatcgaggagcgacgatggatgatattgcttcaaatgcaggattagcaaaggggacgctatattatcattttacaagcaaagaggagatattcaactttattgttgaagaaggaattcagattctacaagatcaagtattagatatccaaaaagtagatattagtccaatagaaaaattaataaaaattagtgaagtacaattaagttttctttatggatatacggatttctttaaagttgtaatgagtcaattgtgggggaatgaaaagagacaggatgaattacgtcaaaaaatccgtggatatataaaagaaattgaagttaacataaaagaggctatgaatgaaggaaaaatagaatcaggtgattcagagcttatggcatatcaattctttggcgctttatgtactgctgcagtatatgaatctattcatatagaaaaaatagatttagacaatataataagaaaaactgttgaatttacccttaaaggtttaggaatacaaatgtaatgtcaaggagatacataaatatggttgtatctccttattctttaagattaatacaaaaataatataataatatattacaagtatataaattatggtaaaatatatattgttattacaaaaaaacaaaaaaatagtagtgtgtatggaggaatttatccaatgataaatttaattattgatgaaaaaaatgttcaagtaccagaaggtacatctatcattcaagctgcattagataatggaatcgacataccatcattatgttacttaaaagagtgttcaaatgttggtaaatgtggggtctgtgcagtagaagttgaaggaaaaaaggttctttctcttgcatgtttaactaaagtagaagaaggtatggttgtaagaactaatactgaggcaacacaagagagagtaaagatgagagtggcagctttacttgacaaacatgaattcaaatgtggaccatgtcctcgaagagagacatgtgaattcttaaaattagtaatcaaaacaaaagctaaagcaaataagccatttctaccaactgataagacagaatttttagatgacagaagtaaatcaataacaatagacagaagtaaatgtgtactatgtggaagatgtgtagctgcatgtaaagaaaagactggaactggaaatattgaaatttcaggtaaaggtccagatagaaaagtgcaggctattgaaggtaaatgttttgatgaaacaaattgtttattatgcggtcaatgtgtagccgcatgtcctgtagctgcattaaatgaaaaaccacatatagatagagttaaagaagctttagaagatcctaataaacacgttatagttgcaatggctcctgcagttagaacatctatgggtgaattatttaaaatgggatatggagtagatgttactggtaagttatattcttcattaagacaattaggatttgataaagtgtttgatattaactttggtgctgatatgacaattatggaagaagcaacagagtttattgaaagaataaataataatggaccatttcctatgtttacatcatgttgtcctgcatgggttaggcaagcagaaaattactacccagaacttttagggaatttatcttcagctaaatcaccacaacaaatatttggagcagcaagtaaaacatattaccctacagtggaaggattagatcctaagagtgtttatacagttacaataatgccttgcactgctaaaaaatatgaagctgatagaacagaaatggaaaatgaaggtttaagaaatatagatgctgttttaactacaagagaattagctaaaatgattaaggatgcaaaaattaattttgctacattagaagatgagaaggcagatccagcaatgggtgaatatactggagctggagttatatttggtgctacaggtggagttatggaagctgctcttagaactgctaaggactttgtagaagataaggatttaattgatatagaatataaacaagtaagaggattagatggaattaaagaagctacagttgaaattggaggtaaaaactacaatgttgctgtaattaatggttctgctaatttaactaagtttgttgagggcggacaaatggatgaaaaacaatatcactttgtagaagttatgtcatgcccaggtggatgtgtaaatggcggtggtcaaccgcatgttgcagctaaggatagggatactgctaatgtaagagcagtaagagcatctgttttatataatcaagataaaactgctataaagagaaaatctcataaaaatgaagcattaatgaaaatgtataatgaatatatgggaatgccaggacaacataaagcccatgaattattacacttaaaatatactaaataattagaataaagttataaagcatagtttataaaagcaagatagactatgctttttttgttaaaaaacttgtttaaaaaagatagatatgtaagagcactgattatgagtgtctgataatataaggattaaaagtaattatacagatgctaatatatattgttaacacttattatagtataattatacttagaattaaattttatacagtggaagatggagggaatatacgtgaaaattttagctagtgatttagatggaactcttataagagaacaaaagatatccccaaaagatttaaatgcacttaaaaagttaaaagaaagtggacataaagtaatagtatctacaggaaggacattaagtggggttgaatctgtttttaaggattttccttttgagtatgattatttagttctttgtaatgggggacttgttttaaataaaaacaatgaagtaattcatgaaaaatcaatagactatactgtgaagaatggtataattgatgatttttacaatgatggaactctgttaatgtattatgataatggtgaagatacatatttaattaataattcatcagttgatatatcaaaccttaaagatgattttgtagaaaccttttcgagtaaaatagaaattaaagatgcattaaattcaaagggaacatataaaatgatgagtgtttttgatgtaatgggttcaattgaaaaatgtgaggatgtaaaaaataaaatattagacaagtatggagattatgttgaagcttatagaaaccaatgttttatagatgttgttccaaagggatgctctaaaggaaatgggattatgatgatattagaggatgaaaagttgaatacggatgatgtttatactgtaggtgattcatttaatgatgtatctatgtttaatataacaaaaaatagttatacatttaatgaagcagaagatttagtaaaacctcatgcaaataatctaattgattatgtacacgaaattgtagaagaaattttagaaaatagtaattaattaaaaaaggctggattttaatccagcctttttattgtaattatttatttgagaattctatatattcatcaaatgtcatagttctgtcaacgatagaaccatcatctttaatatcaattattctatttgctatagtttgaacgaattggtgatcgtgagaagcaaatattatgttactgttgtaattttgtaatccgttatttacagcagtgattgattcaaggtcaaggtgattagtaggttgatctaacattaatacatttgcattagaaagcatcattttagataacatacatctaaccttttctcctcctgataatacattagcttcctttagagcttcttctccagagaataacattcttcctaagaaacctctaatatagctttctgatttttcttcagagtattgtctaagccaatcaactaaagaaagagtgcagccatcaaagaatgctgagttatcagttgggaagtaagaatttgttatagttattccccatttgaattctccactgtctggttccatttcaccagctaaaattttgaataatgtagttacagcaatttcattacctataagagcaattttatctcccttattaactatgaaattaacattatctaaaactttaacaccatctacagtttttgataaatccttaactgctaatatatcattaccaacttctctttcaggagtaaatcctacaaaaggatactttctgcttgaaggttggatatcatctaaagtaatcttatctaataacttctttcttgaagttgcttgcttagatttagatgcattagcgctaaatcttgcaacgaaatcttgtaattctttaattttttcttcttttttcttattttgatctttagacatttgaagagctaactgacttgattcataccagaagtcatagttaccaacatatatcttaatcttaccaaaatcaacatcagccatttgagtacaaactgagtttaagaaatgtctatcatgggatacaacaataacagttccttcaaagttacctaagaagtcttctaaccaattaacagcctttaagtcaagaccgttagtaggttcgtctagtattagtattccaggattaccgaatagagcttgagctaaaagaactttaactttttctcctccagttaattctgatacattcttaaagtgatattcagttcctattcctaaaccttgtaaaagtgaagaagcttcagattctgcttcccaaccattaaggtcagcaaattcaccttctaattcagatgctttaattccatcttcatcagaaaaatcaggctttgcatataactcatctttttctttcatgatttggtataatctttcgttacccattattacagtttctaaaacttggaactcatcatacttgtagtgatcctgagttaatactgacattcttgtgttaggtgcaataattacttcaccagtattaggttctacatcaccagataatatttttaggaaagttgatttcccagctccattagcaccaataactccgtaacagttaccagcagtaaatttaagatttacatcttcaaaaagtttacgtccaccaaatcttagactaacatttgatacatttatcaatctatttctacctcatttcttaattatatagtaatttatatttcatatactgacgaagagttgtaatcaccagtataactgatttttagcttatgttgcttattatatcatagattttgataatttacagttaattaaacttagttttacttttattatatagatatacagttaaatgtaagcaattttatctcaaattacaactttaaatttctatatcgattaaaacatgcaattatctcttgttttctaggcattgcaaaagatccaagtccatattttactggacttatagaaataagtccatttttagaaatataatttaaagtttcatctacaatatctataatagttttactattattaactatattatcctcagcaaacttcataatatatcctaatgagtttatttgttcagaatctacaatctgttcaacagcccttaactctattatatctttgtttatagataagccatccttgccaatagattttatttttactcccttaggtcctgagaaaatagagcctttctttaattttctattgaaatttatcgaaacattgaacgaagagttattgatacgctctaaaacagttcctttacttaaagctttagcttgagatgttacatcctttggagtataagaatccatttggataacagtatctgcaatatcaaagtagtcaccagaacttccaacaactaatattgtagaaatgccgagtttatcataaagtgatttaactatttcaataaatggagttataggttccttttctctacttacaagcttctgcattatattatcacgaatcatgaaatttgtagctgaagtatcttcatcaattaaaaagactttagtatcggattcaataccctcaattatatttgcagcctgtgaagtacttccacttgcattatccgtactgaatttttttgtatcttttccattaggaaggttatttataaatagagatatatcagtattagttataaatcgtccatcttctgcccttactttaagggcactttcatcagttataacatactcacgtccatcaccttcgatatgattgtatactccaagttccaaagcctttaaaactgtagatttaccatgatatccaccacctacaaataatgttattccttttttaatacccataccttttagtttgcctttaaatggtaaatttatttcaatttccatagatttcggagaactgaattttagaccattttttaatggttttgtagaaatcccgctttcacgaggaagtatagaaccatttgcgataaaagcaactaaattattctctttaagatattttcttatgtaattttgatcttcacttaattctattctatttttaatagaagatttattaagattatcataaataagagtgttatctattatttgaggtaaaaattcaaaaagaattttttctaattctctagataaaacagttcttcctcttgcgggaaagcctacttcaaatctgacttgaacctcattggaagatattattatagcggttctttgaagaatttcctgatcacatttacttatgcttataagtccgctttttcctgaaccaaacactttagaagaaaatttattaatgtttgaataaaataaccttgtaagataatcttctaaagcaatttttttataatcagtatcaaaaagttcaacaggaaatttagctgtttcttgattcattattatttgtattttagacggtgaggcaaaaggatcaccttgaacatgatctatacttaaaatataatttttaaaattatatttatcagctaatgatttatatgaatcatagctttttccatcaatagaagaaagcaatttttttaaatctaatgaatttttcattgctattttcctcccttaaactcactaaaacattcatcaattattttttcactcattcgtctataaagattactcatacttacaaatgcacatactaaaagaaatttttcttcaaagtcacctagtttttcatctttatttttgataagttcatttacatgatttgaaatatttgtagatgaaatatcgaagttttctagatttgaatcataaatttttaaaaatgattcataaatatcataaagaggataatcttcatctttagaaaatgattctattataggatcaaacatggtttttatatctgttaatgataacgctccttttaagttgtaaataagtccaataagaatcatatgttcttttgtatactttttatttttaattttcattagaagattacctttagcataattgttaatcatagttttagtaagaattttatcatcttcatttctttttgtgtaatttaatttactttcaaaaagctgtattacttgatccatataaagatcaatttcaggaaaatcatctaaattaatattagtagaagatttttgagaatttatataattgtcaatatcaaagttgttcataaaatttcactccctacatagtaattaaaactacgtgttgtattataaatataatattaatagaaaataagagataattcaagcattcttaggagaaaataaatatatactaaaaaaataaataaaaatcagtcttgccatatagatgtttatatgaaataatttctataatggtaaaaggtagtttttaaaactacgtggaataatttaggaggaataagaatggagaaatatttaagagaacctgttaatggattaactcatttgattggagcagtattatcatttatagcattaattgcgatgattacaaaatcatatttaagaggaagttcacttgttactttttattcggtgttattttttggagtaagtatgattttactgtatagtgcatcaagtatatatcattcagtaataagtagtgaaaaagtaataaaagtactaaagagattggatcattcaatgatattcatattaatagcaggatcatatgctccgttctgtttagtagcattaagtgggaatgtaggattcaatttatttttagcagtaacaatatgtgcagtagttggaattgggttcaagttattatggataacatgccctaaatggttaagcagtactatgtacataggaataggctggtttgctatttttgcaatttatccaatgtcaaaggttttacctgcaatagctttattttggttagtattaggtggaattatgtacactataggtggagtaatttatgcatttaaaaatgaaaaaataagaattggtgcttttggaaatcatgaaatatttcacttattcataatggttggtactttgtgtcattttatatgtgtgttcttctatattatataaaaagtggatttgatataagttcaataaaaaaggtctgttgtattttttgcaacagaccttttctttaaaatattaaattagcgcaaagaacaattataggtaaactaacaagtgttctttctaagaagattaatattaaatctgtgaatttaacaggtatttttgaaccaagtaaaagtcctccaatctcagacatataaataagctgagtgacagatatacatgcaactataaatcttgtcatttcatttgatattgttgaagctagaactgatggtataaacatatcagcaaaaccaacaacaagtgtttgagaagcagcagcggcttctgggacacctaataaattaagaagaggaataaatggtgtacctaatacctcaaagaatggtgtatattcagctattattaatgctataccgcccatagccattactataggtaaaacaccaagccacatatctataacatttcgtattccatcagcaaaaaagccttttatacttgaattatcttctgctttttcaagtgctttttcaaggccatatgtaaatgcagtatatccagaaggaatattatccatatccttttttggcgccgatccatcaatatatgtattagactttcttgataaaggtggaattcttggaactattatggctgcaactattccagtaagtgtaacagttaagtaaaatggaacaaacatatgactaagtcctacttgagtaataaccattaaactaaaagttattgaaacagcagaaaatgatgttcctataattgaagcttctttttttgtatagaaaccatcttcgaactgtttacttgttaaaagaattccgatggtaccatctccaagccaagaggtaatacagtcaatggatgatcttccaggaagtttgaatattggtctcattacttttgttagtaaagctccaacaaattctaataatccatggttaagtaataatggtaaaaataaaccagcaaagaagaatacagagactaatagaggtaaaaggctgaataaaaccattcctcctgttgaatcagaccatataaactcaggtgctaatttaaagtatgtaagtattgataagatcattccaattattcttccagtcatccatattggagtaacattgaataatgaatttaagattttgttatcagttttgtaaaatttaatcactatacttcctatagccgaaatagaaattagaatcgtgacaatcaatggaagaaagtcattaaaaagttctactaacttattcgataaaaatgcaattggaatagtgaattgtccttcgattttaaatggtgtcataaataatagaactccaattaaagaaggaataataaactttaataaggaagatattctataattacattttgaattattattcatttttatcacctttttctttataaatatacaataagtactattctaatatataaaaacaaaaaagatagtattattttatagtaattttaagtatttatacaaaaaaattaaaaacgaaagaatgatgtttattattgtgtatttaatctaaagaaataattagactgtagtctatattgataacctatatgggctatagtaagataaaatatagaagtaaataaataatattgaggagatgtagctataatgggctttcgtgaaaatttaaaaaatgcaaaaagaatagttgtaaaggtaggaacatcaacattaacttatgataatggaaatattaatttgtgtagaatagagaaattaacacgagttatttcagatattgttaattcaggcaaagaagttgcgcttgtatcatcaggtgccattggtgttggtgttaataaattaaaattaaaagaaaagcccgtaactataagagaaaaacaagcagttgcagcagtaggacaatgtgagcttatgcatatatatagtaaattttttagtgaatatagtcatactgtaggacaagtattacttacaagagatgtaatagaagatgatcatataagagaaaatgtaataaatacgtttgaaacattattagaaaacaagatagttccaattgtaaatgaaaatgatacagtatcaatagatgagatagagaatatagttagatttggagataatgataatctttctgcaatagtttcggtgttgactaatgcagatttattaatcatattatcagatatagatggattttatgatagtgatccaagaaataatgaaagtgcacaacttttatcacaaatagaaaagataacacctgaattagaagagtgtgcaggcggagctggttcaaaactaggtacaggcggtatggttacaaagcttacggctgcaaaaacagctatagaggctggtgtagatatgattttagctaatggaaatgaacctgatattataagggatatattagacggaaaagaaataggaacattatttgttgggaaatcaaattaatggtataaagtagttttaaggattttaaattacatataaatctttgatttaaatctgtagaataataaggatttatttaattataaatagataggggtgtataaaatgagtatattagaaacaatgggaaaaaaggcaaaagaagcttcgtatgagttaggagcagcatctacgaaagaaaaagataaggcattattggctatggctcaagaattgattgagaatacaaatgaaatacttgaagctaataggattgacttaaaaaatgcagaaattaaagggacaccaaaggctatgttagatagactagctttagataaggatagaataaaagcaatggccgagggtctaaaagaggtcgtaaatttacaagatccggttggagaagtggtttctatgtggcagagaccaaatggattacaaataggtcaaaagagagttcctatgggagttataggaataatttatgaatctagaccaaatgtaacatgtgatgcagcaggattatgtttgaagactggaaacgcatcaatattaagaggtggaagtgatgctattaactcaaataaggctataatggtagctttaactaagggtattgaaagagctggtcttccaaaggaatgtgttcagttaatagaagatacaagcagagaagttgctactgaaatgatgaaattaaatgaatatatagatgtgcttatcccaagaggtggagcagggttaatacaatctgtagttaaaaatgctacagttccagtaatagaaacaggtactggaaattgtcacatatatgttgatgaatcttgtgattttgatatggcagttaaaatcgctgtaaatgcaaaggcatcaagaccatcagtatgtaatgctgcagaaaaattattagttaatgaaaagatagctaaggattttctgccaatagcagttaaggtcttaagagaaaatggagttgtacttagaggtgatgaagcatcacaagctattattaatgatattgaaaaggctaatgaggaagactggagcaaagaatatttagattatattatggctgttaaaatagtaaaagacgttgatgaagctattaatcatataaataaatatggaactggtcattcagaagcaataattactgaaagctataaaaactctcaaaagtttttacaaagagttgatgcagcagcagtttatgtaaatgcatctacaagatttactgatggtagtgaatttggctttggagctgaaattggaataagtactcaaaagcttcatgcaagaggacctatgggcttaaaagaacttacaactataaaatatattatttatggtaatggacaaataagataagaatttatagatagttaaaatacatgttattatctatacagctaaagggttgtactttattgtaataatcctttagtttttagtttatagaaactaatataataaagttaaatataatagaaaaatttagatataaacacatttaacagtaataaaatttatagtataattattatgaaaacgtatcaaaaatcgaaaaaagggggctgacttaatgaaaatagcattaatagcacatgataaaaagaaacctataatgatagaatttgctaaaaaaaataaagaaatattatcaaaatatgaattaatagcaacaggagagacaggaaggcttgtttctgaagcaacaggacttgaagttaagcaatatttaggaggaccatatggtggagaccaacaaataggaagtcgtatagctgaaaataaagttggattagtagtattctttagagatccacttacagcacaaccacatgaaccagatgtttccgcattacttagagtttgtgatgtacataatgttccagttgtaacgaatcttgcatctgctgaattagtaataaaagaattttaaattatatttttataatttaactaaactaaaaaaagtgcttatgtttatcataggcacttttttagaaaacagtagtgtcatcagaataaattaggtcagctcagaatggaactactgtaactgcctaaaaattctgaatatttgtgtaattaaataataacatattttaataaaaaaacaattagtaatacgatatttgttaaaatatttattttttattaaaaataatatcaaatattaaataaaaaaatattaaattaaaagggagaaatttattatgtttaattttaaaaataatataacagagcaagttgttaatgatattgcattattaaaaaatgttaatgaaaaatttaagatagataataaaacactagaaaagataaaatctataaatttcagaataaacacaggaaaaactacttttgaagagataacaagattagtactaaattctgttattcaattaagtagtttagatttgcaattaaaagataaagaagaaattataactaaaatatcagataatttagtaaatatgattaatgaaatttcaaatgtttctgaaattactactcatacctcagaagaagttacagcagcgcatagtagtatgacagacaatataactgcattatcacataatacttctaatttattagagtcagcaaaaacaagtgaaagaaatttacttgagataaagaagttttctgaagaagctataaattattcttctgatatgaaaagtgatatgaataatcttacaaatgtaattcaaaatatacaaaatgttattttagatataaatgaaatatctgaacaaaccaatttattagcacttaatgcatccattgaagcatcaagagctggagaaagtggacgtggatttgcaattgtagcagaggaaataagacaactttcggatgaaacaaagaatcttataggaggaatgaatgagtttttaacatcgataagacaagcatctaatacaagtaattttagtgttgataagactgtaaaatcactagaaaagataaatgaaaatttagatgtcattgtagagacaggtaaacaaaatagaagagatataaataatattacagaaactgtgagtatgcttgctgccaatagtgaggagataaatacatctatagatgaagttactcaaagtattaaaaaactagataatgatatagatattttgaatggaagtgcgagtgatttaaaagaagttagtaatggattaagcaatgttataagtcccgtaattaatatggaatctgatttagataaagcatctaaattaataggtaatatggttaaagatgtatattatatgacaagtaatgatctatttatagagacggtaaataaagctattgaagcacataaagtatgggttaagaatcttaaaaacatagtagatacaaggaaaataataccgttacaaactgattctcataaatgtgggtttggacatttttattatagtatgttaccaaacaacaaggagatattattaatatggaaaggtatagaagaaaaacatacaatgttacataatattggagctgatattataaaaagaataaaatcaggtcaagatgtatcaagcaatgattacataaaagcagaaaacatatcaaaagaacttataaatgagtttaatgaaattatacatttatccaataatttaagcaaaagtaatattaatgtatatgataaagaataaaatctgtattaaatatgaataattataccatattaatgaataaatatgctataataagggtagtataaagtttttatatgtacaaaaaatatccaatagggtgattataaaaaaattagtattaaaactatccttatttatcttgacatggaatacgctatctactagaatggtagaaagagaaaatttaaaataaagttaagatgcactttaacttggtcctgtgaggccaaaaaggtagtataactatgatatttaaatattcaacggtgaatttcatagcttattttttgaagccaaatatatagatatatcacaggatagtgaagagagcagaatactgtatccctttattatcctttatttttatataaaaatcttcgtaaggtgtagttttagcaaattatattttgtaggaggcttgaacatgaaggcaaagcttatattagaaaatggtatgatttttgaaggtaaagcttttggttatcttaaagaaagtgttggagaagtagtatttacaactggtatgactggatatcaggaagtattaacagatccatcatattatggtcaaatagtaactatgacttacccgctaataggaaattatggaataaatctagaagatatggaatctgacggaataaaagttagaggttttatagtaagagaaaaatgtgatttaccaagtaattttagatgcgaattagaattagaagacttcttaaagcaaggaaaagtaattggtttagaaggaatagatacaagagcattaactaaggttttaagaaacaacggaacaatgagaggaatcatcgcattagaagatttagatgatgaaactgtaaaagaaaaaatagctaatttctcaaatacagaagctgttaaaaaggttacaactaaagaagcatacactattgatggtagtggaaaacatgttgcaataatggattttggaattaaaacaaacataataagaaatttccaaaaaagaaactgtaaattaacaatcttccctgcaacagcaactgcagaagaagtactaaatgtcaatccggatttggtatttttatcaaatggccctggagatcctgaagatttagatttcgttatagaaaatattaaaaaaatagttggtaaaaaaccactagttggaatatgtttaggacatcagttattagcattagcactaggtggaaaaacaactaaattaaagtttggacacagaggatgcaatcatccagtaaaagatttagaagaaaatatagttcatataacttctcaaaatcatggatatgttgttgaaacattaccagaaaatatggaagttacacatgttaatataaatgatggaacagtagaaggaatgaagcacaaggatttaccaatatattcggttcaattccatccagaggcatcagcaggtccaaaggatagcgaatacatatttgataaatttttaaagtatgcactttaggaggttagtgagaaatgccattaaataaagatataaaaaaggttttagttataggatcaggtccaatagttataggtcaggcagctgaatttgattattcaggaactcaagcctgcgaagcgttaaagtcagaaggaatagaagttgtacttgtaaattcgaatccggcaactataatgacagataaggaagttgcagataaaatttatttagaaccattaactttagagtttttagaaaaagttatagctaaggaaaaaccagacagtttacttgcaggaatgggtggtcaaacaggacttaaccttgctgtggaattatatgatgctggaatattagataaatataacgtaagagtaattggaacatctatcgaatctattaaagaaggtgaagatagagaattattcagaaacatgatgaatagaattggagaaccagttataaagagcgaaatcgtaactgatttacaagctggtatagattttgctaataaaataggttacccagttatagttagacctgcatatacgcttggaggctcaggcggaggaatagctgatgatgaagaagaattaagaacaatcttagagtcaggtcttcaattaagtacaataggtcaggttttacttgaaaaatcagttaaaggttggaaagaaatagaatacgaagtaatgagagattcttatggaaactgtattacagtatgtaatatggaaaacatagatccagttggtatacatacaggagacagtatcgtagttgcgccatctcaaacactttcagacaaagaatatcaaatgttaagaacagcatctatcaatattataaatgcagttggaattgaaggtggatgtaatgttcaattctccttaaatccaaatacatttgaatatgcagttatagaaatcaatcctagagtttcaagaagttcagccttagcatcaaaagcaacaggataccctattgcaaaacttgcagctaagattgcacttggatatggattagatgaaataaagaatgcagttactcaaaaaacatatgcatgctttgaaccaacactagattacgtagtagttaagattcctaaatggccatttgacaaattctttggagctgatagacagcttggaacaaagatgatggctactggtgaaatcatggcaattggagctaattttgagcaagcattcttaaaaggtattagaagtttagaaattggaaaatactctttagatcataagaagtttaaagaacatagcatggctcaattaaaagaattagttatgaagccagatgatgaaagaatctttgctttagcagaaatgataagaagagattatagaatagataagataaataaaatcactggtatagataagttcttcttagaaaaaatcaaatggattatagatgaagaacaaagattaaaattaagtaaaattgaagatttagataaagaatggttatatgcattaaagaaaaaaggattttcagataaagcaatagctgatatgttaaaggttagtcctgatgatgtatatagattaagagatatatggaacataaaaccatcatataagatggttgatacttgtggaggagaattcgaagcattatcaccatactattactcaacttatgaacaatatgatgaagttgaagtatcagataagaagaaagttatagttataggatcaggtcctattagaataggtcaaggtattgaatttgactatgcttcagttcactgtgtaaaggcattaaaaaaattaggaattgaaactataatcgttaataacaatccagaaacagtaagtacagattttgatgtatctgataagttatattttgaaccattaactgaagaagatgttttaaatataattgaaaaagaaagaccagatggagtaatacttcaatttggtggtcagacagcaatcaagcttgctaacttcttaaaagaacaaaaagttgtgactttaggaacaacagcagatcaaattgatatggcagaagacagagaaaaatttgatgaattattagaaaagttagaaataactagaccaaagggtaaaggtatatggtcactagaagaagggttagaagaagcaagaagattaggattccctgtacttgttagaccttcatatgtaattggtggtcaaggaatggaaataactcatgatgaagaagaattaacattctatttagaaaatgcatttgctaaagataagaagaatccaattcttatagataaatacttaatgggtagagaaattgaagtagatgcaatttcagatggcgaaaatgtattaatacctggaataatggaacatttggaaagagctggggttcactcaggagacagtgttactatgtatccaagtcaaaacatcactgatgatatgaaaggcagaatcctagattatactaagaaattagctttagaaataggaataaaaggaatgataaatattcaattcatagaatttgaaggaaatttatatgtaattgaagttaatcctagagcgtcaagaacagtaccatacatcagtaaagtaagtggagttccaatagttgatttagctacaaatgttatgttaggagctaaattaactgacttaggatatggagtagacatatataaagaaccagaactagtttcagttaaggttccagtattctcaactcaaaaattacctaatgtagaagtttgtttagggcctgaaatgagatcaacaggtgaagttttaggagtaggtagaaatgttaaggaagcactttacaaaggatttgtaggagctaatatgtacccatcaaaagaaaagggtaagatacttgctacaattaataaacatgataaacctgagttcttagaaatagctaaacaattagctaaggtaggatatacatttatagcaacacaaggtacttgcaaattactagaagaagctggtataaaggttgaagaagttagaaagataaatgaatcagaaccaaacattttagacgtagttaaacacagagaagtggatttagttataaatacaccaactaaaggaaatgattcaaatagagatggtttcttaatcagaagagcagcagttgaaagaaatctaggtgtaattacagcgttagatacattaagagctattgcagatgtggaacttgaaaagtttgatgaaaacaaaaatttagaagtatttgatatagctgaaatttaataataaaaatgagtcatcaggtttttgatgactcatttttattagggtaatattaccacggtggtattgacaagtgaacatgtgttctatataatataattaatgaacatatgtttgctaagggggatgtatattgtgaatgaattaggtaatttttttgtaaaagtaaactgtaaaaacatggacaacattagaagcttaataatagatagggaagtaaaatcaaaaggcagacaggataaatacataatgtgtgctggaaaatacgataaaaatggctggacgttgatttttagagcaaaaacttttgaagaagctgaagaattagctagtttaaatccatttgcagacagaagaagtaagataaattagaatagaaattatacatacatatacatagtaagatattaagcaataaaaagctatttaacaataaagttaaatagctttttatacttcataacgaatatctgatattacaattgatagatattctattagatttaattctgcaccaatttgttcttgattgtcactttttattatttttacaattggacgtaaagggaagtttggtaatgtttcttctacaattcctatatcgccattgcttaagcttacaatggtaccttttggatatggaattattactttgcaaaaaacattaactatatcataatcaaacaatgtacctgcatttgacattatatattcaagtgcatcacttgggcacatagctcgtttgtatggtctatcagaagttaatgcatcatatacatcagcaatagaaacaattcgcgcaagataacttattttatttccagtagttccatctggatagccaagtccatcaaatcgttcatgatgctgtaaaactattaattttatatgtgcacttaatgaatagaattgagttaaaaaatcatatccaagtttaggatgatcttttataacttgaaattcttcaggagttaatttacctggcttttgaagaatttcgtgcggaataaaagctttacctatatcatgtaccaatgcacccatgcataggtatattaagttttgtttgcttaagcttaagcttattccaattattatagagataacagctacatttacacaatgagcatatgtataattatccatattttttatgtcaactaaagataagagtacgtttttattacttaaaacattttctaagagttcttctgcaacctcatttatgctattaaaatagttttgttctttttgagaatattcgctaagtttacgcttttcgaatttatgaacagaagaaattcgttcaatgtcagaaaatacttcttttataacggaaattgatttttgccttaactcaggttttattacatcctcaatttcggcagagctatattcatcaattatataaagagagaatatttttaaatctttaattttttttagacgaatacttgtaagttctactccagctcttaataaaactcttccgtcagcagtatatatatttttaccaagtagagaattctctcgaatacattctaaaggaactagcctcataagtacatacctcatcatcatcatagtaataattagtataattataacataaaacatatagaaaattataatcaattatgaaaaaaatactataaagtgacataataatttaaaaaataaaatcattagtttttatgattttatttagaaaaaactcatttgtttaccaacaaatgagtttttttagtaataaatattaaatgtctaaaagattctttttataagtcgaatataattttctaagtgtactcatcttatcttcaacttctaaatatagtctagaagcatcggcgaagtcctcattattaaaagcttctatcaatttagtgaataaacttttatttgtgtaagtatccttcattaattcaactcttaaatcatggagatttgtccaattagaaatatctaagtctaaaactttgtctaatgaatgaagtggtttgaacgatcttatttcatccatgtaattttttatgactctatgagtaatttcagttgtccatctttcgataaaagctagtttgaaactatttatgatttcatcagtaaatacactgtttctttttaatgctttaattttagatggattattgtttaattgagataaattttcataaactgttgctggagcctttccaaaatacttatttctttcagcttcggtaaagtcttcgaaaatattatcttcagttctatacgatcttgttttttcaaggtattcagctgaatctcctgcattctttgaaagttctttaagtaaatcatcttcagttttattattttcagctgcataaattatcccatcgagcattcccatataagaggcagccattacaagataagtgttagaatgtggatttggagatctaagttcaaatcttgtagccataggagaatttaaatctcttattaatccagcaagtactgttctatttctagaaggattttctggagataatccaagtgatgttacagtacatattggagcctcaaaaccaggttttaatctttttaaggaattgtttgttgaagatacaaatggatttataacttcatagtttttaagaagtcccataatagcaccatatcctatttggcttaggaagtgtccttgtggaccattaaatatatttaatctttttccgttatttaattttaagcttacacctaaatgagtatgcataccagaaccagcaacattttcaattggtttagccataaaagtaacatctagtccatttcttctgaatgtttcttgaacaagaattcttacaaataattcattatcagcagcttgaacagcatcagagaacttccaatcaacttctaactgttccattacatgatcaaattctcctgaactatttaatttagcttttacaccaccaacttctttatgacccatttcaggttcgaatccgtatttttccattagtataagtgtttcttctaaagcagttcttacagaacctttagttcttgtccaataatgttcgtgtaaaacttgagatgtagataattcatcaacatgggctatattgttaggagtctttacccaaaattctaattccgttgcagatgttattactacttcgtcaatatcatttgcagttatatcaaatgattttaaggtttcaggatgagatttgaaaatattcataagagtatctttaaaagtagaaactgctgaagtaagtatatgtcttgaatcaacagcaatgttatcatgatataggaaacaagggattcttaatgttccaacaggcttgtcagtttcagtatctataaaatcatagttataatcaacaaaccatttgcagtttaaatcagttaccatatcaacttttgcattatctaaagttgcaataccaggtaaaactacagaagaaccatctgtttgaacagcaacaccctttaagaatgattccatatcctctaaaaataattttacaggaattttttcatcagtatcattacctgataaatcaatacctacaaaagaaacaaattttatttcaggatgattgtttagtattttttttaggtcctcagcattatgattttctttggcaataatatacagtaaattattcatatgttcgtttattacagacaatactgtaataaaacagtcacatcctttcctataatgtcgaataaaaattaaaaaagtagaattaacattcgtatttatctataaacaaattctattataaaatcagtaataatgtcaataattatatacgaaaccttatattcttatgaattttagtcgtgaaaaattattttcattagtgaaagtaatttgatactttattttcttaatataatataaattaattttatgaatgaaatttgaaaatgagaaaatatgaagttataacttaagtaaaaactattatagatttattggtaataaagtaataaaatatttatagataatctaaaagaagatggagtgaggacactttggatattaaaaatagtcctataggatttttcgattcaggagtaggcggattgagtgtactgaaagaagcaatttcaataatgccaaatgagaattatatatattttggagattcaaaaaatgctccttatggaacaaaagaacttgatgaagtaaagcatcttacatttaatgcagtagattttttacgtgaaaagaatgtaaaagcgattgttgtagcttgcaatactgcaactagtgcagcaattgaggagattagaaataaacataatgatattccgattataggtattgagcctgcgttaaaaccagctgttaaattaaagcgaaatggaaaaataataataatggctacacctatgactttaagagagaaaaaatttaagcaattaatggttaaatatcaggaaggatcaaatatagttcctatgccttgtgcaggccttgttgaatttatagaaaatggaatacttgaaggtgatgaattagaaaagtacttaaaaaataaatttgatatttattttgatgatatagcagcaatagttttaggatgtacgcactatccgtttatcaaggaaactttagcaaaggttgttggtagtgaaattcctttaattgatgggggagctggaacatctcatgagcttcagagaaagcttgaagagaaagggactatttctgattcaaaaaacataggtaatgttgaaatttataattctacaaatgatatgaaagttatagatttctgttataatctaattaatgtgtaggattctgattaaattagaataattaatcatatttattgaaattgatttttataatgtatagaataaattttagattaatatattttaattctgaatgttcagcagaattttagacaatactaatatttaagagtgatagttgaagggagaaagttaaaatgaagaatccaattgttacaataactatggaaaatggaggcgttattaaggcagaattatatccagaagttgcgcctaacacagtaaataattttgttgatttagttaatagaggtttttatgatggattaatattccatagagttataccaggatttatgatccaaggtggatgtccagaaggtacaggtacaggcggaccaggatattctataaaaggtgaatttacttctaatggatttaagaatgacttaaaacattcaaaaggagtattatcaatggctagagctatgcatccagattcagcaggaagccaattctttataatggtagcagatgcaccacacttagatggtcaatatgcatcatttggaaaagtaattgaaggcatggatgaagctgataaaattgttaaatcaaaaagagatgtatatgacagaccttatgaagatcaagtgattaaaactatgactgttgatatgcagggtgaaagttttaaagagccagaaataatagaagaataatacttggaaattgtaatacataagtaaatataaaagaattaatgtatattaagatgttaaaaaacattttaatatacataatttttaataaggccaaatgaagagaggtgcttaaaatggctataaattataagtgtatactagcatatggtttaagtgatgaagaacttgataagatacaaaaaagaagactaaaggtaaaagtagttgatgacaaaaatgcaggattaagaattatagatctactttgtagtaatgatatggaggctccttgtaataaattgcctgaaaatgaaaaggcacttatttttaatggatataacgaaaaagaacttagagaaactattaaatttatacgaagattcatagaaggcggagtattagccgttgttacagagcaatcaagtaaatggacttttgattatttaatagaacatctaatagaagagagagaagcatataaatcacaacaaggggggcaaagttagcatgagtcgtgtaggagaaaatataaaaaaagcaagagagaaaagtggattaactgttaaggcattagcaaaaaaacttggagttgctgagaaatatttaaatgaagttgaaatgggaagaaaagttgcaccagaatcatttatagataaggctgcaaaagtattaaaagcagacttaaatgatataagcatggttgttactgataatgatcttatggaagaaaagaagacgtttaaagaactccctaaaagaaaaaatgatagcaacgaagtttggacagatgcattctcgtctgtacttagaaatgttccaatatataattattcattaacaaagaataatggaaataaagaaatgccagtacactctaataagatagaaggatatcctcaagataaagtcttttatattcagattgaagatgatgaaatgataggatttagaatgttaaagggtgatcttgcatttgctcatatagttaaggaattgagtaataatggatttttcttaattgaatataacggtaaaagaaagataagacaagttaagattttaggaaattcaaaagtacttttagttagcaatagtggtagtcttcttacagaaacaatggaagtaagagatataaatgtaattgctaagttagagagagtagaaataacattgtaatgttatataacataataattatttttaaagccaaaaaacgatatgtttcatattgatttttggctttaattttaattaaatttgaaaatttgacattaatagtatatataaggtacaatttcaataagaaactgttgtcaggggaggggaaagtcatagttaatttaaaagaacttattcttaaaagattttctaatggtccgaagacaaaagtaattgctttaataactgtagttgcattattaagcattacttcagtgacagtagcattaacaagaaagacacttactataaatgtagacggtaaagagcagacatttgtcacgtataaagggaccgttcaagatgtgttaaatgaacaaggaataaaagtagaagaaaaagatagcataaaaccagcattaaatgaaaaagttcaagaagatagtataataacactaaaaaaagctgtacctattaaaattatttgtggtaattcagaggtacaggttaatacatcacaagaaacagtaaaagatgttttagaatcagaatcagatttactaaaagataatggaataaactttagtgaaggactggatgaagtatcaccaaagcttgattcaaaggttgaaggagatttaacaatacaagttgttaatgttgaaaaacaagagaaaaaagaaatggaaacgatagcatatgaaacagtagttgaaaaagatagtaaactaatggccggaaatacagaggttaagactcaaggaaataacggtcaaaaagaagtgacatatgaagttgtgtataaagatggtgtagaagctaatcgtcaagtaacaagcacaaagactatttcagagcctactactcaagttgtagttcaaggaactggaactatacttacagctagtagaggtgatggatcaggaaaaaaatctataacttgttcagcaactgcatatagtggtggtggtgtaacatcatcaggaaaaagaacttcaagagatgctagtggaataagtactatagcagtagatccaacagtaataccaataggatcaaaagtatatgtagatggatatggatatgctattgcagcagatactggtggagctataaaaggtaataaagtagatttgtattttaattcagaaggtgaatgtagtagttggggtagaaaacaggtacaagtaaagattattgcatatcctggtgaatggtaaaagagataactttaagttatctctttttttatacattaatatctcttttttttagtataaatatatatagatataattctaggatgtgagataatatggccaatttagaacataatgctacgtcaaaaacagatgcatctataggacttttagccaatgtaccaaggtcaatactaaatagaatatatggaaaactaaatattcaaacttatggagaagagaaaattgaattaactattctatatagatatacatcacagagtgcgaaagatttagttgaaagcttaggaggagagttttatgatttgaattttaattttgctttagtatatataccgataataaaattgaaggatttggcaacaagttcggaaatacagtatattgaactaccaaaaggtctgattgaatctgacttggaaagcaatagagaagcatgcgttttacaaacatattcaagttataatatttctggaaagggtgtcatagtaggttttatagactcaggaattgattatatgcatcctgcatttatggatgaaaaaggaaatacaagaattgagtatatttatgatttgagtgatgggaataagacttatgataaaaatgaaattgacagagcaattaaatctgaaaatccatatagcatagtgccacaacaggatttaactggacatggtactcatgttgctggagaagcatgtggaggtggtaaaatacctgcaagatataggggtgtagcaccagagtcgtctataataatggtcaagggtagtagaggaaaatgggtattaagttctcaaataatggttggacttaaatttttgctagataaaagcaaggaattagatatgcctatagttgttaatataagcttaagtaccaatgatggagcgcataatggaacaagtttacttgaacaatatataagtgctatagctaacttagaacgagttacaattgttattgcagcaggaaatgagggagatgcaggacatcatgctggcggtgaatttcaaaagattcaaagtagatcatttactgtagcaagtgatgaatcgatgatagttataaatatatacaaatcaatacttcctgatataacaattaatataatagggccaacaggacaacaaagtggttatattaagatatctcaaggatattttaatggaaatattggtagagatagatttgatatatatgtttcaggacctaagccatttggactagaaagtgaaattcaaataataataacatcaatatcatcagattatttaataccaggaacatggagtatagaactggatgttataaatgaatatgaaggatcatattccatttggctccctatatcagaaggacttaacccggaaactaaatttttggattccaatcaatttaacactttaggtataccagctactgttaataatataattgcagttgggagttataatggaagaacaaatacactatcttcgtatagtggaagaggagaacaagtatcatgtactcaacttattagaccagacattgtagcacctggagagaatgttataggtccattacctggtggtgggtatgatactaagacaggaacttctatggcaactccaatagttgctggaatttgtgcactttttaatgaatggggcatcataaaaggaaatgatccgtatttatttggccagagattaaaatattatctggtaaaaggagcacagaggagtaggtcggatataagttatcctaatccatcatggggatatggaacaatttgtgcaaatgagagtttttttattcttgaaaatgatttaaatatactaatgtctagaaatttaaatagggataatgaacttggtatagaaagtagtagtaataattacatggaaacaaatgatgttgctaaaaatatttcagcggcaataaatgtattaaataacgctgtgaaagatgaaaatattgatccagatgagattattggattaattgtacaatattatacagaagaagacttggttgaaataaataagttgcctaatacatcagcaatatctatatcagagtcatatgcagttgttagaattcctgttaaagaagcttctaagcttattccttatgttaaagagattccaaacatatataatgtaaatctttatacattatcatcattatctccagttgaagcaagtggtgtatcattatttagcaataatccatatttattattagatggtacagatgtaatagtaggaatactagatagtggtattgattatttaaataaagaatttatgagagaagatgataccactagaatattaagaatatgggatcaaactatagaaggagataaacctgttgaaaatttaaaattaggaacagaatatacggagagtcaaattaatgaagcaataaaaatatccaaggaaggtggagatccatacagcatagtaccttcaaaagatgaaataggacatgggacaatgagtgcaggagttattggtggaagaggaattaatccagatttacttggagctgcacccaactgtaattttgttgttgtgaaaattaagccagtaggagattttgtattgaaatatggaggggtttcaacagataagatagcatatgggaatattgagttaatactagcaataaggtacctaagaataatatcagctaagttaaaaaaaccaatggtgatttattttccttttggaactaatactggtgctcatgatggaactggtgatatggaaggtgttttagaagcgcaaggtagaaaaaatggtatagttgcagttgttggaactggaaatcaaggtgatactcaaactcatatcgaaggaaaatttgagcaagatgaaaaaatgaaaacaataagaataaaaataggaaaaaatcaaaaagatttaaattttcaaatttattgtcagaagccagataaagtagaagttggaatagtatcaccatcaggagaaatcttagataaactcgatgtgaaatttagacaaatagaagactataagtttatatatgaaggcactactgtaacaatagtatatttatatcctgatgaatataatgcagatgaaacaattataattaaatttaaagacataagagagggaatatggcaaataagattgtatggcgagaaaatagttgatggaagatattgggcttggcttcctcaacgggaacttttagatagtgatacgcgtttttttgatccaacgcaaagaactactttaactgtacctgcaacaggaagaggagttttagctacagcttattataatcaggagttaaattcaactgtatctaaatctggaagaggatatacgagagatggtaggataaaacctgatatagcagcaggtggagtaaatgcaattgttccaaaacctggaggaggaacaacagtagcaacagggtcatctgtagctacatctgtacttgcaggatgctgtgcattaattcttcaatgggcaattattaatggcaatgatccagaggtcagagcaagaaaactcataagttatgttgttagaggagctaagatgagacaaggtgatatatatcctaatattgactggggatatggaatgctagatatgaaaaatattttcgacagttttagaagtcaaaaacaattaaaagaaataagagacagcatagataaagatggaaattctaaatatattgaattttcaataattagaaaaagggtaattaataaattatacgatgaatttacaaaaaacaatttatttttcaggattcctagatagtattgctgtaaccaattaaagattatattcatataatatttgaggaaaaatttttaggagaattgtatggctgatattggtaaattaaaggttcaatgttttataggaaatgattacgttcctgttgatagatgtaaaattaaaattaagggcaaaggagattttgctacaacaaatgaaataaatttagatacagattcagcaggattaacgcaagaaatagaagtagatgcaccaccaatagaatattcattagatgaaaacagtaataaaacaccatatagtttatatgatattatagttgaaagagaaggctttgatccaattgcaatcaggggatgtcaagtatttccggaagaagttgcatatcaggtatgtaatttaaaggaacaatccaaaactagaagtatgaggcaagaaattataaatatattacctaatacattaaatggggattatccacccaaaataccggaagaagttgataagccactaccaccaccaacatctggtgtagtgttagcaaaacctgtagttcctgaatttattatagtacatcaaggaagcccaaatgattcttcggctcctaattataaggttccatttaaggactatattaaaaatgttgcatcatgtgaaatatattcaacatggcctgaaacaacaataagagctaatatattttgcatagtatcatttacacttaataggatttatacagagtggtatagatcaaaaggtaagaattttcaaatcacaagttcaacagcttatgatcatgcatttaattatggaagaaacatttatgatagtataagtgtaattgtagatgagatattttctacttatgtacgaagagttggtaaaaagcaaccacttttaacacaatattgtgatggaaaaagtgttaaatgtccagaatggttaagtcaatggggaagcaagtatttaggtgatcaaggtaaacttccatatgaaatattacagcattattatggatatgatatagagcttgttacagctgataagattgaaggaatcccagaatcatatccaggatatgatttaactgtaggatcatcaggagagcctgtgagaactatacaggaacaattaaatagaatagctcagaactatccgttaatacctaagcttccacaagatggtcaatatacagataaggttgctgagtcggtaaaggtatttcaaggcgtatttagtcttccacagactggtgttgttgattatgctacatggtataagatatcagatgtgtatgttggcgtaagtaagattgcagaacttagaagtagttgtgataaaactttatttgttccaccagtaatgcctaatataggtgacgaaagagaaatacctaaattttattattaataaatagatatgtattttatgtgattatgataattagaatgaaggttagcatgaacgctataagaaggagtttaataattattaaactccttctaaattaaaattaggtgtatatacatccgtattagcaccttcttcttgaataaagccattcttaactccaagttcagcagcgtaattaactaaactatcataatgtttaggattaagcttcttatttatttcaggatatttacaggcatcgaacattggtacatactgattcattatacttataaaaatattatcgccatatctgttatatagaagatcaataatttttttagagtcaaataataaaccaggaagcattaaatgccttacaatcacaccttttataatacgcccagtatcatcaaaggtaggaattcctgtttgttttatcatttcatcaattactttaactgcattttcagcataatttttagcactagaatatttaatagcatatttatcgttaaagtatttaaaatcaggaaggtacacatctatatatccctttagagattgtattgtttctaatgaatcatagctgttggtattataaagtattggtagtgaaagaccattactttttgcaatatcaatagctttaattatttgtggaacataatgtgttggcgtaactaaatttatgttattagcaccttgtgattgaagctctaaaaatatttcggataacatttcaatagaaactatttttcctattactgatgaatcgcaattatttttgcttttgccattgttctgacttatattataattttggcagaacacacatttaaaattacaatgagaaaagaaaacagtccctgaaccttttcccattgaaattggaggctcttcccaaggatgaaggaaagctttcgcaatcataaccttatcagaagccttacaaaaaccagtcatgtgattatttctattaactttgcaatttctaatacaaagtgtacattcatttaacatatctaaagagttcatattatatctcaatccttaaataacttattaaaaaacctaaacattactttttctatttattgtaatgtttatatagattttcaataaaagtatatcataataatttaaaattcgtttacttagataggatttttttatttttccaataataaaatatacattgagaaataaataataagcttaacaatccaaatagagggtaaagctttgttattaagtttccgaatccaaattgagatattacaagagcaattgtaattactataaaaattgattttttaaatttaatattgaaactttgctcgagtgttttacatatagaatagatatcagagacttcagttgaaaacatttctagccatattatcattagtaaaactgcttgaattatatttccaaaacgatttgcaacaaaaagtaaaggaatttcatatttatatatataaggttgattcacagttaataaaagatttatcattgaacataaaagagtaagaccaactgcaccaattagtatgccaaggaacattatttttggcttttttatttgattactaagaggtacaatgactcctgatgctgataatgtgttataaccagcataaagcagagtagaaagaaatataccgcttcttttaggctcaaaacttaaaatgttattcattgaaaccgtatctttagaaaaacagaaataaagtattgttatcagtgttattgtagttacaagtcctggaacaataaaagaatttacttcaattaatccatcggtacctttaagtagaaagaataatgatatacaaatcattattaaggagccaataattcttggtataccaaagaattgttctataagagctccacttccagcaagaattatggatgcacttgaaattagaaataaagtagtgataaatcctgtaagtttacctactaagttaggacttattaaattaataacatcactatatgaatctaatttatggtgaatgcttattttagaaataattgaacccattattatataaaaaataccgcatcccataattccaataaaactttttattccatactgagtaaaaaattgagttatttcctttcctgaagcaagtccagcacctacaatcgttcctataaatactgtggcaacttgaaaaattagttttaaattttctttcaattaaattctcccccaaaattattcctgttaataatatatatagtttacttttgaattattctataaataatttagaatagtagtaaaaacatattatatagtaaaataaaattacaatagtatcataaaagtaaattagtaagatttaatcatgtatatatgcaatatcttgcaatatataaatttaatatggatgtgatacaatataataaactattaaaatagtttattatttactctcaaggaattgagataggaggcaatatgaataatttatggaatggaaaaagatataatagtcttaactattttttaagaaataaatttggtgaaaaagtttttaagatatcattggatggaggattttcatgtcctaatagagatggaaaagctggacgtggaggatgtacgttttgcagtgcaagaggatctggagattttgctggagacaggattatgtccatctcaaatcaatttgatgatgtgaaagaaatgatggcacataagtggaaaagtggaaaatatatagcgtattttcaagcttatacaaatacatatgcaccagttgaagaattaaaaagaaaatatgaagaagctataaacaaagatggagttgtaggtcttgcaatagctactagaccagattgtttaggagaagatgttctagacttattagaggaaataaataaaaaaatatatgtatgggtagagcttggtttacagacatctaatgatgatacagctagaaaaataaacagaggatatactctggaggtttttgatgaagctatgaaaaatttaaaatcaagaaatatagatactgtagttcatgctatttttggtcttccaggagagacgaaagaagatatgtttaacacagtagaacatatagcacatagtggtgcaatgggaataaagatacatcttcttcatttaatgaaaaatacaaaattggtagagaattatgaaaaaggtgagttaaagtttttatcgcaagaagattatatagatataattactagaagtgtctctatgctaccaaaagaaatggtagttcatagattaacaggagatgcaccgcgaaatgaactcatagggcctatgtggagtttgaaaaaatgggaagttttaaacgctatagataaggcttttgaagataatgatttatggcaaggaaaaaactatagagaaatataagtttagattatgaaagtatatttaatagaataggagcttatggtaatgaaaatagatataataatatcagcagatgatataattgagagcaaattagaaaataaaatagccgtagtaatagatatgtttagagctacttcagtaatagtaactgcattaaacaatggatgtgaagaagttattccatttttaactatagaagaaacattagaaagttcagaagaattaaaaagagaagaatatatattaggcggagaaagaagagctgtaaaaattgatggatttgatttatctaattcaccattggaatacacaaaagaagttgttgaagataagaaggtgttaattacaacaactaatggaacaagaacattaacaaaatctaatagtgcaaaaagaattattattgcagcaatgattaatgcaaaagcagtagcagataaattattagaaataaatgaagatgttgtgataataaatgcaggaacaaatggaaatttttctatggatgattatatttgttcaggatacataataaatgagatgctaaaagtagataataatatagaacttacagatatatctaaaacagctaatatgatttatgaaaacaatagcgatattataagttatgttaaagaagcgactcactattcagttatgaaatcattagaactagataatgatatagaatactgtatgaagaagagtatagttaataatgttcctgaatataaggatggtaaaatagtaaatatgtaagatttaaaataggaactattatttttttgttcctattttaaatttattgaactatatatttttgaaaatatagtatacaataatgaatttttattataatccattggaggaatatttggaaataacgtaaccattcgatataagtaaactgagaatattattaagaagataaaaattaaaaataaggtttcttttttgtgattgttgaataagggtttttttcctactattataaaaagtaaaacaggggaataaaccaaaagaggggattataattccatgcatcgataaatctaaaatgtaataaagaccagtaagctctagtcataccacatgctggacatggaaaaccagtaattaattttattaaacaagtaaatttagtaagtattaaaaagataagtaaaatgaagatgacatcatatttttttataaaatcttttaaatttttcattttgaattttcacctatgaagtaagttgtttaaacttaataaataaatttgatttatttattgtttaaacaacttattattttatttaatagtgtagctgattaataattttcagcaagtaagttaaaattcttaattataagatataatcctatgaattgtcctattccgcataaaaatgaaccaaataacatccataataatattgaagagccactttcaggtattaagataccacgtgaattaccggctctttgaattttatctcctaaattataataccaaaaaaatgtataaataccgcaagtaataattgaaagtattattactataaagaaatttggaagtggtttattatcgtctttgcacattaaattaagatcttcagtaaattgataccagaagaataagctataaattccaaatgttataatgcttaataataaaaacatccaaaaatttcgttgtttaatcatttgattgcttcctccttatataaaaataaaataacaccaaacagtttactataattaaacatagcagtaaacaattatgttggaattttatttaataattggaaaataaaaaagtagatactattttaaaccacttactatatagctgataggttcaaaataatatctacatttaaagattaaagttcattttcttctttatgcttttttataagttcattaattatataagaacaatttgcacctttacaagagcctttaccagcaccagtaatttcttttacttcttcaaaagttgaagcaccattttttatagcttctttaatttttgctctgctaatagctctacagcggcaagtttttgttaatttatctaaaacaacttcgtttaaattattatccatatttctctcctaaaaatgtattttagataattaaagcattatataaaaatatggtcaatggtattttaatgaatattatttaagggtatccaaagtttggtgtaataaaaagaataatataagaaataactccattatataactggatttgaaaaactgacttgagtataatactattgaaatagaggtgaagttaatggttaaaatattagtagtagaagataatatagaaataagtaagaatatagaagagtattttcaaaaagaatttgaaataactgcagtttacaatggcgcggatgctcttgataatttacaaatatataattatgatgttgtcattttagatctaatgcttccagaggtaggtggtatgactgtattaaaatatatatcagataaatgcctaaatacaggggtaataatattaactgccaaagaagaacttggagataaattgaaagcatttaatttaggtgcaaatgattatttaacaaaaccattttttatggaagaattaaaagcacgtataaatgcaatattaaaaagtatgggtaaggtaaaaacagctaacatactagaatttaaagatttgaaaatagacatgaagactaaaaagatatttattgaagataatgaaattgaattaaatgaaaagttatataagcttttagaatatttagtattaaataaaggggtgctactctttaaagaacagatatttgataatatttgtggatataatagcgatgcggcaacagaaataatagaagtttatataagccgacttagaaagcagctaaactcttttggttatggtaagtatcttgtaactaaaagggggatgggttacatattagatgaaagtgcagatgattaaaaatatgaagaaggatctgttttctagaacaaggagaaatattacagctattagtattacaattgttttcttatgtttgatagtattttcagcaataacacagattttttattactccagggtattaagaaatgttgatattcagttaatggaacagaaaaagctattaagtggagatgtatttaatggtggaaatggatatagtacacaaaagaatacacatattcctgaaaattttaaggggaaaccagaagataaggcaatgagagttcctcctaacttaattgttatattatataaagataatgaatttcaagctatgagtaataatttatatttttcagaagataatcttcctaaattccctaaaaattcagaggataagatagtttcattagaaattaatggatataaatttagagggataagtgttaagcaagaaaataaagagtttcaaattttttctaacattgatgcagagataggatctatgtatagattggcaacatctattttatttggattaataattttagtagtagttgctttagctatgtctgcatatctagcatcaagggttataaagccagtaagagaagcttatgataagcaagtatattttgttcaagatgcatcacatgaaatgagaactccccttgctgtaataaaaggaaagcttgaacttttagcaaatgcttcaggagatagaatagatgatcattttgagcatatatcaaagataatgagtgaaataagaggtcttgaaaagctgaatagtgatttactcttattatcaaaagaagatttaagtttaggagataatattggagaatttgctttaaatgattttattgatgaaataagtgaattctatactgacttagcagaaataaaggaaaaaaaatttagcattataaggccagaagaaagtacaaaagtacagtgggattatactaaaattaaaagagtattaactatattacttgaaaatgcatttaaatatactgatgaaaatggagaaattatattaaaaattgagataataaaaaaatacattagaataagtgtcaaggataatggaataggaattaaggaagaagataaatctagaatatttgatagattttatagaagcgaatttgtaagaggacagaatattggaggtactggaattggattaagtctattaaaatcaatttcaaagagctttgatataaagataaaagttaattcagaatatggagttggatctgaatttatattagatattccaaaggttacaaaataatatttatatttaaaagaaggcgttggtataacagtgtaagcactgatatgccaacgcctgttaaatttaagttaaatgatttttttaatgttaagctaacgttaaggttgcttgattatactatgtatagtgaggaacggaggtgtagatatggcagaagatacaaagtttagacatgagttaaaacattatataaattactcagattatctagctataaaaagtagaataagaacaataatgcatatagacagaaacgcaaactcaaacaatgaatataggataagaagtttatattttgataatgtttatgataaagcattaatggaaaaggttattggaattcctaaaagagataaatttcgtattagattttataatgacaatcatgattttataagattagaaaaaaaatcaaaaatacgtggtttatgtcttaaagatagtgagcgcattactaaagaagaatgtttaaaaattattaatggtgatattgagtttttaaaagagtctggaaaaaaactttttatagatttatatgctcaaatgaagggaaatctactaaaaccaaagacaattgtagattatacaagagaggcatacatatatcctataggaaatgtgcgcataacttttgataaatcaataagaacaggattaaattgtataaatatgtttgatgataatctgccaacaatagaaactgttgatcataaatttattgtattagaggttaaatttgatgagtttatgccacaggtaatacatgatattgttcaagtaaatgaacgaagagctacttcagtatcaaaatatgaagcggcaagaatttatggataagaaacaatattaatggtagtagattaggttaattgataataaattaaagattaattataaaaaaataaaattgagtcaatgaaaatcaggaggaacaaaaaatgaattctacaacagtaaattttagtgacattttcaagtcgagtttcgtagagaaaatggcttcagtacaaattttagatgtatttatagcgttagctttagcgtttgtaataggtttgtttataatgcaggtttacaaaaagacatttaagggagtaatgtattcagaaagttttgcaatatcacttatagcactttgtttaattacaacattaattatattagcggtaacatctaatgtagtattatcacttggtatggttggtgctctttctatagtacgttttagaagtgcgattaaagagcccattgatatagcgtatttattttgggcaattagtgtaggtatagtaattggtgctggacttattcctttagcagttattggttctgtatttataggattagtgatggtgttatttgtaaatagaaaaacaacaaataatccatatattttagttataaattgtgaaaatgattattcagaaaatgatgcattaaaattattatcaaaaaatgtacaaaagtataatgttaagtcaaaaactgtatcaccagtaaatggaatagaaatgacagttgaaattggattaaagaaaaatactacaggatttgtaaatgaaatatcgaaggtagatggagtttcaaatgttgtattagtaagttacaatggagattatatgtcttaagtgataagtgataagtgataagtgagaacccaaattttacatttggttgttcgaacttagttaactagcgttagctggttaacttccttataagaatatttggtcagccgaacttacccagggaacgaatgtgagtcgggtttccttgtaaaaaaggagcaaagcgaccctccaaattttatatttggcgaatctaacttactccacaagactataaaaaacccagctagctgtatgccggttgggtttttattatagatttatcaaagaaggtgaaaagcgtgataaaagaaaaataccaatggtatctatccataattactattgttttatccataattttagtatttacaataagtagtttttcaggaaaaattaattctaaaagtgataaaacaaaaacgttagcaacagttttagataaggaaagaataactgatataaatatagatattgatgaatcagactggcagtggcttatggataatgcttctaatgaagaatacaaaagctgtaatgtaactataaacggagagacttattataatgtaggaataagaccaaaaggtaactcaagtctttctagtgttgtatcatctgaagagactgatagatatagctttaaaataaaatttgataaatatgttgatggtcagacatacaatggaatggaaagtatagttcttaataatatgattgaagataacacatatatgaaagagtatatatcctatgatttatatgattttatgggtatagcagttccagaaatgtcctatagcaatattaaagtaaacaatgaaaattggggattttaccttgccattgaagtgatagatgagcgatatcttgaaaataattttggaactacagaaggaaatctttataaacctgaaactatgggaatgggtggaggaaacaacgctaaaggtggtggtggaaatccaccagcaatgggtaatggaaatccgccggatatgaatggtggcaataggaataatggaatgcagaatccaccagatgtgaacaacggagaacagaacatggaaaatcagcctccaatggatggagaatctactggtggaccagataataatatggcaccagaaggaaatgatattaatcaagaaaaaaataataattcaggtgtaaatcaaggaaatgcaaataagagacaaatgggaggaccaaattcgaataaaaatgttgagggagctgattttgtatatatagatgatgaagtaagtagttattcaatagttagagatagtgctgtattcaaaagaaccactgataaagattttgaaaaagttgtaaatatgtacaaaaacttaaatgatggaacaaatttagaagaggtattagatgttgaggaagttcttaaatattttgcagtaaatacatatctagttaatcttgatagttattctggagcaatgtatcataactactatctttatgagaataatggtgtgtgtcagatacttccttgggatttaaatctttcatttggaggattctcaggaatgggagcaaacggaggtaattcaggatcaggaacatcaactataataaattttcctatcgacaatcctgtatcaggaacattagaaaatatgccattgataggtaagttgttagaggttgatgagtatagagaattatatcacagttacctaaaagaaatagctgatgaatatttcaacaatggatattatgctgaacttgtagataatcttgatagtcttattaaagattatgtaaaggaagatccaacagcgttttgcacatatgagcaatatgaagcatcgataccagaaatgattacatttggagaagatagaacaaagagtattttagctcagttaaatggtgaacagtcttcaacaacttatggaaatattgaatcaacaataaatacatcagcattatcatctaagattggcggcggaaaaggtcagggagaaaaaaggtctgaaaaggtatcagagaataatgatatacaaaataacaacttagaaatgaataattatgcagttaatgaggaaaaggataataatgttgataagaaagaaaatactaatcagcataatataaataatcaaaatcaaggacatccaggtatggaacagagtgcttcaaagatgaaagagtatttatttactggaggattattttttattgttgtaatttcagtgttttgtgtaaataaatttaaaagaagaaaaatttagatgaataaaataggatttttgtgagataatattaatgtgataattacacaataaattctacaaaaaatatcgtaatgccttaagtttatagggattacgatattttttattttaaatttgaaaagctaaaataattcccataaaaaaagttgttatatataggaaaatccaagatataaatccatatatagtccatgaaagtattttacgtgaattagctttgtttttagaattcattataaaaaacatgcaaaccccaacaataggaaaaacaagagctataagtttagaaccaaatgagagtttaaaatattcactattaatcattccgcaatgaggacatatattggtatttttagaaatttcattttcacaatatttgcaaatcaaaaaaatcactcctgcttaataaattttattaaaaaagggataaacatacttaaattataacattactttagaggataaaattattaccataatgaaaagaaaaatttacgaaaaatgtaaaatcattaattgacatttaaaaatccttactatataataattacaataaaagactatgattaggaaaagtatcttagaacttatttttagagagtagctgtttggtgcaaagctataataaatcttagagaaaatcacctaggagtttgaggctgaaaggcatatattatttatgtttattaagttatcacgtaagagcctgcgttaaaggatagagtatgtatgtacttgaaattaagcatttagttttagattgaatgttcaccttaggtggtttgcgaattttacttcgtcctgtaggatggagtttttttacgtttaaaatacttttaagggcatataataatgattaaatgttcaatgagagttaattattgttttttagcatgataagcatatatacattacataaaatgaaaggggaaaattcaatgtacaataaagtagatgcctcaaaaggcaatgtaaatatggaaaaagatattgcgaagctttggaaagaaaaagatgttattcaaaaaagttttgattctaataaggacggagaacattttactttctttgatggaccaccaacagctaatggtaagccacacgtgggacatatcttaacaagagttatgaaagacataattccaagatataaagtaatgcaaggatatcaagttttaagaaaggctggatgggatactcatggtcttccagttgagcttgaaatagaaaagaaacttggtatttcaggtaaagaacaaatagaagattacggagtagaaaaatttattacagaatgtaaggatagtgtattctcatatgtaagtctttgggaaaaaatgtctgaacaaattggatattgggttgatatggatgatccatatgtaacatatcacaataactatattgaatctgaatggtgggctttaaagaaattatgggataaaggattattatataaaggtcataaggtaatgccttactgcccaagatgtggaactgctctttcatctcatgaagtagctcaaggatataaagatgttaaagatttaactgctacagctaaatttaaagttgtaggagaagaaaataaatatatattagcatggacaacaactccttggacattaccatctaacttagcattatgtataaacaaagcatatacttactgtgaagttaaggttgaagatgaaacatatatcttagcaaaagacttagtagaaaaagttttaggtgaaagagaatatgaaatcataaaagaattcaagggtgaagaattattaggtgttaaatacgaacaattattaccttttgcaaaagttgaaggtaaggcctttgaagtaattcacggagactatgttacattaacagatggtactggtatagtacatatagcgccagcttatggtgaagatgatagcttagttgctaagaaaaatggaatcacatttgtaaacttagtagatgcaagtggtaactttgttccagaagtaactccatgggcaggtaagttcgttaaaaaatgtgatgaaagtatttgtaattatttagaagagaataataagttatttgataaacacagacacatgcattcatatccacactgttggagatgtgacacaccacttctttactatccaaaggatagttggtttgttagaatgactgaaatgagagacaaattacttgaaaataataataaagtaaattggtatcctgataacataagaacaggaagattcggtaagttccttgaaaatgttattgactggggtatttcaagagatagatattggggaacaccacttccaatatggcaatgtgaatgtggccatagagaatgtattggaagcagagaagaattagaagcaaaagctacaacagactgtaagggaattgagttacacaaaccatatgttgatggaattaaattaacttgtcctgattgtggtaaggaaatgacaagaactaacgaagttattgactgctggtttgattcaggatcaatgccttttgcacaatggcactatccatttgaaaataaggaaaagtttgaaaagaacttcccagctcaatttatatcagaagctgttgaccaaacaagaggatggttctatacattaatggctatatcaacatgtttatttgatacaaatccatttgaaaactgtatagtattaggtcacgttttagataaaaaaggacttaagatgtcaaagtctaagggaaatgttgttgatccatttgaagtattaggcagtcaaggagcagatgctacaagatggcatttctatactgcaagtgcaccatggcttccaacaagattctcaactgaagatgttgcagagactcaaagaaagttcttaggaacattatggaatgtttattcattctatgtgttatatgctgatatagataaatttgatccaactaagtatgcagattttgtgtctgataacgtaatggataaatggataacttctaagttaaacacattaataaagacagttgaagaaaacttagatggatacaagataactcaagcggcattagctattgaggactttacagatgaattatcaaattggtatgtaagaagaaacagatcaagatattggtctcaagacttaactgatgataagattggtgcttatgttacattatatagagtgttaactactatatctaagatagcagctcctttcgtaccatttatgacagaagaaatttatcaaaatttagttgttaatcttgataaaaatgcacctgaaagtgttcatttatgtaaatggccattagcaaatgaagatgctataaattcagagttagaaaaagaaatggacttagcttatacacttgttaagcttggaagaagtgcaagaaatgctgctaatgttaagaatagacagccactttctgaaatgcttatttcaacaaatgttcttccagaatactatggagatatagttaaagaagaattaaacataaagaaagttgagcttggagcagacctttctaaatatgttaactttgaaattaagccaaatttacctgtattaggtaagtcatatggtaaattaattccacaaatcagaaaagcaatttctgaaaagaatcaaatggaattagctcaaaagattcaaaatggtggaagtgaagttataaatgttaatggaactgaaattgaacttacaaatgaaagtctactagtaacaatgcaaggactagaaggatatgcatttgctggtgaaggacatttaggagttgtactagatacaacaattactccagaacttagagaagaaggtcatgttagagaaatgatttctaagattcaaaacatgagaaaagataaaggttttgaagttgctgataagatcagactttatgttgcaggcaatgatatgttaactgatgtaataaagaagtttgaagagactatcaagaaagaaactttaactgtagaagttgtttatggagctgaagctgagtatacagaaacaactattaatggtgaaacattaaatatgactgtagaagttgttaaataattcaagtaacagaattaaaataagctggggatttaagggaaaccttggattctcggtttattttgtataaaataaatatttaatattaaaatataagagaatattatttagggaaaatgacaaaaattagaataaagataactatttatttatagattattgatttatagtagattatattagtataattaagtaaactagaaagtttcaaaggaggaataaggatggctacttctataaaggatgttgcaagagaagcaggggtgtctattgcaacagtttctagagttttaaatgatattgacgtagtaaatgaagatacaaagaagaaagtgcttgatgctataaagaagctaggatatagacctaacatagttgcgagaagtttaaaaactcaaagaacaaaaacaataggtattttagtaccagatatatcaaatcagttatatccagaaattgttagaggagcagaagacgtttctaacatatatgattataatgttattttatgtaattcagatcttgatatagataaagaaaaagaatatttaagagttttaaaagaaaaaatggttgatggtgtaatctacatgagtagttcacttcaagatgaaatattagaacttataaatgaattagatttaaaaacagtattagttgaaactaaggataaaaatggtttgttaccaagtgtaactattgataatgttaagggaagttacgatagtacgaaatttttaatcgacaaaggtataaaagatattgcatttataggtacaaataaagatactatgaatgcatggggagacagatacgtaggttatgaaagtgcaatgaaagaagcaggattaactatagattctgatttagtatatcttagttcaataaaagttaagacaggatatgaaggtattgtaaacataataaagactggaaagaaatttagcgctgttgtatgtgcatcagatgatattgcaatgggagctataaatgctttaagagataatggaatagaagttccaaaagatgtaagcgttataggatttaatgacaattttgcagcatcaatattctatccaaagataacaactatatctcaaccaacatatgatatgggatcagttgcaatgagaatgcttataaaacttcttaatcaacaagctttagataaagctcattttatcttagaacatgagcttatagagagagaaagtacaatatagtaaattatattaacgaagagacatgaagtaagaaattcatgtcttttcttttggttaattattttttagttaaatattatataaatagttgtatatacaactatttagtgttaacatagtcaagtatgtgtatattttgtttttggtaaggagaaaaatatgaatgatagaaatgaagaatatgaatatataggaaaaaatataggaaaagttcatagaatgagtatgatgtatttttctaagaagtttagcaagtttaatattggagctggccagtgttttttgttggttaggctttatgaaaatcagggaataacccaagaagaattatcatcaatgcttagtttagataaaacaacaatagcacgaaatttaaagaagttagatgaccaaggctatattaagaggataaagagggaagatgataaacgttcatatagtattgacgttacagaaaaatcattgaaaataaaagatgaagtatatagaatattacattcatgggaagaaaagcttaatagttgccttacaaatgatgaatcaaaacagcttataatattattaaataaactaaataatattaatttacttaaggaggaagagatataatgaatgagcaaaaacgtttaggagagcttaagattagtaagcttttattggagttttctataccagcaattattggtatggtagttaatactttatataatataattgatagaatgtttataggacatatacctgaagttggaaatttagcaattgcaggtgttggtataactatgccacttatgacaatcataatggcattcggaatgcttataggtataggaactgctacaagaatatctataagtcttgggcaacatcataaagaaaaagcggaaaagtttttaggaaatgctttttcacttataattataatcagtatattgctaacagtagttggccttgtatttatggatccgttattaagagcatttggagcaagtgataatattattgtatatgcagaacagtatatagaaataatatttgcaggttgtatttttaacatagtaggatttggattaaatcactcaataagaagtgatggaagtcctaaggtggcaatgctttcaatgttaattggagcaattacaaatattattttagacccaatatttatatttggtttaaacttaggtgtaagaggtggagctattgccactgtaatttctcaatttgtaagtgctatctgggttgtttattattttacaaagggaaaaagtgtacttaagataagaagaaaatatttaaaattaaacaaagaagctgtaatgggtatattctctataggagtaagtccatttagtatgcagatagctaattgcgcagtacaggtagtggctaataattcacttcaaacatatggtggagatttagcagttgcagcaatgacaataattaatagtttatcaatgatattcttgatgcctatttttggaataaatcaaggaatgcaacctattgttggatacaattatggagctaagaaacatgatagagttaaagaaacaataaaatattgtgttatttcagcaacaattattgttgtaataggattcttaattgttgaattattcccagaaaaacttattttgatttttaatagtgatccagaattaattaacattggagttaatggaatgagaatattcttatgtatgcttccattaataggtggtcagataatagttacaaattattttcaatcaataggaaaagtaaagatatctatgtttttaagtttgctaagacaggttatattgttaataccatgtttaatagttatgccaatgtttaaaggtcttaatggtgtatggttagctggtgctacttcagattttatagcttgcataattactgttatagtatttttaaaggcaactaaaactttactaccagataaagatgcactagataatgaagcagctttagaaaattaaaatataattacaaaaacacagacaaatttttgtctgtgtttttttaataacttatgtaattaaattattccttcactttttaagatgtcttctaatctttgaactttagttgttaattgaacaaatttttcctttaattctttttttgaagaatcattgtcgatagtaatacaagcttccatttcttcaacagcttttaaagcctcatctacatcgttttgagctaattttaaattggaatctttcataagttaatctccttagttaatttattatgtttaataattatatggtatcactactaaattataagttcaaggaatataaattaaagaacaataatatttaaggaggatacagtacagttatgttgataattgaaagttgataattgttaaacatagggtttcacatttagtattggctgatttatgtcaattgataactggaataagtgtaatgataaattatatttggtttattttaatttttttaggcagtatagtaggaatactaaatggtagtggtgaagctatatcgaaatctataattgattcgtgtggaaatactgtatcatttattattgaactaactggaataatgtgtttttggtgcggagtaatgaaaattgcagaaaagagtggttttacagataagcttgcaaaaatattgaaaccaatattaaagcttatatttaaagatgctgcaaaagatgaaaaagctttaggggcaattgttatgaatattacagctaatatgatgggattatcaaatgcggctactccttttggaataagagcaatggaagaaatggacagattaaataaaaacaaaggtactgcttctaatgacatgtcgctgtttttagtattaaatgcagcatgtattcaattagttccatcaacaataatatccatacgagcagcatgtaactcagttaatccaggaattataatattacctgcaattatatctacaactacagcagctgttgttggtgtgatatgttgtaagattcttcagagatatttctaaggagggtaagtaaatgattaattatttaactaaaagtataatacctataatttttttacttattttaacctatggaatgtttaagggaagacaggtatatgaatggtttatagaaggagctaaagaaggacttaatgtatgtattagaatattcccatgtatactagctatgataatagctgttgaaattttcaagaaagcggatttgatgaatttagtaacaggatttttatctccaattacaaatttaattggtctacccaaagaattgattcctcttgttataataaaaccattgtctggaagtggggcgataggtgtatttacagatataataaagagctttggaccagatactaggacaggacttattgcatcagtaataatgggaacaactgaaacaatcttttatacgataacggtttactttggtgctgtaaaagtaaagaagataagacatacattgtgggcagcagtttttgcagacattacggctataatagtatcaatattagtggtaaatgtatttcttttatagatatttaaattatctgcttatgtatgtaggcagatttatttttaataaaaagccaatagtagtataataatataaattatacaaatttatattattaaggagagagttagatggaaaaaatggtttatagtgaacacagattagctttaatgaataagatagataataattcaatagtaatattatttgcaggaaatgcacctaaaaaaacaggagatgaagtatatcaatttacaccagatagaaatttctactatctaacaggaataagtgaagaaaatcatattgttgtattatcaaaatttaataatgaaataagcgaaaaattatttctaaaagaaatagatttagcgaaagaaatgtggaatggtaagactttaagggattttgaagcaaaagaaatttctggtattgaagatactgtttatatgaatgaattttatggatatctaaacagattaatcaaaggtgcagaagaaataaatttatatcttgacttagatagacaaaattattgtgaagaagattctaatggtaataagtttgcagaagtatttaaaggtaaatatcctcaagttataattaaaaatgtgtcaagcaatattacaccattaagaatgattaaatctaaatcagaaatagcagaaatgcaaagggcaatagagattacaatagatggtgttgaatctttaatgaaaaatgcaaaagcaggaatgaaagaatatgagttagaagcgtattttgattttatatgtaagataaatggagctaaggattttgcatttagaaccatagcagcagcaggaaaaaatgcaacaacacttcattatgtagaaaacaatagtgagataaaaaatgatgatttaatattatttgatttaggggctcagtggaatttctataatgctgatataacaagaacatttcctgtagggggaaaattcactgacagacagaaacaagtttatgaagcagttcttagagtaaataaagcagttattgaaaaaataaagccaggtgttgtatataaagaacttaatgcatgggctactgatttaattgcagaagaatgtattaaacttggaataatcaaagaaaagaaagatgtaagtaaatattattggcatagtattggacataatcttggacttgatactcatgatgtagaaccacaaggaagaaattttgtatttgaagaaggtatggtatttactgttgagccaggtatatatatatcagaagaaagcataggaataagaatagaagatgatgttcttgttactgcagatggatgtgaagttttaactaaaggaatgatgaaagaagtatctgagattgaagcttttatgaaaagataattgatgaactttgatttaaagatataaaaatcgacaaaaactaattgcaaaaaaagtaaaactacagtatgatattaatataaaattaaaaaagtgaataaacgaaagaggtagaggcgcagtatttaatagtattactacggaggaaagcactgtgaagtagtaagaaaggaaatattgccgaagcttataactaatgctttaaagttataaggctggggttatgcagaatatgcataacactgtcacaaagatgtgattttgtggtgagctatcattcatggatttaaattagttttttgtttaggctatttttatgaccttgggtgtatctcaaggtcttttatttttgtctaataattaaattgatcacatgattgaatttactatggaagactatatcagattgttattgaaaaataatgcttttaaataactttttattttaaattttcaacagtaatctaaagtatagtcatactctatatcttgaaattttcacaaaaattaatagggggaattaataaatgaaaaatttcagaaagtattatgtatttttattaacacttttagtgtttatgatgccatctattgcagcttttgcatcagatgatgttgcgggggataatgctgctaagtttggtctattaacaatattaccacctttagttgcaatagcattagcatttataacgaagaatgttgttatttcactatttttaggtacagtatcaggatgtttcttattgcaaatttcaggaaataatataatttacgcaattattcactctttcttagattttgttcaaagagcattaaattcattagcagatccatggaatgcaggtatagttcttcaggtaatggttatcggaggagttataagtttagtaagcaaaatgggtggggcaaaagcaatagcggaagcacttgcaaaaagagctaaaacgccaagaagtgcacaattaattacatggttattaggtattttagtattttttgatgactatgcaaattcattaattgttggaccaataatgaagccagttgcagataaaatgaaaatatctagagaaaaattatcatttattattgatgctacagcagcaccaatagcaggaattatgataatatcaacatggattggtttagaagttggattaataaaggatggtttcgaatcaataggacaaagtactgatgcatttggagtatttttaaatactataccatacagattttataacatattaatattgatttttgttgtagcaacatcatatttcttaagggatttcggtccaatgagaaaagcagaaataagagcaagaagaggagaaatatctgaaacaaacaaggaaattgctttagataaagctgctgaagatgaaatggcgcctaaagaaggtgtgaaattaagtatatggaatgcaattataccaattggagcacttatgatatcagcgttaataagcttttattatagtggatatacttcaataatgggtggtgaggatgccgcattacaagctataatgacaaattcaccaatgtcatttacagcaataagagaagcgtttagtgcatcagatgcatcagtagcattattccagtcagccttatttgcatctatagttgctatagcaatgggcgttggcaaaaaaatatttacattctcagaggctgtagatgtatgggttgatggaatgaaaggattaataataacaggagttatattaatacttgcatggtcattaagttccgtaataaaagaacttggtacagcagcatttttagttcaaatgctttcaaattcagtacctaaattcttactaccaagtataatattcattttaggtgcagttatttcatttgcaacaggaactgcttacggaactatgggaatattaatgcctcttgcgattccgctttcttattcaatatcacctgactttggatatgtagtaataagtacaagtgcagttttaacaggtgcgatatttggagatcattgttcaccaatatctgatacaacaattatgtcatctatgggtgctggttgccatcatattgaccacgtaaaaacacaaatgccatatgcattaacagttgcggcaatcacagtaatttgtggatatattcctgctggtttaggaatatcagtatggattgtacttcctattgcagcaatagtaacatgtggagtagtttattttgttggtaagcctgtagataatgttgaagaatagaagtatataataaattataatataaaggctagtaaataattttatagttattttactagccatttgtatttgaaaatattatattttattatgctccaacttcaacagtttttctaggattaagatatttgtttactaaaatagctataattatacctattatagtatctatgcttctacttatggcgtatgtataagaatggaactgtgatgaattatttatcattattccacttataacaatacaggatactataactgattcacctttttttaagagagtacatatatatattgatatagaaattcccatgccagttactataggactgatgctatataaaaaaggaatttttgtacttaaataaattaatattataccaatgaatccaccgattattgttcctacgattctatttatacccatatatatgctattagaaacagtatctttcatacagaaaactgcagctatacatgcaaaaaaaggattttctctctttatcatattaaaaactatcatgcataaagaaacagcaacagcagtttttatatttcttaatcccaatttaggtaattgaaaagagttaattattctcacctcctaataatttcattagaattataacacaagaataatgattatttaaaaagataaaatatccaataaaactttaattttcaatataataaaataaatgttttttatgggtaagatattctttcctcaaagttatatatttaatcaatttgattgaagaaattttatgaaaataatgtaaagaaacttaaaatacaggaaaataatattaatttattaaatagtcattgattataataaaaaattcgctacaataagtattagcaaatataataatttaaatgcattgaaaagaagagtagtaaaataaacattctataagagagctgataattgctgaaagtcagtgtttgtgagttttatgaagatggtcttagagtatattttctgagcttattaagatattagttaggagaatacggaagcagccgttatactgcagggtgatgatagtcacctagtgagttatttattgcgaagtaaataagaaatagagtggtaacacgtataatacgtctctatataggttttaatatacctatatagagatttttttataaaaattttcaatataatagcaaccttttaatcgttataagttaagaaaaaatatataagttacaataaatttatattttttaaattacgaagtaatttcctcttaactgcaaactgttaactgttgactattaactgatttaactggaggaattaagaatgtgtcaagattgtaaaaaaccattttatattacaacaccaatctactatccatcaacaaagttacatataggtaatacttatactacagtagctgctgatgctatagctagatttaagagattaacaggatatgatgtaatgttcttaacaggaacagatgaacatggtcaaaagattcaaagaatagcagaagaaaagggaattactcctattgaacatgtagatgaaattgttgcaggaatcaaggatctttggaaaatgatgaatatcagctatgataaatttattagaactacagatgattatcatgtaaaagctgttcaagatatatttaaaaaattatatgatcaaggtgacatttacaagagttcttatgaaggttggtactgtactccatgtgaatctttctggactgatactcaattagtaaatggaaattgcccagactgtggaagaccagtagaaaaatcaaaagaagaagcttatttctttaaaatgagcaaatatgctgatagattaatcaagtatattgaagaacatcctcattttattcaaccagaatcaagaaaaaatgaaatgttaaataatttcttaagaccaggtcttcaagatttatgtgtatcaagaactagttttgactggggtgttccagtaacatttgatgaaaaacatgttgtttatgtgtggattgatgctttatcaaactatataactgcacttggatatggtcaagataataaggagttatatgataaattctggccagcagatgtacatttaataggtaaggatatcttaagattccatactatttattggccaataatgttaatggctttagatttaccacttccaaaacaggtatttggtcatggatggttacttgttgatggtggtaagatgtctaaatcaaaaggtaatgttgtagatcctgttgttttagtaaatgaatttggagtagatcctgtaagatactacttattaagagaaattccatttggagcagatggactatttaacaatgaaatatttataaagaaaataaattcagatctttgtaatgatttaggtaacttattatctagaacagttgcaatgatagaaaagtattttgatggagaaatcccagcacaagctgaaaaaggtgaatttgatgatgaattaataaacttagcgttaagtactccagctaaagttgaagaagctgttactgaactaaaccttccattagctttagaacatgtatttgaattaataggaagagcgaataagtatattgatgaaacaactccatggatattagctaaggatgaggataaaaaagcaagacttggaacagttctttataatttaattgaaagtttaagatttgcgtcagttatgatttcagcattcttaccagatacagctaagaaaataaatgaacaaataaatactgaagttctttcatgggattcattaaaagaattcaatggaactaaagcaggaactaaagttattaaagctgataacttattcccaagaatagatgtagataagaaattagctgagttagaagaattaagagctaaaatgaatccagcaccagctaagagagaaataaaacctataaaagaagaaattacaatagatgattttgaaaaaatagacttaagagtagttaaagtattagcttgtgaaccaataaaaggagctaagaaattacttaaattaaaagtagatttaggtggagaagaaagacaagtggtttcaggaatagcagcacactacaaaccagaagaattagtaggtaaaaatgtagttttagttgcaaacttaaagccagttaaattaagaggagaattatcacaaggtatgattttatgtgctgcaactgatgatgacagcgtattaaaagcagttgatccaggtgatttattaagcggaagcattgttagatagttagcagttaataagtaacagtgtttaatccaattagcagttaacaagtaacagttaacagttaaggttgaaatcttctgctaagatttctatataatatatatttataaaaagcagctatgttgcaattaagaatttaaataaaaatatagatattccataggaagattaatcaaagctgttaactgtaaactaaaaaagtgggggtgattttttgaacgtaataataggaaatgcttggccgtatgcaaatggagaactacacttaggaagaatagctgtattacttccaggagatgtgttagctagataccatagacttatgggggatgatgttgtttttgtatcaggtagtgactctcatggtacaccagttacaatgaaagctaaagcagagggaatgagcccagaagaagcaagtttacactatcatgaaaaaattaaagaatgtttccaagggttagggttttcttttgacatttttacaaaaactcatacagaatatcattcgaaaaaagttagtgaatttataaaagaattatatgacaagggatatatttatgaaaaagaagttgagcagacatattgtccaaaatgtaatgaataccttctagatagatatattgagggaaagtgcccatcttgtggaagtcatgcagttggagatcaatgtgatgaatgttctgaaatatttgaaagtgaagaactattagaaaagaagtgtattttttgcaaatcagaacctgttataaaagagactaaacatttattttttgcattatcaaaacttgaaaatgatgttaagagaatctatatacgccaaaatggatggagagaaaacgctcaaaaaattacgaatagatatttaaatgagggcttaagagatagagcagtaacaagagattttaattggggtgtagatgttccttttgaaggatttgaagataagaaaatatatgtatggattgaagcggtaatgggatatcttacagcaagtatgaaatgcctagatgaaagaggcgaagattacatggaatattggaatggagaagatagtagaatatacttcgttcatggaaaagacaatattccattccatacagttatatttccagcaatattatcgggtttaggaattaaaagacctaacatacgagaaatttcaagtgaatatatgaagcttgaaggtaaaaacttttcagcagtaaagaattgggccatatggccggactatcttatggaaaagtacaatgtagatttaataagatattatttaattagtaatggtcctgaagttaaagatacagattttacatggaaatcttttatacatgctaataacaatgaattagttggattgtttgggaatcttataaatagggtattagcatttatagataaaaattttgatggaaatatacctaaaggatcagtagacaaagcatttaaggatgatatgtttaaactttattgtgacgtaggagataatattgaagaggggaattttaaaaaggcattagaatatattttttcagctataaaaaaggctaataaatactttgatgatgaaaaaccttgggtaaatataaaaaaagaccgagaaaaatgtactgagtgtatgtatacatgtatacaaataattgcaaatctaagtaatttgattgaaccatttctaccttttgctgcgaaaaaaataagaggatttttagaaattaagaatccaatgtggatgcctattgaaataaaagagggtaaaataaataattttaatatattatttgatagaatagataaaaatatagtggaagaagaattagggcgactaaaagataagaaaaattaaaaaaaatgaacgtctcatttaggggaatgagacgttctttaaccatatgaaaacaaatggttaaaaggggtaaataataatgctttaactactttacaaattaaatattacacttaaattatgtcaataaagtgtcaaataaaaaaattttaggagaagaaattttatgagtaataaatttaaaattatagatagtcattcacattatgatgatgaatcatttaataaagatagagaagaggttcttaatcagattacatcaaatggtgtaataggaatacttaactgtgcttcatcttatgaaagtttgaaagccacagatgaactaacaaaaaagtatgattatatttatggagcattgggaatacatcctgaaaatgcaaatgaaatgaatgatgatgtattaaaagaaataaaaagctatataaaggaaaattctaaaattatagcaataggagaaataggactcgattattattgggatgagaatccatctaaagaaattcaaaaagaagtttttagaaagcaattgaatttagctaaggagcttgggcttcctgtagttattcacgatagagatgctcatcaagatactttagaggctatgaaggagtttccagaagtaacaggggtagttcattgtttttcaggtagtgtagaatttgcaagagagtgtgtaaaattaggatattatataggatttacaggtgtagttacttttaaaaatgccaaaaaggttgtagaagtagttagagatattccactagatagaattctcgtagaaacagattgtccttacatggcaccagagcctaatagaggaaaaagaaataaatcagactatattgaacatataattaataaaattgctcaaatcaaagaaattgacccttatgaggccaatatgaagtttaatgagaattttttaaggttgatgaaattggaaaaataaggtaaaatagggtttgtacacaaaataattatattgacataaatactttttcaaaataaaacttattgtagataaaatataagccagtgaatatacaaacttgttaaaaagatgaaggtacaattacagtacaaaaatagtaacttaattatattattgtacgtttttacacataagattttatgtgtaaattacaaatataattaagttaatttattacaattttgaaggttaaattagctttttaacctcatatcattaatcaagtgtgaagcatgaaaaaacgttattataaattattataatatttttagtacagttaaaattttattaaaaaagtgcttcattattaatgcaagagattgttaatttgacaataatgtcaaattaatatataattcaaaagacactcttgccaaaggagggaaattaatggtagaaagattaaagcgatttaccaccaaatctttatttaacggtccgaaggcaaaaatcattgtaggagcagttgcagtaacaattacagttggagcaatagctgctataacaataatgaatatgagaaaaacactaacaataagtattgatggaaaagaagaaacttttgtcacttacaaggggactgttcaagatgtgctgcaggataaaaacattgcagtaggtgttaaagacaaagtgcagccgtcactagaatccaaagtatctgaaaaagaaacaatcaaaataaagtcagctataccagtagaaattacagcaaatggtgtacaattagaggtacaaagtgcagacggtactattggagaaatgctaaaaaatgaagaagaagcattacaagaatatggaataaagtttaatgaagacattgatgaagtgtcaccatcgttagattctcaaattgaagataatatgtgtgtacaaattgttaatgttgaaaagaaagaacttgtacaaaatgaacccattaactttgaaacaatagttgaaaaagatgaaagtcttgataaaagcgttagtaaggttaagagtgaaggtgttaatggagaaaaggaagttacttatgaagtcgtatatagagatggagtagaaacttcaagaaatgttacaagtactaaaactattacggaacctaaaaatgaaatagtaatcaaaggaactggacaagtctatgcgagtagaggtggagaaagcataaactacaaagagaaacttaattgtgtagcgacagcttatagtggagacagaactactgcaacaggaagatctcctgtaagaaatccaggtggtatgagtacaatagcagttgatccttcgtttattccattaggaagtaaggtttatgtagaaggatatggatatgctattgcagctgatacaggtggggcaataaaaggaaatataattgatttattccttaactcatctagtgaatgttggagctggggtagaagaccagttactgtattggttgttgcgtatccaggtgaatggtagtttttagagagataacatatgttatctctctttttttattaaaaataaagatgctcaacttataattcttttaagtggactaacatttactataaaattaatataatattggaatattataaaagaaatattataatttatttggagatatatgagttaacaagtataatgtaattaatacatagtacactgtatttaaatattgaattttatatagagtagtacagatgaaaggaagtataaatttgattaaagaagttatcgttgtcgaaggtagggacgatgttgatgctgtaaaaaaagctttagatgctgaaataatagctgttggtggatttggaataaatgcaaaagttatttctagaatacaggaagctcaaaaaagaaaaggtgtaatagtattaacagatccagattttgcaggagaaaagataagaagaataatctcaaaaagagttaaaggaattaagcatgcttatatcactaaagaagatgggcttaaaaatggtgatataggagttgaaaatgcgtgtccagaagtaatattaaaagcacttgaaactgcaaaaataacactgacagaaaaaacagaattttttaatatgcaggatatgttttattttaaacttacaggagatgtaacgtcgaaagaaagaagacaaagtttaggtaagattttagggattggttatggaaatgcggcgcagatggtatctagattgaataattatggaataaccaaagaagaattcacaaatgctataaatgaaatagaaaaacaaatggaggcaggtaacaaatagatggatttaaaggattataaaactcaggaactagttaaaaaatataattttaaattttctaagagtcttggtcaaaactttttgatagatgattcagtacttactgatatcgttgatggtgcatctgttgatgataaagattttataatagaaataggaccaggtgttggaacattgacagctaaacttttaatgaaggctaaaaaagttacgtcaattgagcttgataatgatttaattcctattttacaagaggaattaggggaacatgagaattttgatttaatacataatgatgctttaaaggttgattttaattcgcttataggagatgaaccgagcgttaagcttgtagctaatcttccatactatgtaacaacacctataatagttaagcttttaaaagatggatataattttaaatcattaactataatgatacaaaaagaggttgctgaaagaattaatgctgaacctaattgtaaggaatatggtgcattatcagttttagtacaatattattgtaatacaagtatagttagaagagttgctccaagctgctttatacctagacctaaagtagaatctatagttataagattagatagattagaagcaccaagagtaaatgtaaaagatgagaatcttatgtttgcacttgtaagagctggtttcaatatgagaagaaaaactttatggaatgcaacaaaaacattcaatttgagtaaagaaaagttagaagaagcctttgaaaagtcaggaattgatccaaagagaagagctgaaacattatctattgaagaatttgcacatttatcagactgtatatatgatgcgaaacaatagtataaatgagataaaccgtacattgagagtattttaaactccatgtacggtttattttattaaaaacaagaaatcataatcaagattacctagcatatactatatggaataaatatatgtaggaggaaatttggcttggcacataataaattgtatagaaattttataattctacaagaagatgatagaggatattcatcagctaatgaaaaagccttgtcggggtatgcaaaagtcgaggcaaaaggagacaaatgcaaagtttctttttatgctcaaaaccttaaaaaagaaagtaaatattcgatgatacttatttgtagtaagaaagactgcaaacaacttattgatttaggtccacttgaagtgaatgaagtaggtaagggtgacacaagtaaagagtattatgtgaataatattgctggtcttggaatttcgtatgaaaagatatcaggagctgcaatatgtatggtaagtggaaatgaaatgagctttattatgcatggatttatgaatggtgaggaatccagtgaaaattggagaaaatttaaggttattaaggacagtgaaaattcaagtaaatctactaaaaaaatggatttagatactataagaaaagaatcttctggtccagttattaatacatcacctaaaaaaccaataattgaagctaaaataacagaaactaaggttgttgaacctaaaattatatctcatgaaaatgagaacatgagtttagaaagtcaaaagaacatagtaacagaagaagtaaatactaatgtagaatcaactaaattatctgatataagagaatcagatagtgatgatgaaagatgcaaaaaatgtgatgataaagaaaaggaaaaggataaagataaggataaagataagtgcaaggacaaggaaaaagataaagaaaagaaagataaaaaatattgcgtaggtgatgaaattaagaaaatttacgataaattagaagattgcatgcttgatattaaaattcatatacctgatatgaaagaagatatggttatatgtggatttattaaaaagaaatcagaagataattgcaattggaggagatttaaagctgagaatagatgtaaaagagatgaagagtctataatttcttctttagaaaatagtagaagaatagaagaaaatacaagacttgatagaatcgattttgaggaatatgaaaaatctattgaaaatgtaggaaaggatagcaatttcaagctaagaggagaagaaggaaaatactttgagggaattgttaagggatttgaacaatatagtagtaacattcaagacatagattattgcaaatggtataaagtaaaagtaaatagtatggatgatttatgcaataaatctgattatgataaatatactttagcttattatccgatgttaaattattatccttatataagtaaggaaaattactttttgttaggatataaatgtaatagttttggtgaacttcagtatattgtttatggaattccaggaagtaaggatgtaagtgaacagccttatggaggtaaaactggatttgtaacctgggctaatgatggaacaagaaataatggatattggctaatgttctacgattataaaaagtgttctattgtagttcctactgaatagaataaaaattagtatatgaataaaaaacagattgttgttactggattattaatatcattaatgttgttgttagccataacacaaggtttcttcgtggataacttctcaagagtaaatgttacagaaagtactcaaaaatataatgaatattcatttgaagggtattctataacatttccttctgagtgggttatagatgaagaagaaaacaaagatgagtacattagctataatattaaatttaacagtaaagataatattattacaggattagttcaggtgataaatacaaatcaggacgtaaaagattatgcagacaaagatactaaaaagcaatcactagaatattctaacaatgaaataactccgtttgaaaattctcaaagtattggtgtattatcaaaatacaatactaatattaatgatggatatagttatgtaaatcaatgttactatattaaaggtatgaatggacagatgataaaagtattatttaatataccaaaagacaaatatgaaaaagcttttgacaaggattgtacagacgtaattgcaagtattaagcagaataaataagatttgctaatacgctatataagtattataatttaagtatcaaggagaagcatagctaagcttctccttgatacttattttttgagtagttaaaaaagggaggtaataaatgaggatagtactatttgagctttttggaatacaaataaaaagttatggattaatgattgctataggaataatagtagcagcatctatatttataaataaaggtaaaaaaagaggatatgatgaagattcgttacttaatttaattatttgtgctgtaataggtggagtattcggtggtaaggcactatttatagtaacggagataaaggacataataaaagatcctagtatattacttaactttggctatggatttgtaatttatggtgctattggtggtggtgcattagcaatgtatctatattgcagaagaaaaaagtggaacattattgaaatgttagatatgacagttccaggattagctatagcacaaggatttgggcgtataggatgtttcttagcaggttgttgttatggggctgagactgagttgccaataggagtagttttcccagaaggatctcttgcaccagcaggtattcatttgcatccaacacagatttattcatcgatttttgattttgctttaggatttttccttttatattatggaagaaaacaaaaagcaaatggaaaagttatggggatgtatttactgatttatagtgttggaagattcttagtagaatatttaagaaatgatcctagaggaaatgttggtctgttatccacatcacaatttattgcaatatttactttagtacttggtattattatatttaatcttagcaagttttttaaaggagagaaaaaaagcattgaaagttaataagtcagtaataatgtttatggtattaataatgcttgttacacctttatcaggatgctctgtagttaatgatgtagcagtaaagttgaactttagaaatgaaaagtttgattacataaaacaaaataaggttgataaaattataatacagaatgtaagagatagtggatttagatttatagtaaatgatccacaggctataaatgatatatacaaaatactttctaaaggtaaggaatgtagtgaaaaaagctcacttgatcctgattatatgtttgaagtatggattggtgaagaggtaaaaaaatattcatatgtagtcggagccaattctaataaagaaggaaatttctatgatgatgaaaatgcattttcagtacctaaaaatttagaaaatacaataatgcagaatctttcatttataagaaaaccaagaaattttgaatatatttattatgaatctattttaaaggttgttgaatcaaataaggattcactatcaaatggcaaggttggaatagatatatctggagatgtagattgtttgaaatacgttttttcaaatgatttagaagaatttaagaaaaatctaaataagctaatacctaatgttgatttagttagtaataattcagaacagtttgatacaataataaaagtaaaaaataggggttataacagtacagcatttaaaacattgataacaatagataataaattagataaatcttttaaaagttactatataaccgcagaatataattataaagattgggacatcaatgtcagcggggcaaatgaaatgcctcaagactggtaaagaaaaggaggataaaaatggcaagttgtgataactgtccaagtaaggaccaatgtaaaacaaaaagtaatggtggatgtgaaacacaaatacctaaaatagcgcctagatatgggaatattaaaaatgtaataggtgttataagtggaaaaggtggtgttggtaaatcaacagttactggaatcatggctacaatgttatctaaaaagggatacaaagtaggagttctagatgcagatataacagggccatcaatgccaagattttttggaataaatgaaaaaagatcattaatagaacctttagataatgaattagttagattcaatcctgttgaaacagcaggtggtataaaggtaatgtctatgaatcttgttacaccagttgaagaagaacctcttatatggagaggagctgtaataaatggtgttttaaaacagctttatggagaaactaattggggagaacttgattatttacttatagatatgccaccaggaactggtgatattgcattaacagtaatgcaagaattccctattaatgaaatagtaatagtatctacaccacaagatatggtttcaatgatcgttaaaaaggtagttataatggctcagaagatgggaataaaaattaaaggtgttgttgaaaatatggcctatattaactgtccagattgtgataagaagataagagtatttagcagaaaatcttctgaagaaaatgcagagtacttaggattaccattattaggtgagcttccaataaatatagagcttacagaagcacttgaagaaggaaaagctgaacaatatgttactgaaaatcctttatattcattaatttttgaaggattatattaaaagaagcaactatatagttatgataattaaaccctcgtatatttttgtaatgaaatatacgagggtatttatttattcatagcaaattataatgatagcatagtgcttgaatttagtagattaaagagatttctaaaaaataaaattagaagaaaatatttgactttccaccacactattaactgtcaactaaaagcatggtgtagttacttttttattagttaataaaataaatacataaatataatatttcttgggaaatattaataatgtaatttttaaagagaggatgaatttttatgaaagcaactgtagataaagatacatgcattgcatgtggattatgtccatcaatctgtccagaatgttttgaaattgaagatgatggtaaagcaggatttattgttgatgaagcaccaagtggatctgaagatgaggttaaagaagcagcagaaagctgtccagtaagtgcaatttctgttgattaatcattattaaaataaaaagatacactaaaagtgtatctttttattttaagtagatgtcaatgattagatataatctataaaattaaatctattgaaattatcatttttcgttttatgggatacataattattagacatttgagatgaacttatttcatacttacttataggattattaggtaatatatgtgcaggtgtagtagagaattcatcatttgcattaactattacagcatctctataagttgagtctaatacgaaatttttcataaataatctcctttcaaaattcggtaaattatttattattatttacaaaattaatataaatatacgaaaagagactttaatacaaatttcgattaaagtctctttaatttaaaaatataaatcattatatattattttaaaaacttctagagaatcctctattttagattttaagataacttttttattttctaattcatgtaatcctttttcagtaattttatatattttttgaaaacgcttattaggattatcccattcacctataattaaatcatcttcctccatgcgttttaagagaggatatattccaccagtacttggagtccactttccattagtttttatacttatactgtgagatatttcgttgccatttgtaggcgatagtgataataagtatagtacatatataggtaataatccttttgtgaaaatttgaacagatgattcttttggcttctttgattccttttttaaatcagaaatttttttcttatattcttcgtatagccttttttcttcagacttaatataatcattttttgaagcacctaattcactcatacttaatccaccatttctacaataaagccaacaagacctggtccagtgtttacgccaagagcaggaccaatcattccacctaaagtacattcaactaaattatcagaatccttaatagtgttatatagtaaatctgctttgtctggagcatctccattcataatccatactttacatttaccttttgctaagtaatcatttaatatacttgatagtttagaaatagattgtttagttcctcttacttttgagtatgtgtgaaaaccatcatcttttattgttattattggctttatattaagggcttcagctattgttccagcaactttacctattcttccgcctttttttaaatatgttaatgtatctagtgtaaagaaaacatcaattttctttcttattgtaggaagttcatttgttatttcattaaatgattttccttcttcaattagggcagctgtttctaaaaccattgcaccctcagacattgtaagagtaagagaatcaaatacaaatgtagtaatatcagaaacactttcagaagctaatctggcagcgttaaaagtacctgagaagcaattagatattgttataattattgcatgagtatacccatcagattttagtttctctaacaattcagtgaattcgcttatacttggtagtgatgtagtaggaatttcagttggtaatttttcataaagcattgaaggtgttatatctactccatctttatattctttatctgaaaatatgattttaaaaggtagaacatgtatattatatttttttattaactctgaattaatatcagaagcactatctgtaattaatgcaattttttccactaagaaccctcctataatttaaaaatctttaaattaattatatcactattgataatattatcaatagtgataactatatcaatagtgatatagttttcttatttagaaaataattatttatatagagaattgtaaataaacagtccaatattagtaaataagttaatattaacatatttaaaataagtcaactattgaacatatatataaaataatcaaatagtaagataatcatacctattccaagataattaaaatatagaggtaaaaaaattaaaaattaaaagcattgctaaggaatatttaatacagtataataatacagtattaaatatacaatatattgtgccatggagggaataataatgctatatgttgtgaagagagatgggagagaggtagagtttaactcggataaaattgcacaagcaataaaaggttcagctagtgaaatcggtttaactcttaaggaaagtgaagtcttaactactgttgcaaaggtaacagattatattgaaatagaatataaaaaatctataactgttgaacaaatacaaaattttgtagaaagagcactacaaaatcaaggtcatatagatatagcagtagcttattcaacatataggaaagaaagaactaaagtaagagaaataaaatcagatttaatgaaagcaattcgccaaataggtgtggaaactgatagagataatgctaacgtaggaaacaattttagttccaagttattaagaatagcatctgagtcaaataaatggaatacacttgctgttatgcctaaaaatttagcgaaggctcatgaaacaggagatttatattatcatgatttagatagctataatttaactgtaaattgtcttcatatcccaactaaagaaatgctagttgatgggtttaatactggatatggaacaattaatgcaccaaagagaatagaaacagcagctgaattatcatgtatattattacagtcaactcaaaatgacatgtttggaggacaatcacatccagattttgataatgatatggctatttttgtagaacctacaagagaagaagtaagaaaggaactagaagaattaggagttccttcagaaaagatagatgaattaacagagaaaaaggttaataagagagttcatcaagctatgcagggtgttgtttataatttaaatactatgcattcaagagcaggatctcaggtaccatttagttctattaaccttggattaccagatagtgatgatgcagcacttgtatgtgaaatattcctattagaatacgaaaaaggattaggtaggggtgaacaacctatattccctaatataatatttagagttaaggatggcgttaatagagaagaaggagatccatatttctatttatataaattagcatgtagagtagcagccaagagaatgaatcctacattcatgaatattgatgcagatttcaataaagaatattacgatagaggatatgttccagcaacaatgggatgtagaacttatcttatgaagaatgtaaatggtgagcctggatgcaaaggaagaggaaatatagcacctacaactatgaatcttcctagaataggcctacaagcaaaaggagatttaaataaattctttgaaatactagatgctagacttaaccttgcaaaagaatcattaattcatagatacaatgtattaaagaatttaaaagttaaggatttaccttttgtagcaggtcaaggtcttatgaaaggttctgaaggactatgccctgatgattccattgaaccaatattaaaacaaggaacttggggaattggatttataggattggcggaaacattagtagctttagtaggtaagcatcatggagaagatgagaaagctagagaattaggaataaaaataattgagcacataagacaatattgcgatagattaacagaagaatataagttgaattggagttgttacgctacaccagcagaaggactctcaggtaaatttataaaacaagacaagaatatatttggaaaaatagaaggagttacagacaaggagtattatacaaatagtttccatgttcctgtatcatatccaatatcaattaaagataaaattgatattgaagcaccttatcataagctttgcaatggtggtcatataagctatattgaagttgatgatgctcctacagaagaagctgttatggatataataaattatgcatataagaaaactaatataagctatatggggataaatttccatataagatattgtaaaaattgtgggacatatttacaagaacatcaacatgaatgtccaaattgtagaagtactgatattcaaggaatttcaagagtaacaggataccttagtcttgatgaaagatttggaccaggaaaatactatgaaagagaagatagaatatctcatactgaaaatcataagcatcattattaaaaatattaataaaaaactcattaaacttaatataattaagtttaatgagttttttattatgaaaattatgtgaaataagtgcagttgaattaacataacaatcaaaagtatgcaataaataaaaaaaaacttgcaataactataagtaaaaagcaaaaaaaacggttaaaaatctaaaagtgtgaaggaagatgtatgacttgttgcaaaaaaataataataatacttgtctgataatactaaaatatgctattattaatgtgtactgtaaattaaaaggaaattaaaaggaaattaatttatgcaataagcaaaatattaaaatgggggaattagcatggtaattaatgataaggaaaacaaaaagattactatagtagatacgactcttagagatggggaacaaacagctggggtagttttcgctaatgaagaaaaaattgttatagctgaaatgttaagtgatttaggcgttgaccaattagaggttggtattccaactatgggtggagacgaaaagcaagctataacagaaattgttaagagaaatttaaaatcaagcataatggcttggaatagagctgtaattagtgatatagaacaatcaatagattgtggtgttgatgcagtggcaatttcaacatcagtatcagatatccatatacaacacaaacttaaaaagtcaagagaatgggtattagataatatggttaaatctgttgagtttgcaaagaaaaatggactatatgtttcggttaatggtgaagatgcatcaagagcagatagagaatttttagttgaatttataaatgcagcaaaacaagcaggagcagatagatttaggttctgtgatacagttggaataatggaaccatttagtcttagagatgagattaaatatctttatgataaaacaaaatttgatatagaaatgcatacacataatgattttggtatggcaacagcaaatgctttggctggacttcatggcggtgctacacacgttggggttactgtaaatggccttggtgaaagagctggaaatgctgcattagaagaagttttaatgtcacttatgatagtatgtggatacaaaggtgaaaatataaatacaaaaatgttcagagaagtatctgaatatgtttcaagagcatctggaagggaattaccaaaatggaaggccattgttggaactaatatgtttgctcacgaatcaggaatacatgcagatggagcactaaaagatcctaaaaactatgaagcttttgatccagatatagttggacttgaaagacaaatactcataggaaagcattcaggaagagctgctgtagttaataagtttgcagaatatgatataactcttacagatgatgaatcaaaaggaatattagaacttgttagatcaacttccgtgagattaaaaagaactctttttgataaagaagttgttcaattatataaggaatatcatagacaattagaagaaaaaaaatgtgattaattcattaaatcaatatataaaaaaaggttgtataggcacattcattattgcaatttagtaatatttcgatgatgaatatgtgctttaagtttagaaaatacataataagcaatgaaatagggggaacatcaaagtgggagataatttagtatataaaattttaaaaagccatatagttgaaggtgaattaaaggttggagaaccagtagcgttaaagattgacaagactttaactcaagattcaactggaacaatggcatatcttcaattagaagctatgggaatagatagagttaaaacaaaaaaatctgtagcatttgttgatcataacatgttacaacaaggatttgaaaatgctgatgatcataaatttattcaaactgttgcatctaaatatggagtatatttttcgaagccaggaaatggtatatgtcatcaaatattcttagaaagattctcaactccaggcgatactttaataggatctgacagtcatactccaacagcaggtggagttggtatgcttgctatgggtgcaggtggattagacgttgcattagctatgggtggtggagcttataatataaatactccaaaggttgtaaaagttgaacttacaggatcattaaataaaatggtttctgctaaagatgtaatacttgaagtattaagaatgcttactgttaaaggtggagttggtaaagtatttgaatatgcaggagaaggtgttaagagtctttctgttccagaaagagcgactataactaacatgggtgctgaacttggagcaacaacttcaatttttccaagtgatgaaagaactttagaattttttaaagcacaaggaagagaagacgaatggatagaattcaaaccagatgcagatgcagtttatgatgaagttgtaactgttaatttaagtgaattagaaccattaacagctaaaccacatatgccagataatgtagttaaagtaaatgatgcaggaaaaataaaagtagaccaagtatttatcggaagttgtacaaactcttcatacatggatttaatgaaggttgcaagaattttaaaaggcaaaaaagttaatcctaatgtaagcttagtaattggaccaggatcaagacaagttatggagatgattgctaggaatggggcattagcagatattataagtgctggagcaagaattcttgaaaactcttgtggtccatgtattggtatggggcaagcacctggaacaaatggaatatcattaagaacagtaaatagaaatttctatggaagaagtggaacattatctggacaaatatatattgtaagtccagaaacagctgcagtttcagcaattaatggatatttaactgatccaagagaaattgttagtgatgtagatttagatatagaaatgccagaaaaattcattatagatgattctatgattttagaaccagcaccaactaatgctgaagtagaagttgtgagaggtccaaacataaaaccattcccaataggaaaagaattaggttcagatgtagatggaaaggtagttattaaagttgaagacaatataacaacagatcatattatgccttcaaattctaagttattaccatttagatctaatataccttatctttcagaattctgttttagcacaatagatgcagagttccctaagagagctaaagataataatggtggattcatcattgctggaggaaactatggtcaaggttcaagtagagaacatgctgctcttgcacctttatacttaggaattaaaggagttgtagctaaatcatttgcaagaattcataaagctaacttaattaacaatggaataattccaatggaatttaagaatgaagctgattatgataagattgatttattagatgaattaaaaattgaaggtatagaaaatgccttagttgatggaaaagtgatagttaagaacttaactaagaatgttgaatttgaagctatagcagatcttacagaaaaagaaattgcagtaataaaagctggtggaagattaaattacgtaaaggctaatagctaggaattaataaataaaatgacagattagtatatcgatgcataataaaatatgcagatgctaatctgtcttttttatttaatgatataatagatatgtattataattgacatgtgaaaatgaaaagttaaagttaaaaactttactgagaaatttttcatatcatatgtaggtttataattggaacatatatattcacaaaaaatactaaatacaaaattaaaattttagtaaagtaagtacgtgggagtttgatagttatggataaagatatacgattatcaggaatagcatatgagagtttagtaaatggtccaggaattagaagagtatttttttcacaaggatgtaagcataattgtaaaggatgttttaatcctgatacacatgattttaatggtggagaaaaccgtaatatggatgaattgatagaatcagttttagataatcctatgattaaaggtgtgacttttagtggaggagatccattagaacaggcagagaagtttgcatatatggcaaaggcgtttaagaataataacttaaatatatggtgctatacaggttatacttatgaatatataagagaacataaagatgaaaataatggttggaatgaacttttaaataatatagatgttcttgttgatggaaaatttgaagaagagaatatgcaagaaggtttaaaatttagaggttcaacaaatcagagaataatagacataaaagagagtttaaatcatggtaagatagtaacactagattattaagataataatagattaaatatattttgtgcaaaggggtatggaaaatggaatacattttagaaaattcaaaattaagaatcaaggcaaggacatatggtggagaaataacttcaatattgaataaggagaataaagaagaatatttgtggaatggtaatcctgagtattggaaatatcatgcaccaatattgttcccaattgtaggtaaggttgcagattcgaaatatagggttaatggaaaagtatatgaacttccacagcatggattagcaagggtatcagaattttctatgattgataaaaaggaagatgaaattacatttgaattgaaatattcagaagaatcattaaaagtttatccttataaattttctttaaagtctaactatagattagaagatgatggagttagaataacttatattgtggaaaacttagatgacaaaaagatatatttttctataggagctcatccagcatttatgtgtcctatagataaaaacgatttactagaaaattgttatattgaatttaataaaattgagaatagtaagcaaattacacttacagaggaaggatatttatctcatagtagtagtgattgcttaaaggacacaaataaattgattttatctaaagaactttttaaaaatgatgcgttagttttcaatgatttaaaatcaaataaaatgactataaaatcagaaaagagcgataaatctttagaagtggattttacaggatttccttatatgggaatatgggcacctaaagatggagcaccttttgtttgtatagaaccttggtttgggcatgctgattattatgactttaatggtgattttacggaaaaagaaggtattaattctattgatgtttgtgaaaaatttagttgcacgtataaggtaacagctagataaaattaatatgtatcaacaataagagtattgtacaaaataaaaatatcaaaaagttttccacaaaattatgaaaaaacgaatatagttgtggattattattttgatgttgtggataaaatttaaacatatgcttattaaaaagttggtgagaaacatgattttagaaaaaagcttttacagtaaaggtgctttagatttggcgaaagaactattaggtaaaactattgtaagaaaaatagatggaagagttttaaaaggaaagatagttgaaacagaagcttatataggggaaattgataaagcgtcacatgcatataacggaagaagaacagcaagaacagagcctttatttcatgaaggtggaattgcatatgtgtattttatatacggtctttaccactgttttaatgtaataagtggagagaaggataagggtgagggagtattagttagagcagttgagcccttaaatgaatttaactatatatcacaaaaaaggtttaaaaagaatttcgatgaattaagcaacgcaaagaaaaagacagttacaaatggtccgtcaaaattatgtatggcttattcaatagataaaagtgaaaattataaaaagctatatgaaaatggggatttttatatagaagattctaatgaaagtgatttcgaaatagttgaaactaagaggattggaattgattatgctgaagaagcaattgattttccgtggagattctatataaaaggaaattcatatatatctgttaaataaacataacattaagttctggattgatataaaaagtcaattcagaacttaatttttatgttgttttataagtgcataataaagttgtaaatttaaataacgataaattacgtaagaagaaatttttaaaaatagtattttagatgaggggatgatggtgaatgattcaaggattaaagcaagaattaggtattgataagtataattccacttcaagatatgaaaaaaacagtgaaaagactaataaaaatgaaaatagcaattcaacagataaattacttggaaaggatacatttgaaaaatctgaaccaactgagaagttgacatatactaaatctgatatagaaaataaggcaaaggatacatctgcaagtgaagaagttaataggcttatagaagaaaatgaacgtaagcaagaggaatttaagcagttaataaaaagtttaatttcaaaacaaggtgatagctataatttaattttatttggacagaagcttaatgtaacaccagaaattgctcaaaaagcaaaagagtcaatttcagatggaggagaatattctgtagattcagttgctacgaatattatgaatatggcaaaagcattatcaggaggaaattcatccaatataggagaattaaaagagggctttttgaagggatttaaagaagctgaaaaggcttggggtggaaaacttccagagatttctcaaaagacctatgatgaagtattaaagcgatttgatgaatgggaaaatgaatcaaagcaacaatcaattgaaaagtaatatttttatactaaactacataaaaaagctgataataattcaggttgtgagttattatcagcttttaattatattttctagaattcagaagttccaggagttctagggaatggtattacgtctcttatgttagtcataccagtaatgtacataattaatctttcgaatcctaaaccgaatccagcgtgtttagtttctccgtattttcttaattctaagtaccaccagtaatcttctttagcaagacctaattcagccattctagtttctaaaacatcaagtctttcttctctttgacttcctccgatgatttcaccgattccaggaactaaaagatctgttgctgcaacagtcttgttatcatcattcattctcatatagaatgctttgatatcttttggataatcagttacaaatagaggtttcttgaagtgttcttcagtaagatatctttcatgttctgtttgtaagtcgattccccaagatacaggataatcaaattcttttccgcatttttctaatatttcaacagcttctgtataagttactctagcaaagtcagaagaaactacgtgatttaatctttctaataatcctttgtcaacaaatgagttgaagaattgcatttcttctggacattcatctattacatattggattacatacttaagcattgcttctgcaagttccatatcatcttgtaggtcagcaaaagctatttcaggttctatcatccagaattcagcagcgtgtcttgtagtgttagaattttcagctctgaatgttggtccgaatgtatatatatttctaaatgctaaagcaaagcattcagcatttaattgaccagaaacagtaagattagtttcttttccaaagaaatctttagtgtaatcaacgttaccttcttttgttaattcaggagtttttggatctaaagttgtaactctgaacatttctccagcaccttcacagtcactaccagttatgattggagtgtgtgtatatacgaagttttgttcttggaagaacttatgtattgcataagcagcaacagaacgaactctgaaagttgcagagaatgcattacttcttggtcttaaatgagcaatgcttcttaaatattcaaaagtgtgtcttttcttttgtagaggatagtctgagtttgacattccttctataattatttcttttgcctgtacttcaaatggttgcttagcatcaggtgtagcaactaaagttccagttatagtaagagacgaacttataggtaattttgaaatttccttaaaattgtctaacttttcatcaaatactatttgaatgtttttaaaaaatgaaccatcatttatttctatgaatccaaaagcattagatgctcttaaagttctgatccatcctgatattgttacatcctttgataagaaatcatcagcatttctataaaggcttctaattaaagttgattttgccataatatatgacctccattgttcatgattaattttacaaaataatgaaaaatttttttcataaaatttgcaaagaaaaaattaaaaatattatattttttagcacgagccaatacaatattcacaaatgaaatatatgagcaatttaaagtaaaagattaaattgctcaatgtatactattacggttaatgctaaataaattttacaatactttcttggtcaatgcaactaaccatatgtatcatatagtgataatattaaaatgctaaatctattattctactccagtttcaaatgaatggattaaagtttgaggaaaatcgagcatagtcatatctttaataatctttttcacttcataagttacttctttaatttttacttttacgcctccagaattagtgatgtccattatacagtatgttgggtttggtctgccgattttaggttttccaacacttccacaattaataaatagtttatttccaaattcctttgcacaagggatatgagtatgggcgcaaaggagtatgtcctcttttaatgcgctcattatttcggatgtattttcaccatcttgaagtaaatattcattaatcttattaggacttccgtgaacaaacaaaatacttttgttagcgatatttaaagatagagtagatggtaagttatcaaggaatattctattttcttctcttaattcgttaacagcccaaggcatagaaaaagaatttataggattttctctgatgaatgaaaattcattatctacaacggaactatcgtaatttcctttcaaacaaagaatattgcgtcttcttatggtagatacaacttcatttggatgtggaccgtatcctactaaatcgcccaagcagactatggtatcaactctttcactatctatatcttctaaaacagtcataagtgcataaatattagcatgaatatctgatattacagctattttcataagtaatcctccctaaatgcataaaaattatgtcattatataattttctatatgtttgaatttaaaactttaaatatattatatcattcatggttaaagtaagaatatgattttttatggaaaagttatataataagtaaaaaactattaaagttaagcaagatgtgtttataaatatatttaatagacataaagaggaggctctaaaaatgaaaaaacaaagagtattaaatgttattaatgaaatggagaaggcaggtttatctcagattatagtatcatctactgcatccatatattatcttactggaaaatggatttcagcaggagaaagaatgatagccttatatttaaataaaaatggagagcacaaatttatagtaaataagttatttccaattgaagaagacttaggcgttgaaattgtatggtatacagatagtgaagactcaattaagattttaagtaatatagttaataaaaatgaagcattgggtgtagataaattctggccagctcaatatattataagactaatggaacttaatgccgtaaaaggatttgtaaattcatcaggaataattgatgaacttagaatggttaaagatgaagaagaaaaagatcttatgagaaaatcatcaaagattaatgataaggttatggaagcacttaagagtgaactaagagaaggttatactgaaaagtattatgcaagattgttagctgaaatatatgaaaatgaaggagctcaaggtttctcttttgatccaatacttgcatatggtgaaaatgcagcagatcctcatcatgagccagatggaactaagcttaaaaaaggagatagtttagttattgatattggaggaatatataatcactattgctcagatatgacaagaactgtattctttgggaaagaaccaagtgaagagcatagaagaatatatgaaatagttagaaatgctaacttaaatgctatttcaaaagttaaagatggagttaaattttcagatatagatgcagcagcaagagattttataacagaagaagggtttggagaatactttactcatagaactggacatagcataggtttagagattcatgataaaggtgatgtaagttctattaatcatgcagaagtaaaagaagggatgattttttctattgaaccaggaatttaccttccaggtaatataggtgttagaattgaggatttagtgcttgtaactaaagatggatgtgaaatattaaattcagtgccaaaagaaattactgtagtttaatttagaattaaggctgcttcatattagaagcagccttttaaaatattatttattttctaaatatttttcaccaacaataactacatctccagcaccaactgttaataataaatctccatcgccaagcttagattttacgtattctaaagcttcatcatgtgaatgaacatttgtacaatttacaccggtagagcgtattgcatttccaagttcttcagaagatactaaaccagtatctttttcacgagcagcatagatatccattaaaataagttcatcacattcattaaaacaatgtgtgaattcatcaaataatgttttagttctagtatatgtgtgtggttggaatacacagtatactttattatggtctattttttgggctgtatttagagtcgcttttatttctgttggatgatgagcataatcatctattacagtaacgccatttaattcgcctttatattcaaatcttttatgagcacctttgcattttgataaaccttcaactgtatctttatcagcaatgttaaaaatcaaagaaacacatatagacgcaagtgcatttaagacattatgcttaccaggtacatttaaagttagagaaaatagctttttatcagacttataaacatcaaatgatgcacatcccattttattaaaagtaatatttttagcagtgacatctgaatcatcattaaatccataacttacagtattacattcagcatttgaaagaatttctttaactctttcatcatctccataaccaacaagataaccatcctttggtatcaattttgaaaaggccataaaagtatctgctatttcattaatatctttatagcagtctaagtgatcagcatcgatatttaagataattccaacataaggtgggaattttaagaatgattttttatattcacaagcttcggttaaaaaatattcactgttaccaattcggaaatttcctccgataacatctaattctccaccaactaagattgtaggatctaaatttgcagctaatgtaacgtgagaaagcattgaagtacatgttgttttaccatgagtacctgaaactgctacattatatttgtgacctttcattatatgtcccaaaaattcagctctgtccattaaaagtatattttgatctttagctgccaatatttcaggattatcggaaggaatggcagcagtataaactactaaatctacatctttttttatgttatctttgttatgacctatgtaaatttcagcaccttcagctcttaatttttcaacgataggtgaatctttaaaatctgatccagacactttgaaaccgctgtttagtagaacggcagcaagaccactcatactgataccgccaatacctataaaatgaatttttttatctctatcttttaagaaatcaaaagacacgaaatcaactcctttgctacttatagaattactaattctaatatttatttataaattaagatataaaatcaatatcaccattaagatattattgtataaattgtagaggagaaacaccatactataataatatttgtaatttattattaatatgtttctaaatttacacataatatttaaattcaaaattttaattttacactttaactataattatatacatttttttttgaatcaaccataaaataaaaaaatatataagaaattatggaaaaaattttttattattaataaatttatctatttattagattaatatatgtaatttattaaaaaatttaactggaagtatgaaaaaattatatatataatataactttatggataaaatcattgctattaattcgaaattagaataaaatatgaatattaagtgaatttaacaaataaaaattcgtgtaggtgatatggatggagaaatttactagaaataaaagagtagttgccataactaagattttgttagaaaaccctaataaaataatagggttaaatagatttctagaattattaaatgcggcaaaatctacaataagtgaagatattgtagtcgtaagagaagttttagaaaagcttcaaatgggaaaaattgaaactgttgcaggggttgcaggtggtatcaagtatattccaggtaatggtgatgaaagtaatagagcgtttgctttagaattatgtaaacaattagaagatgatggaagagttattccggggaatattatttatatgactgatttaatgtataatccagaaattataagtaaggctggtgttatgctttcatcatgtttcaaggcaagtgatattgattatgttattactgttgaaactaaaggaattcctttggcttatgaagtagcaaggaacttaggagtacaacttgttattgcaagaagagatagtcaggttacagaaggtcctacagttactataaattatgtttcaggaagtaatggaagacttcaacagatgtcattatcaaaaaaatcaatgaaaaataacagcagatgtatttttattgatgattttatgaaaggtggcggaactgctatcggaattaaggatctattaaaggagtttgatagtgaattagtaggaattggagtattagttgataataaacaaacagaaaagaaacttgtagatgagtatgtatctattgttgaattaaaagaagtagataaatcagcaattgtaggaatacaaccatcaaaattatttgcttaatattaaaaaatagtatttataatataatacacatttaagaacagaagatcagtggggtttctgttctttttttattatgaaattatgttaattatttgatttttaataaatttattgatattttattaaataattaaaaggaatttagaaatttatggagaaattatataaatattaacttattttaaagcaactggaggggtttaggatgcaaattacagacgttagaattagaaaaatagcatcagaaggtaaaatgaagggaattgtttctgtgacatttgataatgaatttgttgttcatgatattaaagttatagaaggtcaaatgggcttatttattgctatgccaagtagaaaaacaccagatggagagtttaaagatattgctcatccaattaatacagaagcaagagaaaaaattcagacagctattttagaagcatatgaaaaagctttatcagaagaagcgccacaagaataagcaatagaaacgtaagaggaagaagtaaatcttcctcttgtttgttatttattaaattagatgaaaagtggtgaagcagattaatgttctattatttatacttttgatattacgggatatgaataccttgaaataaaagtatgtttcaaatataattaatatgaatattagaagtgaaaaataagttaattaatcgtttaattaatatataatgaggtgttatttatgtataaatgtgcactagttttagcggctggtcaaggcaagagaataaaatcagatttaccaaaggtattacacaaagtttgtggtaaagaaatggtaaaacatgttatagattctattagaagtgctgaaatagatgatgtgaatttaataataggaaaaggtgcagagcttgtaaaagaaagaacaagtgataaaaacgtatcttattctcttcaagcagaacagcttggtacgggtcatgctgttaagtgtgctaaagaatttttgaatggcaaaaaaggtgttgttgcagtatttgcaggagatactccattaataaaaacatctacaattaaaaagttatttgatgaacacatcaacaatgaaaactcagcaacaatactaacatcactagttgaagatccaacgggttatggaagaatagtaagagatgataatggtgaagtgttaaagatagtagagcataaggattgtaatgaagaagaacttaagattaatgaaatgaatactgctatctattgtttcgatattgaattattagaaaaagctttagataaaataaataataataataatcaaggtgaatattatttgactgatgtcatagaaatattaaaggaagaagacaaaaaggttggagcagttgtaactgaatttgaagaaacaataggagttaattcaagagttcaacttgcacaagcagaagaaattcttagaaatagaataaacatcatgcatatggataatggtgttactttaatagatcctaagacaacatatattggagttgatgttgaaataggaaaggatactattatatatcctaataatattttagaaggcaatacaaaaataggtgaaagatgtcttatatatcaaaactcaagaatatcaaatagtattattgggaatgatgtagatattcaatcttctgtaatattagatagtaaagtaggagaaaatactacagtaggaccttttgcatatatccgtccagaaacaacaattggtaaacatgcaagaataggtgattttgttgaaattaaaaaatctactattggtgatggaactaaggtatctcatttaacttacattggagatgcagaagttggatcggaatgtaattttggatgtggaacagtagtagtaaattatgatggtaaagaaaagcataagacaataataggagatcatagctttataggatgtaatacaaatcttgtatcaccagtaaaagttgctgataatacttatattgctgcaggatcaactattacatgtgaagtaaaagaaggagaccttgcaatagcaagagctaaacaaagaaatattagtggatgggtagataaaaagggtctaaaaaaataaacttttaaatataaagataatccataaattttaaggaggtcttcctaatgataggtcatgtaagaaatataaaaattttcactggaaattcacactgtaaattagctcaagatatttctgatatcttaggagttgcagtaggaaagtcaaaggtttcaacatttagtgatggagaaatatcagttgatattaatgagactgtaagaggaatggatgtatttatagttcaatctacatgctcacctgttaacaataatcttatggaactgttaataatgatagatgcatttaaaagagcatcagcaggtagaataacagcagttgttccttactatggatatgcaaggcaagatagaaaagctaaatccagagatcctattacagctaagttagttgcagatttattgacagcagcaggtgcaaatagagtacttactatggatttacatgcatcacagatacaaggatattttaatatacctgttgatcatcttttaggagggccaatacttgcagaatattttatatctaaaggacttgaagatcaagatgatgttgttgtggtttcaccggatcttggtagtgtgacacgagcaagaaagtttgcagataatttacatgcacctatagcaattatagataagagaagaccaaaagcaaatgtttctgaaataatgaatattattggtgatgttgaaggaaaaagatgtatattgatagatgatatgattgatacagcaggaactataactaatgcagctaatgcacttaaggatttaggtgctaaaaatgtatatgcatgttgtacacatggagttttatctgggccagcgatggataggataaataaatcagcaatagaagaacttgtgatgttaaatacaattcctctaagtcaagataaagaatcagcgaaaataagatcaatatcagttgcacctctatttgctgaagcaatcaagagaatatatgatgatcaaccaataagcaagttatttgagtacgaaaaataatgtataagattatagaaacattaataataaaaactcccttgatggttatagccatagagggagttttaaggttataatataaggaattgaaaggaagtgtatttatatggagggttttgtaggtaaagttcttattgttgatgatgatgaaaatatttgtgaagttatagatatgtatctaaaaagtgttggatttaatacaaagatagctcttaatggaaaagaagcaaagatgttatatatggattataatcctgacttggtattgcttgacatgatgattccacaagttgatggaattgatgtacttaagtggattagaaaacaaggagaaagacctgttataatgatcactgctaaaggggatactttcgataaggttttagcattagaacttggtgctgatgattatatagtaaagccgtttgagcctaaagaattattagcaagagtaaaagctgtcttgagaagatattcagttgataacgataaaaatcaagtaattaaattaagtgatttagttatagattctacatcttataaggttatatatgatggaaaagacattaaaatgccaccaaaggaatttgagttattatactacttagcgagtaataaaaataaagtttttacaagagaacaacttttatgtgaagtttggggatatgattatccaggagattcaagaactgtagatgtacatgttaaaaggctgagagaaaaacttagtggtggagagcagtggcagattgaaacagtatggggtgtaggatataaattcgaggtaaaataaatgaagagaaaaagcttgctttataaattaattattattaatggaataattttaggatttattttgcattttcttgcatttgcattgtcattatggtttaagggaaacttttttgacgataaaaagacttcatttgaaaatacaggaagttatttagcaagagcagtagaatattataatggaaagaaaacagactttgagcttgaatatcttagaagaattacggaaatggcaagtatttctattgatgctaacattgttgtagtcgatgaaaataattataagtatctttcatctggcaatatggagaagaatgataatttaattgtatcaaaagataatatagatttattgaaacaaggtaagtatgttgagtatgttggtaattattatacatatttatatccagtaattcatcaagggacttttgaaggatatataattatgactagtcctttaaaagaaataaatagtaagttaaacaaagtgtatcttataatttggataggatcaatttgtacagttttattttcaataatagtattatcactgtttgcaaaaacatttttgataaatcctcttgcagaattgaataatgcagctaaaaagtttgctaatggagaagtaaaccgtagagttactatacagtctgaagatgaaattggacagcttgcaaaatcttttaatgttatggctgagtcccttgaaaaagttgaaatgaatagaagagattttatttcaaatgtatctcatgaattaagatcaccaataacatctataaagggatttattgcaggaataatagatggggtaattccaaaagataaagaaaatgagtatttagaaagagcttattttgaaatacaaaggctcactagattgataaatgatttattagacttatcagcaatttcatctggtaaattaaaattaaatattaaaaaagtagatataaatgaattaataagaagatgtataataaatagcgaaagaaaattgaaagaaaagggaataatattaaaggtatatctacaagatgataagtgttttgtaaatacagacgaagataaaataattcaagtagttactaatttactagataattcaataaagtattgtgaagataatggaattataacatgtagagtatattacaaaaacaacaaagtattagtagaaatatataacaatggacctaaactttcagaagaagaaaaaatacatatatgggatagattttataaatctgataaatcaagaactaataaagtcagcacaggcttaggactccctatagtacgaatgcttcttaatgaaatgggagaagaagtatgggctgagaatgatgaaaaaataggtgttagatttatttttacactttcaaaatacaattctaaaaatcaggcagtgttaaaaatttaaatttaataggtctgattaattaataggaggtttttatgtttttaatagtgggattaggaaatccgggtagtcagtatgaagatactagacataatataggttttaaagttgttgataatattgcaaaagagtataatattgaaataaataggcaaaaatttaaaggtatgtgtggtgaaggctttataaatggagaaaaggttattttattaaaacctactacatacatgaacttaagtggagaaagtattagagaagttgtagacttttataaattatctaatgatgatgttttagttatctatgatgatattagtcttgatgtaggaagacttagaatacgtgaaaaaggaagtgccggtgggcataatggtataaaaagtataatagcacatcttggaacagatattttcccaagaattaaagtaggcgtaggacaacctaatgtagatttggttaactatgtcttaggtaagtttacaaaagaagaaatggaagttttaaatgaaagtatcgatgcttcaacaaaggcagcaaaagaaataataagtaatgatgttaaaacagccatgaatatatataatggattcaaggcaagtaaaagtatttaaggatggtgcatgaaatgagattgaaggggttattagagccctttgaaaatagtgttgaatttgaaaatatattaggaagtattaataacgaaagatatcctattggtatatatggaattgctgaatcgggaagagtttatactattgatagtatctttgaaaatatagatagatctatggtaatagttactcaaagtgatatggaagctaaaaatatatatgaggatttattgttatatactaatgatgttcactattttccagcgaaggaaatggttttctataatatagatgctatttcgggtgatttaagatgggcgagactaaaagttataaatgaaattttaaaaaagaagaaaaagataatagtaacctcaatagatgctttttcagcaagatacactcctcataaattgtttgcagattatacaatgaagtttaaagaaagcgatgaaataaacctcattgaagtatctaaaaaacttatacaatcgggttatgagagagttgaaatggttgaaggaaaggggcagttcgcattgagagggggaatacttgatgtatttcctacatgttcggcttatccttatagaattgaacttttcggtgatgaaattgactctataagaactttcaatacagaatcacagagaagtattgataaagttaagaggatagaggtatttccagcaaaagaaataataataacagatgaaactatttctttaggtaaagaaaagttaaaaaaagaatttgataatatatcaaaaagtgatactgattcagctagggtagaaaaattaagaaatatattaaataaaaacttagaatcattggaagaaacttcaacatttgaaactatagatagttatcttccttatttctgcaaagaaacagaaagtctttttgattatcttaaggattgtttatttataattgatgatgttcaaaggtgcgaaggaaaacttgattcaacatatttagaatttgaagagaactttactgcattttctcaaaggggagatatatttccgaaacaaggtgaacttttaataagcaaagaggaagtaattgaatcttttaaagataaaaaagttgtatttttagatggattggttaagaaaaattcatggtttaatccatatacaacagttaatatttcagaaagaacattaaataactatcaaggtcagttggatttattaatagatgaaatatctgataagaaaaatcaaggatacaagatagtaattttatcaggaacaagggctaggggcgaacgtttagtaggaactttaagagatagaggtatagaaagttcttataaagacacagttgataatattcaatatggtgaagttgtaattacatttggtaaccaacttcatggttttcaatatcctgaatataaagtttgcgtaatatcagataaagaagtttttggagaagctaaaagaaagcttaagaaaactaaatcaaagagaaaaggtattgccaaaataaaaagctttgctgaattaaaacctggtgattatgtagtacatgcaaatcatggaataggtgtttataagggaataaagcaaatagaagttgctggtcataagagagattaccttgatattgtttatgataaaggtgataagttatatgttcctgtagaccaacttgatttaattcaaaaatatgtaggtagtgaaggaaaaagtcctaaggtaaataaacttggaagtgctgaatggcaaaaggctaaagcgaaagtaagaaaatctattaatgaaattgctgaggatttagtaaaattatatgctatgagaactacagtaaaaggacataaattttcaaaggatactcaatggcagaaacaatttgaagatgaatttccatacgatgaaactccagatcaattaacttcgttagaagaaataaaagctgatatggaatcagataaacctatggatagacttttatgtggagacgtaggatatggaaaaaccgaagtggctttaagggcagcttttaaagcagttatggatggaaagcaagttgcacttcttgttccaactacaattttagcagaacagcattataaaaatatgaaaaatagattttcagactttcctataaaaatagatatggtaagtagatttagaagtgctaaagagcagaaagaaacccttcagaaagtaaaagaaggaaatattgatattcttgtggggactcacagacttgtatcaaaagatattcaatttaaagatttaggacttttaattgttgatgaagagcagagatttggagtaaaacaaaaagagaaaattaaaaatattaagaagaatgtagatgtactgacattaagtgcaacaccaatacctagaactcttcatatgtcgctaagtggtgtgagggatatatctgttatagaaactccccagaagagagatatcctgttcagacatatgttgttgagcagaatgatcagctaataagagatgctattttaagagaaataggaagaggcggacaggtatattttgtatacaatagagtagaaaatattgatgctatagctaagtatgtgcaaaatcttgttccggagagcaaggttggtgtaatacatggtcagatggctgaaagacagcttgagcaagaaatgttcaattttatggaccagacatataatgttcttgtatgtacgactattatagaaactggtatggatattcaaaatgttaatacaattattgtttatgatgctgataaaatgggattatcgcagctttatcagttaagaggaagagttggaagatctaatagaatagcatatgcttatttattatatacaaaggataagattttaactgaagttgcagagaaaagattgaaagcattaaaagattttactgaacttggttctggattcaaaattgcaatgagagatcttgaaataagaggtgccggaaacatgatgggatcatctcaacatggtcacatggcagctattggttatgatttgtattgtagaatgttagaagatactgttaagcttataaggggagaaattcaaaaagaaccagtagaaacaactgtagatgttaaagtagatgcattcatatctgcagattatattgaagatgaaattcaaaaaattgaagtatataaaaagattgcagcaattgatagtgtggatgaatatgaagatattaaagaagagctagaagatagatattctacaatacctaatccagttcgtaatcttatggatattgcttatataaaaagtcaggcaaaatcactgtttattgaagaaataaaagagatgccaagagaaatagtattcagatttgcagaaggtgaaagtgattataagaatatatataagcttttaattgaaaaatataaagatagtgtagtattaaaatttggattaaatccgtatttctcatttaaattaaaagacattaagcaggagaataagttggagttcctaaaagaagtttttaatgacataatattgtaacaatattatgatataacataagaagtgtgaaaatattgtgaaaagtttgaattgtaaattcaatattgctatactaatattatgtaacttatacagaaatttaataaataagtgaggggaaaactttgaagagaataaaaaaattaattgcagcagttgctatctttactctttcaatatcagttatgggatgtaagatgatagaaaagactcctgaagcaatacaaaaaacggtttatgcaacagttggggatgaaaagataacgaaggctgatatggatgaagaaatgaaagcaactatagatcaattaaagcaacaatatggtgatgattatgcaaataatgaaaaaataaaagatcagcttaagcaaatgaaagttcaatatttaaatgccatggtaaatgaaaagttaatgcttaaaaatgctgaatcagtaggagttacaccaacagatgacgaattaaatgaatatgcagataagcaaattgaacaattaaaacaggcatatccagatgatgctcagcttcaacaagtactagaagcaaatggatttacagaagattcatataaggattatgctaaaaagcaatataaattacaaaaagttcaagaagctattactgctgatgttgaagttacagacgatgatgcaaaggcttattatgatgaaaataaagatagtcaatatacagttggagcaggtgccaatgctgcacatattttaatagctgaaaaaggtagcgatggaaatatagattttgatgcatcattagcaaaagctaatgaagtaaaagctaaattagatgcaggcgctgattttgcacaattagcatctgaatacggaacagatggaactaaggataagggtggagatttaggatttgtagcatataatcaagcaaactatgatcaagatttcttagctggctttaagcaattaagtgaaggtcaaatttctgatccaataaagagtcaatttggatatcatattattaaagctacagggattaaagatgaagttgtaacaccttttgatgatgttaaagaacaaataaaatctcaattattacaacaacagcaaagcaaagcattcaatgataagatatcagaatggaaagatgctgcaaaagttaaaacatatgaagataaactttaatatataaataaaaaaagcctttatggctttttttatttatattaaagaaattatcctgttgccatataaaaattctgtattgaaaagttataaaaaattctaattaattaattgtataaaatttagttataagtgtataaaatttctaaaaattcaaataataatattgcaactaattaacagagttttaaaggaggataaaaacctatatgaaggcaacaggaatagttagaagaattgatgatttaggaagagtagtaataccaaaagaaataaggagaactttaagaatcagagaaggggatccattagaaatatttacagatagagatggtggagtaatattaaagaaatattctccaattgaagaacttactgatttttcaaaagagtattgcgaaagtttacaacaagtaatcggacacattgtattaatttgtgataaggatgcatttgtatcagttagcggtgcaactaagaaggaatatctagaaagaaaagtaagtagtgaactagaaaaaattatggatgatagaaagactgtattattaagtaaatcaaataatacagtaattcctctacataatgatgatgaagaaacatcatataatagtcaagttatagctccaataatagcagaaggagatgaaattggagcagttattatattgtcaaaagaagaagatgttgaacttggtgaagttgaaactaaattagttgaaacagcagctgcttttttaggcaaacaaatggagcaataatttattcataattagagtaaacgttacagaaacaagataactttatctaaacataaatatgtgtcataatacctccaaacttacataaaaattagtaataacgtgttaagtttggaggtattttatgaataaacagtcactagtaaaaggaagtattattcttggcgttgcaggaatattaactaggtttttaggattattttttagatggccattaataatgcttatcggtgatgaaggaattggatattatcaaatgtcatatcctttatatatgttttttattgcaatggcttcaggaataccagtagccatgtctaagatgatatcagagagaaatgcagtaaatgatattgagggaagttttcaggtaatgaaagaatctacattactgatgatgattataggtataggaacaacattatcactattcttttttgcaaatcctataatatcattattaaaatgggattctaaagcttattattcattaatagggatttcttttgcaccaatggtaatttcatttattactatattcagaggtttttttcaaggttttcaaaatatgactccttcagcaatatctcaaatattagaacagattggtagagtagttgttggagttggactagctgttttcttattaccaaaaggaattgaatattcagcaggtggagcagcctttggtgccacagctggagctgttctaggtggatcttatttatatgcaaaatataaaaaagtaagaaaacaatatggaataaaaaagtaaaaactaatccagaaatgttaaatacaattttaaagatagcaattccaatatcattagggacaactgttggaagtattatgaatttaattgattcaattctagttccacaaaaattattgcaatcaggattaacaaatactgaggctactgtgctttatgctcagcttacaggtaaagcatctgttattgtaaatgtgccactcactctttctatggctatatgcacatctttgatacctataatagctgaaaattttgttttgaaaaaacatgcggaacttgaagaaaagatgcatatagcaatgaaaatggcaattgtaattgcattaccttgtgcatttggtcttttctttctagcaaatccagtattaaaattaatatttccaggaagatctgaaggtggagaaatattaagatatctatcattgtccataccatttataatagttactcagacaacaacatcaattttgcagggaactggaaattatattaagccagtaattaatttacttataggatgtattgttaaggttatccttacatgtatgcttgtctctatcaacagtattaatatttatggagctgtaattgcaagtgtaagtgcatatataactgctacattattaaatctgattactcttaaactatcattaagaataaaattgaatttttatgatattttaataaagccagcatatgcgacaacaattatgatgatttcagtaatattgagttataatattatatataaaaatacaggaagtaatggagtcgcttgcttattatcaatatttttaggtatgatagtatatatgatattagtagttgtatttaaggtatttaaagtatctgatataaagaagagattaaaaagaaagaattaaaaggagagatacctaatgattaaaatagttggattaggaccaggagcaaaagaagcgttgactataggaactgtttgggaacttgaaagtagtgaaaatatatttttgagaactgaaaaacatcctactgtagaatatttaaatgaaaaaaatatacagtttaatacttatgataatgtttatgagactatggaaagctttgatgaggtatattcaaatatagctaaggacttagtagaaaaacatagccaattaggagatttgatttatgcagttccaggtcatcccctagtagctgaaaaatcagtatttaatttaattgatgaatgtaagaaaaatagtatagaatataaagttattccagcagtaagttttattgatgctatgatggaaagtcttatgatagatcctattgaaggattgaaagtaattgatgcatttgatataaataatcaaattcttgataagagaataggaacaataataactcaagtttataatccattaatagcatctgaagtaaaactaaaattattagaacaatatgatgatgaaactgaaattttttatgtaagagctgctggaattaaaggtgaggaaagtataagaaacataccattatatgaattagatatgcaagaagatattgattatcttacatctatatatattcctaaagatttaaataataaaaaggattttaatgatcttttagaaattgtagaagttttaaggggagaaaacggatgcccttgggatagagaacagacccacaaatcattagaaaaggctttagtagaagaaagttatgaagttatagatgcaattgatagagaagatgacaatggattagttgaagaacttggagatgtactattacaagttgttttccatgcatctataggtaaagaagatggatattttgatataaatgaaattattacaggtatatgtaataagatgataagtagacatccacatgtttttggaactttaaataatattaatacatctaacgatgttcttacaaaatgggatgaattaaagaaagaagaaaagggatatgaaactttatcagaagaaatgaagggcgtaacaaaaggacttccatcacttttaagagcacataaggttcaaaataaagctaaaaaagttggatttgacttagctgatattgattctgctataaataagttaaaagaagaaattcaagaggtaatagatgtatataatacaaaaaatatggataagataaaagatgaggtcggcgatttactgtttagttgcgtaaatgtagcgagatttttaaatgttgatgaagaattagcgttgaatgctactatagacaagtttattaaaagattctcttatattgagggaaaaataaaggacaaaggacaagatttgcaagatgtaaatcttgataaaatggataaactatgggaggaagcaaaaaaactagaataatatcaataaaataaaggaattttctagtttgtgaagaataatattttattgagaactatattgtaaatctttatgtattattagttatatctaggaaaataaagacttttctatagactgttagctaaagaggatatataataaagaagtgcaatttagtacataatttagaaagcagttaaaaattatataactggattttaaggaggatgttattgtgaataaagcagaattaataactagtatggcagaaaaaagtaaattaactaaaaaagatgcagaattagctttaaaatcatttatcgaaagtgttgaagaagcattagaaaatggtgaaaaagttcaattagttggatttggaactttcgaaactagagaaagagcagctagagaaggaagaaacccaagaactaaagaagttatcaatattcctgcaacaactgttccagtgttcaaagcaggtaaagaattcaaagataaagttaacaagtaagataccgttaactaactaatatgaacccgagttatctcgggttcttttgatagaggagttaattatgagattagacaaatacttaaaggtatctcgtataataaaacgaagaactgtagctaaagaagtatgtgaaagtggtcgtataaacataaatgataaagttgcaaagccttctactaaaattaaagaaggagatataatagaaattacatttgcaaatagaatattaaaagcccaaatagttaatatagcagagcatgttagaaaagaagatgcaaaagaaatgtatataattattgaaggtgaagaagataaagagtagtggcttaaaaagttaactacttttttagaaaatttttatttaaatttcacaatccatattagaaatttatttttaataaaacataatataactatttatcatgtacatcaatcttctaaatgaaatttataatacatatatttattgtatataaacaataattgtggaggattttttgatggaaaagagagctgataatagcgtacaagataataaatctagtttaaaccttgaagatagaaagaagttaacgttaagtggagttgttgaggttatgagtttcgatgaagagaaaatagatctaacaactaaacttggtaatttaactataaaaggtgaagagttaaaaatgaataagctggatgttcaaaatggagatgttataattattggtaatatatcttctatggtttataatggaaaagtaagcaaaaaaaatggcgaaagtttattaaataaactttttaagtaggtgattgatatgccgttagaaataaatatgcaggttaatattgttatatatagttttattgcaggtatcattacaggaattctgtttgatatatatagaatatttagaggtatgaataaaattaaagttataacaataatagaagatttattattttggtcactatcatcgctaattatatttacttttttattatatatgaattatgcttttttaactctgtacgtatatgtatttatggtaatttcactgggaatatatctaaggttttttagtagatttttttatggtattgagaaacattttgctcaaaaaatgtataagatattaagagttgtattcaaaaatatcatgtatcctttaaaaatagttatatataaagttacagataaaagtaaatgataaaaaattacttgaatattaataagttagtgtttacaatagacttaagagaatttgtaaaatagaggttctatggatgaaaaagaaattaataataaaaaagctgataatttttgcttttgttattttctttggaggaagttatataaatcagttaataacaacaaagaagatagaaagtgaaatagaaaataagcaatctcaattggaagaaattcaagaaaagaatgaaagactgcaagaagaggtagaaaaaataaattctaattcagctgattacttagaaaaattagcaagagaacgacttggtatgattaaaccaggagagaaagttgttaatagtagtgatgaaaaagaagctaatccgaattaacatttattttatagataaacttatggtgcacaaaacaattaataatacgtgagtattaaaaattaaagaacagctgtaaaaggtcgttcttataataaatataaaatatatttttaaatttaaggaggaatcttttaaacatgaccttaatggcaggaaacatagtagaaggcacagtgataaacatcacaaattttggagcttttatagaagttgaaggaaagactggattagttcatatctcagaagtagcggattcttatgtaaaagacattagagaacatcttaatgagcaagataaagtaaaagtaaaggttatttcaattgatgataatgggaagattagtctttcaataaagcaggctaacattcaaaaaaagtcagttaagccagcagaagttgattggaatgtatctgaaaagaaaaaagcaactggaaattttgaagatataatgtcaaaatttttaaaagatagtgaagaaagaatgcaggatgtaaaaaaacatcaagaatttaagggtaaaggtggaagaaaaggctgctaatattcttaaaagttatatagactttttaaataataggttattttgggtgtagaataggtggaaattagtagttaattaattatctattctacattatttatgcttataaaccttagacataaagctgaatttaactaaatgaaaaatattttaaattttttgttgacagtatagggaatatgcattataattagttttgttgttgacagtcgtgttcaacaaaaggatatgccgaagtggcggaactggcagacgcacaggacttaaaatcctgcggtggttaaacaccgtaccggttcgattccggtcttcggcaccagtatatatgataaaataatatcgcggggtggagcagttggtagctcgtcgggctcataacccgaaggtcgtaggttcaagtcctgccccgcaaccatttatggcggaatagctcagctggctagagcactcggttcatacccgaggtgtcgtaggttcaagtcctatttccgctaccaatatgtgccgaagtggcggaactggcagacgcacaggacttaaaatcctgcggtggttaaacaccgtaccggttcgattccggtcttcggcaccatatatacaaaacataatatcgcggggtggagcagttggtagctcgtcgggctcataacccgaaggccgtaggttcaagtcctgcccccgcaaccattaatatggcggaatagctcagctggctagagcactcggttcatacccgaggtgtcgtaggttcaagtcctatttccgctaccaatatgtgccgaagtggcggaactggcagacgcacaggacttaaaatcctgcggtggttaaacaccgtaccggttcgattccggtcttcggcaccatatatataaaacataatatcgcggggtggagcagttggtagctcgtcgggctcataacccgaaggtcgtaggttcaagtcctgcctccgcaaccatttttatattgccatgccgaagtggcggaactggcagacgcacaggacttaaaatcctgcggtggttaaacaccgtaccggttcgattccggtcttcggcaccaagacttaagtaattttacttaagtcttttttgttatttagattatattataaaatttaatatttattttgcaaggagtaggaaatgaataattttatattatctataaatgttgtggctccattatttttaacaataatgtttgggtactttattagaagaataaatcttgttgatgaatatacactaaagaaaatgaataatttgatatttaaaacatttctacctatgttactattttttaatgtatatagtactaacatagagggagcaatagacgtaagactaatgatatttgcgccaacttgtatattgctgagttgtttgggggcatgtgctatagttccttttatggtaaaggaaagtaaaaagagaggtgttgtagtacaagctatatttagaagtaattttgttttgtttggccttccagtagtactatcactatttggagaagatggtgcaggaataacttctatattaatagcagttatagttcccatgtttaattttttagcagtaatagttttggaagtttttagaggtggaaatttaaatttaaaaactataattaagggaataataactaacccattaatactagcatctttactaggtatattaatgctagtattacaaataaagctacctacaatttttgaaaaaactatttcagatatgtctaaaatagctacaccattagcgttagtagttttaggaggatcttttagaatagaaaagataaataaaaatttaaaaccattaattattggagtgataggcaaattaataattgtaccgcttatatttattcctattgctatatatttaggatttagaggtatagaacttgcaagtgttatgataatgctttcagcaccagtggcagtttcatcatttacaatggcagaacagatggaagcagatggcgaattagcagcacaacttgtagtatttacatcaatgttttctgttttgacaatattcatttatatctttgttatgaaacaattatgttatatttaactaagcttcataaacaattaaattatccttgatttgatgctattcaagtacttcaaattagggatattttttttgcaatggttttgagatcataaaagcattaaaaataaaattaatatgcagtggtaagtaaatttatgaaaaaatatttatatataaagttctaataaattaatattagcgacaaatttatcatcaaaaaagaaatagattgtttctgaatagttaccattataatgtggatttttaaaataatattcaaatttgaatttgaaaaaataaaaataaatattagagaattttagatgaagttgtcctacgaaagttagatggatagtacatcttatgacatttatcgtaaaactgcagtgctataatcgagttacattattggtagaaggggcgagagaacgtgcagtatgaattaaatgtaaataagtatgaggaagttaaaagtcttcaaaaaacaaaaggaaaattaaatttaaaattacctatagttaatttaactttaatatttgtaataggaattttgcttggaagagtaagtctcttattaaatcaatctgatagtaagggcattgctccttttggaatagcatatttaatggctgtttctgtaaggaatagtaagcagaaagatgttagtgctgggattggagtgctattagggtatcttactgttaatagtttattaagtgatggaaatatgtatcttatttcaataggagtattaacattaagttatctcattattcctgccagcaaaaaaattagaaaggaaattttgggttttgttttaattttatctactttctttatatatggtatggcggtaaataaatatgaagttggtgtaaatattacattatgtcttattgagaccgttatgattatgcctatatattatgtaattaaatacgcggttgattcaatcgaagaatttgattataaatatctattttctacagaacaattagtaagtatagggattttattttgcttgatagtttctggaataggaaatgttactataatggattactctttaaaaaatatttttgcattattattagttttgtgtgtggcttatttgggtggagcagcttatggtgcaatgataggggtgtcaatgggagttatattaggtgtggcatcaaatgatatgatgtggtccataggcttttttagtgttggaggtcttattgtaggaatttttaaagatacagggaaaatattttcaatacttgcaggaataattatttactttgcattaggtttatattctaatgttttgagttttaaatttggagtagaagtattagccagctgtgctttatttttatgtattcctagggctgcatttaaaagtattgaagttgaaataaatccagatagaaaaagagaatttatagatgaaggaaaactaaatagtataagagaggagtttacgtttaaactaagagaattgacaactgtacttggtacggtatctaattgtcttggagcagcaacagaaaatgaaaagcttcttatgaaaggaaagggaagtgcattagtagaaaatttagcagatagatgttgttctaagtgtgaaaatagaccagcgtgttgggatagagaatttgcgcagacatataattcttttcaagcacttatacaaagttatgaagagaatactatatgtatgccagcagatttagaaaagaagtgtgttcaaagttttacacttttaagaaatgtagaaaatatagttgataataatacggtaaatgaaacaataaaagaaaggcttgcagaaggtagaaaattattatcctatcatattgatagtatttcaaatacattagatgatcttttgaatgattttaaaaagcaggtgatagtaaatacagatttagagaaaagagtaaggcttgctcttaataaaaagtcagtaaattataatgatatcttttgttatacagatatcaatggaaagataaaaataaaaatcagtatggatgattataagggagatgagcatttaaataagaaagtaataccattattaaatagtcttacaagaaaaaaattatgtgtatgtgaagaagaaagtagacttaatagtgaaaatgatgaatatattataagtattcaggaagaagctacattttatatggtttcctataattctatggttcctaagaatggagaaaatcagattggagatagttatacatttggtaatactaaagatggatgctatatgactatattaagtgatgggatgggattcggtcctgaagcaggacaggaaagcaaagcaacagttgatttagtggaaaggtttatagaagcaggcttcgatgaaaatataacagtgaatacagtaaattcaataatgggaatgagatttgctgaggatgaaaaatatgccactcttgatttgaataaagtagatttatatagtggtgaagctgtttttgttaagattggtgcagcgccaacttttattaagagaggaaatgaaataaaaataatcaattccaaaaatttaccttttggactagttgatgaagttgatgttgaagttataaaagaagaacttcaagctggagacatcatagtaagtgtaagtgatggaattttagatatagataaatcaaacattgaagagaaaacatgggttgaggattatttgagtaatgctaattctgatcctagggagttatctgaaagaatattaagtaaagcaaaagaattaagtggaggaacagttaaggatgatatgaccgtagtggtttcgaaagtttatctagcaagctagaatttatataaaaatagaaaaactaagcttagtttatagtgatttggtagcaatttgaacaataatgtttacattttaatattaaatacgtaaaatatattatacagtactatgtaataggaagtgtttattattgtataaaaaagtaatgtcttatataaaagacaataatttaattaaatctggagataaggttttggtagctctttctggtggacctgattctgtatgccttttgaatattttatataatttaaaagctgagctaaatatagaaattggagctgctcatttgaatcatttattaagagataaggatgcttttgaagatgaggaatatgtaaagactctatgcaaaagtttggatattccttgctttgtaaagcgcgttgatataaataaatattcaaaggataaaaagatgtcatctgagatggcagggagagacgcaagatataatttttttgatgatattgtaaaagatgaagggtatactaagattgctactgcgcataatgcaaatgatcaggctgaaactattctttttaggctgatgcgtggaagtggaattgaaggattatgtggaattaaagtaagaagagataaaattataagacccattttatgtttatcaagaaaagaagttgaagaatatatagaaataaataatttaaaacctagaattgataaaactaattttgaaaagatatataatagaaataaaatacgattagatatcattccgtatataaaggagaattttaatgaagatataatacagacattaaataggatgtctgtattattacagaaagataacgaatttatagaaaattctgcaagaagtttttatgaaaaacattgtatagaacagtcagactattttataataaaaaaggaaatgtttgataacaaagaagcagttgttactagagttatcagatatgccctcactaacttttctaaaactcattatgattttgaaatgaaacacatatatgaaatctgcaatcttgcaaaaaataattcgggtaaagctatagatttaccgaataaaatttatgctgaaaacatatatgggacatatacataaaagagagaataaatattaataatattgatgtaaaacaagaaatagtagtgaacaaaaatgagataaatggcaagaaaatattttttaatgatgaaaacataaaattttcagtattaaaaaatgattcaaatttagatttaaatcaaaataatttcataaagtattttgattttgataaaataaatgatagtatctcattaagaaagagaaaaaatggagataagataattcctttgggtatgaaaggaagtaaaaaaataaaagatttatttattgatatgaaagtacctaaagaagaaagagattgtataccacttttatgttttgatgaaaatatttcatggatagttggaattagagtttctgaagaatataagattactaataaaactaaaaatatattaagagtaattgttgaaagaaaggaaaaataaaatgagggaagatttaaaagaagtactattttcagaagaagtattaagtgaaaaggttagagagcttgcagttcaaataagtaaggattataaaggaaaggaactagttgttgttggaatattaaagggatctgttgtgtttacagcagaacttataaaaaatattgatatttactgtgaattagactttatggctgtttcaagctatggaaattcaacagaaactacaggagtagttagaattttaaaagatttagataatagtattgaaggaaaacacatattaattgttgaagatattgttgatacaggaacaacattaagttatcttcttaaatacttgaaggctagaaaggctgcaagtatagaaatagtagctttattaaataagccagcaagaagaaaagtagaacttccagtaaaatatatagggtttgaagttcctgatgccttcatagttggatatggaattgattatgctgaaaagtatagaaacttaccttgcataggtatattaaaacctgaaatatatgaaaaataaaatataaatttttattaaattggtattaaaattgtagtaaatttggagagggggccctgaatgaagaaatattcaagtgcggctgtgtggattgtatgtacagttatgttggtcttagcagcacttactatgtggcagaatggaaagacttctagtgatattgcttatagcacattcattcaaaaatgggattcaaaagaaatacaaagcattattgttagagaagataaaatgactgttgaaggtaaaactagtgatggtaaatctttcactacatatgttccaagtcaattgattaattcattaatagaacaaaaaccaaatgaagatgttaaggtgtcgtttgaagcaccttctagtaattcaacatggatgccagtggtactgccttgcatattgtttgcaggtgttatcttattatttatgtttgtaatgacccaacagtcccaaggtggcggaggaggaagaggggttatgaattttggtaaaagcaaagccaaaatgatgactccagatagccaaaccgttacttttgcagatgttgcaggggcagatgaagaaaaagctgaacttgaagagattgttgattttttaaagttgccagctaaatatatccaaatgggagcaagaatacctaaaggaattttattagtaggtcctccgggaacaggtaagacattacttgcaaaggcaatagctggtgaagctggtgtaccatttttcagtatatcaggttcggattttgttgagatgtttgtaggtgttggggcttcaagagttagaagcatgtttgaagaggctaagaaaaattcaccttgtttgatatttatagatgaaattgatgctgtaggtagacaaaggggtgctggacttggcggtggtcatgacgaaagagaacaaactttaaatcaacttttagttgaaatggatggttttggagttaatgaaggcatcataatgattgctgcaactaatagacctgatatacttgatcctgcattattaagaccaggaagatttgacagacaaattcttgttggggctcctgatgttaaaggaagggaagaaattcttaaagttcatacaaagaataaacctcttggtcctgatgtagatttgaaaattcttgcaaagagaactccaggattctgtggagcagatttagaaaatttaacaaatgaagctgctttacttgcagttcgtagaagtaaaaaagcaattcttatggaagaaatggaagaagctattacaagagtaattgcaggtcctgaaaagaagagtaaagtaatcacagagcatgataaaaagttaacggcctatcatgaggctggtcatgcagttgttatgaaattgttacctaattgtgatccggttcatgaaataagtataattccaagaggaagagctgggggtatacaatgcatcttcctaaagaagatacatcatatacttctaagttaaaattaaaagatgaaatggttggattacttggtggaagagtggctgaaaaattaatcatgggagatataagtactggtgctaaaaatgatattgatagagctagtaatatagctaaaagcatggttatggaatatggaatgagtgatgaaattggtactatatcatatggttcaggtcatgacgaagtattcttaggtagggatttaggaaagagtagagattttagtgaagaaattggtgctaaaattgataaagaaataaaaagatttattgatgaagcttatgacaaagctcatgagttgttaaaagaaaatttaaataaactacatgctgtagctcaagctttgatagaaaaagaaaaattagatgcagatgaatttgaagaaatatttgcgaacaattaatgaaaagacttgctggaattctagcaagtcttttcttataattataaattaaaaagaattgtttgtatgattgaaatttgaaagaatgaaaaattataatttatgaaataatatagtaagatatatcggttaaaagtgaaataacacgaatattttggcgtattataaatataatattcgaaaattgcttttaaaatatatagcgaaatgatataatgataatacaattaattatagaactattatagaaatattctataatatcaggggagtaattatatgaaaagtgatattcaaatagcgcaagaagcaaaaatggaaccaattaaaaatattgcagaaaaactagggctttgtgaagatgacgttgagtactatggtaaatataaatgtaaaatatctttagatgtatatgataaagtaaaagataataaagatggtaagcttgttttagtaacagctattaatccaacaccagcaggtgaaggaaaatcaactgttacagtaggtcttgggcaggctttaaataaaatgggtaagaatgctgtaatagcactaagagaaccttctttagggcctgtttttggtattaagggaggagctgcaggtggaggatatgctcaggttgttcctatggaggatataaaccttcattttactggggatatgcatgctataacttctgctaacaatttattaagtgcagcaatagataatcatattcatcaaggaaatgttttagaaattgattcaagaagaatattatttaaaagagtaattgatatgaatgatagatctttaagacacatagttgtaggtatgggtggaaaagttaatggatttgtaagagaagatggttttacaattactgttgcttcagaaatcatggctatattatgcctagcaagtgatttagaagatttaaaagaaagaatgggaaatatagtagttgcatataatttagctggagaaccggtatatgctaaacaattagaagtacaaggtgctatggctttattaatgaaagatgcaatcaaacctaatttagttcagactttagaaaatacaccagcattaatacatggaggtccatttgcaaatatagctcatggatgtaattctattatggctactaaacttgctttaaagcttggagatgttgctattacagaagccggatttggagctgatttaggagcagagaagttctttgatataaaatgtagatatgggaacttaaagcctgaatgtgtagttatagttgctacaataagagcattgaaacatcatggtggagtggctaagatggatttaaatactccaaatgttgaagctttagcaaaaggaatagcaaatttagaaaagcaaattgaaaatataaagaaatttaatgtaacaccagttgttgctataaatagattcgtttctgatagtgatgaagaagttgaatacataaaagatttctgcaacaaaatggatgttaaagttgctttatcagacgtttgggctaaaggtggagaaggtggaattgaactcggaaatatcgtaatggatattttagaaacaaacacttctgaattcgctcctatttatgatgaaaaagcaacaattgaagaaaaagttttaacaatagcaaaagaaatttatggagctattaaagttaattatactccagcagcaaagaaacaaattgctgaattagaaaaatttaatttagataaacttcctgtatgtatggctaaaactcaatattcattatctgataatgcaagtcttcttggaaaaccagaaggatttgaaattactgtaaaagaagtaagagtttctaatggagctggatttgtagtagttcaaacaggtgatataatgacaatgccaggattacctaagacaccagcagctaataaaatggatgttcttaagagtggagaaattgtaggattattctaaaatatacgtgaaactattgacaaataagcagaaattgttaaaattaaattgttatttttaagaaatttctagattaaagcagctcttggggctgcttttaatttaactatattaaggtggtgcttttaatgatcctacttgtagatgcaggtaataccaacattgttttgggtgtacatgatggaaatgattatattgcaagctggcgtatttccagtgaaggaaataagacttctgatgaatatggaatacaggttatgcagctttttaatttaagcaatattgatcctgaaaatatagaaggagttatagtttcatcagttgtacctaatataatgcattctctagaaaatatgcttagaaagtgtttttgtcatgagccaataatagttggaccaggaataaaaacagggataaatataaaatatgataatccaagagaagtaggagcagataggatagttaatgctgttgctgcttatgaaatgtataaaagaccggttataataatagattttggaacagcaactacatactgtgcagttaaagaaaatggggattatcttggaggttgcatatgtccagggataagaatatcttcggatgctttatttgaaagagcagcaaaactgccaagagtagaattagaagtaccaaaaaatataatatgtaagaataccgttacaagtatgcaggctggtattttatttggttatatagggcaagttgaatatatagtaaagaaaatgaaagaagaaatgagaaaacttaaaactaatgaggaacctttagtaatagctactggtggtttagctaatcttatagctaaggaaacggatgttattgataaagttgattcagaattaacattagaggggttaaagatattatactataagaataaggagtaaagtataaatgaacataggagatttaacctttgaaaataatgtatttctagcacctatggcaggtgtaacagatatatcatttagaggattatgcaaagaaatgggatgcgggcttgtatatactgaaatggttagtgcaaaagcattatactatggaagtgaaaacactaaagagttattaagaatcgctgaagaggaaaagcctgtggctgttcagatatttggaagagagcctgagataatggctaaaatggttgaagagcattttaatcatcgagatgatatatgcattatagatataaatatgggatgtccagcaactaaaatagtaaaaaatggagaaggttcagcacttatgaaagaacctgaactagcatataaaatagtaagaaaaataaaagaagtttcaacaaagccagtaactgtaaaatttagaaagggttttgatgaagaaaatataaatgcagttgaatttgcaaagggtatggaacaagcaggagctgatgctgttgctattcatggtagaacaagaaaacaaatgtatcaaggaaaggctgactgggatataataaagtcagtaaaagaaaatgtttctatacctgttataggaaatggtgatgtattttcgccagaggatgcattgcgaatgaaggaacttactaattgtgatggaattatgattgcaagaggtagtcaaggaaatccgtggctttttagacagattaaagatgtacttgaaggaaaaataccacaagaagtaacaaataaagaacgtgtagaaatgtgccttagacattatgagttagctataaaatatgatggtgaatataaggcgataagggaaatgagaaaacatgcttcttggtatataaaaggcttgccaaagtgtactgatatcagaaatgaaataaatgtattagatgatagtagtaaggttattgatattttaaaggaatataaagaacatttataaattaaatgagattttaagttttatttaattagtattggtaatatagatagtataagtttcattatagatgctatactatagaagagtgaaattaagcataatttaactgttagaacgagtgattagtttaacttgcttttattgacatatcatatatgctgatttataattagttaaatgatttcaaggttgtaaggctattttagttgttttgacggaaatattatgtaagaaactctgtttttaatttttaaacagagtttatatgagttaattagaaaatgctcttttaaaataggagcagatattaaataaataatagaggttttaaaggggagtacagcatatgagcgaaaataaaaaacaatatgtaatgacttacgaaggtgttaaaaagttagaaaacgaattagaatatttaaaaactgttaaaagaaaagaaataactgaaaaaataaaagtagcattaggatatggagatttaagtgaaaactctgaatatgatgaagctaaaaacgatcaggcattcacagaaggtagaattgttacattagaaaatatgttaaagaatgctgttgttgtagatgaatcagaaataccaaaagatgttgtttctgtaggttcaaaagttaaagttaaagattatgaatttgatgaagaagtggaatattcaattgtaggttcagcagaagcagatcctatgaattttaaaatatcaaatgaatcaccagttggaagtgctttaataggtaagaagataggcgagatagtagaagtacaaattccagatggtgtgaacaagtttgaaatattaggaataagtagaagttaattggaggtacaataatgtcaacagaagaaatgagtatgcaggagttagagtctcaatttagtgaacaagaaggtttaagaagagagaaactagcagagttacaaaaagcagataaggatccttttgatgtttataaggtaaatagaactcacacaactggagaagttagggataattatgaagaactagaaggtaaagaagtaacaattgccggaagaataatgtctaaaagaggtcaaggaaaggttgtattctcagatatccatgataaagatggtaagatgcaattattcttaaagattgataaggttggagaagaaaatttaaaagaatataagacttatgatattggagactgggtagcagctactggagaagtatttactactcaaagaggtgaaatatcaattaatgttaattcttttgaattaacatgtaagtcattaaaaccattaccagaaaagtggcatgggttaaaagatccagatttaagatatagacaaagagaattagatataataactaactcagaagttaaagatacttttgttaagagaagtagaattatatcagctatgagagaatttttagataatagaggattcttagaagttgaaactccaattctttctccaattgcaggtggagctgctgcaaaaccattcgtaacacatcataatactttagatatggatatgttcttaagaatagcgccagaattatatcttaagagattaatagttgctggatttgaaaaagtttatgaaattggaagaaatttcagaaatgaaggtatgtctgttagacataatccagaatttactgcaatagaattatatgaagcatactcagattataatgacatgatggaaattacagaaaacatggttgcttatgtttgtgaaaagataaatggaactactaaagttacatatcaaggaacagaaatagactttatgccaccatggagaagaataactatggttgatgctgttaaagaatatgcaggtgtggattttactacaattaattctgatgaagaagctcaagctatagctaaagagaagaacttagaattccctaagccattaaatacagtaactaaaggtgaagtgttaaatgctctatatgaagagtttggtgaagaaaaaatgattcaaccaacattcataatggattatccagtagaaaattcacctcttactaagaagaagagaggtaatgctgaatttactgaaagatttgaagcatttgtatttggtagagagttaggaaatgcatattctgaattaaatgatcctatagttcaaagagaaagatttgaacaacaagctaatgcaagagaattaggtgatgatgaagcatacatgttagatgaacaattcatgagtgctttagaaacaggtatgccacctacaggtgggttaggtatagggatagatagacttataatgttcttaactgattcagcatcaataagagacgttatattattcccaacaatgaagccacaaaaatagtaaaataaaattgatttatattatatataaaagttaattatgttaagtctgcattggaattatgcagacttttctttatattgaattaaagaaataaagaagtatacaataagcaaagaaaatgtaataaaagtattgcataatgtaaaaaacctgttataatagattaagtaatgacgttccgcgatagctcaatggtggagcactcggctgttaaccgataggctggaggttcgagtcctcttcgcggagccattttttaatataaatggttatttcatcccgtataattagtatatgggatttttttgttttaaatatattttatgactatacaaaattagagaagattaatatattgtaaaatgtgaaattaaataaatataaaaacatagtttaattatttatttaatgatttaacatctatattagagttttataattagctatacatactgcaatatagaatcataaaaataaatttaaaaaaatttaaaaaaagtattgcataatataaaaaacctgctataataaattaagtaatgacgttccgcgatagctcaatggtggagcactcggctgttaaccgataggttggaggttcgagtcctcttcgcggagccattttttttgctttttttagtgaatagttaatttatttcgcttaaagtaggcgaggtttttgttttttttatttaaatgctatacaagtttgtatagcatttttatttatataatagattacgatatctggtatctattaatacttatatttaattttgagtaataaagttgattaattttatattaaaaaataatgagctattaaaattttaatagctcattattacataggttatacagtattctttttatccataaattgaaaggattctaaaattatttttgttgaatatcttttttgttgttgtttatccatataacttcctatttgaatatgaccttcaatagaaatttgacttcctttagaaagatattcattaattatttcggcttttttatcaaaagccacaatatcaatgaaatctgtaactttctctcctgtaaatttattgtagttattaatagctaaggggaattgtatgtaacatcttttaccgttatcaaagaatttcaactcaaaatcatgagcaatcctaccaattagatatactttattcataacataaacctccagtttgcttcaagatattagaattatggacataaatagaaacttatattcaaaaaatcagaaaaaatttaaaaaaggtattgcataatgtgaaaaacctgttataatagattaagtaatgacgttccgcgatagctcaatggtggagcactcggctgttaaccgataggttggaggttcgagtcctcttcgcggagccattttttttatattttttaataataaatacctattgtatttcgcatgttaattatgcggatttttttatataaaatattattacgtgttgaaatgtagtagtttgttgtttaaaaaaattatttatgcaaataattatattgacatataaaaacattttgctaaaattaaatgtataaattgaaaatgcatgttgataaagaagagtagtttaaaaatcaattttagagagataatgtgcggtggaaattatcattgattttaaatgaaaggaacttttgagtgtgagcaagaaagatggacttaagtcaagaagggtggaaccgcggaattataatttcgtccctttgtgatgtgggtctttttattttataaaaatatattttggagggaaaaattatggcagtagaaaaaacaatggataagattgtagctctttgtaagaatagaggatttgtattccctggctcagatatatatggtggccttgcgaattcatgggattacggccctttaggagtagaatttaaaaataatgttaaaaaagcatggtggaaaaagtttgttcaagaaagcccttacaatgtaggattggattcagcaatattaatgaacccagaagtttgggttgcatcaggacacgttggtggattctcagatccattgatggattgtaaagaatgtaaagctagatttagagctgataagattgttgaagatcatatgacagctaatggtgcagaagtagcaagtgctgatggatggactaatgaacaattaaaagaatacattgaaagtaacaacatagtatgtcctaagtgtggtaagatgaactacacagatataagaaagtttaatcttatgtttaagacattccaaggagttactgaagatgctaagtcagaaatgtacttaagacctgaaacagctcaaggtatatttgtaaactttaaagcagttcaaagaacttcaagaaagaaagtaccttttggtatagctcaaataggtaagtctttcagaaatgaaattactccaggtaacttcacgttcagaacaagagaatttgaacaaatggaattagaattcttctgtaagccaggaacagatttagaatggcataagtactggaaagattactgctggaatttcttacttaacttaaatgtaaaaccagaaaacttaagaatgagagatcatggagaagaagaattatcattctactcaaatgcaacatctgatatagaatacttattcccatttggatggggtgaattatggggaatagcagatagaactgattatgacttaaataaacaccaagagcattcaggacaggatttaagctatctagatcaaacaactaatgaaaaatacataccatatgtaattgaaccatcattaggtgctgatagagttgcgttagcattcttaatagaagcttatgatgaagaggaattagaaggtggagattctagaacagtaatgcacttacatcctgctttagctccatttaaagctgctatattaccactttcgaagaaactttcagaaagagcattagaagtttatgctgacttaagcaagaaattcaacttagactttgatgaaacaggaagtatcggaaagagatacagaagacaagatgaaataggaactccatactgtataacaattgacttcgaaacattagaagatgaagcggttactatcagaaatagagatactatggaacaagaaagaattaagataagtgaacttgaatcatatattcaaaaaagtttagaattttaatatagctatgagcttactgatgaatttatcagtaagctcatattttttaatgtataggaacttacaatgataggataatgtttaaagtattgaatttagctaattgatagaattgaaagcatgattaaacacttttttttatatttaatatacttgtgataagataaataggaaaaaaattgaatacattgctaatttggtagaagaaggttttttgtagtgatataattaaaatcagatagatttcagataataacgtagaaggtactattaattttgttggaggaaaaataatgaaaaaggattttaaagagtttaaaaattatatatcaaataaaaaggttgctgtagttggtatcggtgttagtaatattccattgataaattttcttttacagcttggagctcatgtgactggttttgacagaaagacaaaagaagatcttggagaggttgcaatagattttgaagcaaaaggtgtaaaacttgaactcggagaagggtatttggataatttgattggatatgaagttgtatttaagagtccatcaatgaggattgatagtgaagcgttagttagggctaaaagtgaaggagcatatattacttctgaaatggaagagttcgtaagatataccaaagggaagatttatgcagttacaggcagtgatggtaaaacaacaacgacaactataatttctaaattattaaaagaacaaggatataatacttgggttggtggaaacataggtacgcctttattttctgaaatagaaaacataaaagatgaagataaagttgttttagagttatcaagctttcaattgatgactatgagtgaagaaatagatattgctatatgcactaatttagcacctaatcatttagatatgcataaggatatgaaggaatatgtagattctaagaaaaacatatttttatatcagtctgcaaaggatgtgttggttgttaacagagaaaatgaaataacatatgaatttgaaaaagaagcaaagggtattgtacgagaatttagttctaaaagaaaaatagaaaatggagcttattatgaagacggtattctttacctagaaggaaaagaagtttgtagaaaagaagatatagttataaaaggtatgcataatgtagaaaattatcttgctgcttttattgcaacaaaggatgaagtatctatagaggtaatgaaaaaagttgctgaaacttttgctggcgttgaacatagatgcgagtttataagagaacttgatggggttaaatattataatgattcaattgcatctagtcccacaagaacattagctggtttaaaagcttttgataaaaaggttattttaattgctggtggttatgataaacatataccttttgaaccacttgcttatgaagggtatccatatataaaagaattaattcttgttggagctactagtgataaaattgaagctgtgtttaaagctcttgaaaatgaaaaaggcattaaaactaatataaaaagagctaatactttagaagaggctgtatctatatgtaaatcaatcgctgaagtcggagatgttgtaacattatcacctgcttgtgcggcatttgatatgtttgctaattttatggttagaggtaatacatttaaaaagattgtgaatgcgttataaattgtagtagattatgtatttataatgttatgattatctaaaaattaatactgtaaataagacaaaggcatgtagagtttcatctacatgcctttgtcttatttatttgagaatgttttatagtaaatattatttacatttaggctgggactataaaatatacctgatggagttaaatgataagaattaattccgaaagatacttctggttttaatgtaatctctgaagttgaagcatcaatagatagtgagtaaaggttattaatatcatcaccatttataaagtatatagtgtcattaatagtttgaagttgaaatccattcataatttttaatcttctagtttctagatttgttggctttaaagcataaaggttgttgttatctgaagagttaaaaaataatatttcatctttatatgttataaaactgttagcggtataatcggtcaatttatgtttgtcactataatctgattttatagaatataatttagaattatcgtttaagttttgataaataatataatcaccattaactatgtattgtccaactgaatcagaagttacgagtgaagcttttgatgtctcggtatcatatatgtataatttgttcttgtcggctttatttttataataaattagattttttactataatcatttgatctactgagtggttatttaatttaacagtttctttgttggtgagcttacatgaatacaaactattgttatcagaactatttgcgaaataaaggtattctccaattatccctatgttattagatgaataatcaataaaatcttttactgattgactttctaatatattctctggaagtggatctggaattattgaaattctattgttttcatcaggatttgtgaaaattaaatctgtgccattaaatataaaaggacagaaataatatgattctccattaattttaaaattagaatcattagagttatcagcattatatgtagtactagtagctgttattggtgatgtactagcaggtgtgtttggttttgagttagttgcttctgtatcagcttttccacatccaactatattaagtaaggttatagataaaattatacaaattatttttttcttcattaaaaatctccccataatcaaagtctgaattatatatttttttaaatactatcttttaaatgcaatatatacaaatatttagtttataaacaataagttatagattctatataaatgtcgtataaaaatgtataatactaaatagtaataagcttatatattaaataataagtacattcttaatatatattataaagaaaaaagtagagaagtgtaattttacagcccgatattcatagattattttcatataaaacagtatatagctagtaattataatgactaatagacgtaaaaattacagaaaaactcattttgaaatgataacttagccacgtgtatcctatatcgaaaaacgtattattacgatgaaattattagcaatacaactgtaatttatatagattggagatatacatataattaattataaaaaacatgatatcataatattcgttgtcagggggaaacgccaacaacaaaaaacaaaatcagctaagaagttcaaaaatttatttaaaataaatgttgacaacgaaagctgatgatggtattataataaagcggtcgagagagaccgacaagatctttgaaaattgaacagaatatgatataaatatttaagtaaaccagcaattctttattttgagtaagctaagattaaactttttattgagagtttgatcctggctcaggacgaacgctggcggcgtgcttaacacatgcaagtcgagcgatgaagctccttcgggagtggattagcggcggacgggtgagtaacacgtgggtaacctgcctcatagaggggaatagcctttcgaaaggaagattaataccgcataagattgtagtaccgcatggtacagcaattaaaggagtaatccgctatgagatggacccgcgtcgcattagctagttggtgaggtaacggctcaccaaggcgacgatgcgtagccgacctgagagggtgatcggccacattgggactgagacacggcccagactcctacgggaggcagcagtggggaatattgcacaatgggggaaccctgatgcagcaacgccgcgtgagtgatgacggtcttcggattgtaaagctctgtctttagggacgataatgacggtacctaaggaggaagccacggctaactacgtgccagcagccgcggtaatacgtaggtggcaagcgttgtccggatttactgggcgtaaagggagcgtaggtggatatttaagtgggatgtgaaataccgggcttaacctgggtgctgcattccaaactggatatctagagtgcaggagaggaaaggagaattcctagtgtagcggtgaaatgcgtagagattaggaagaataccagtggcgaaggcgcctttctggactgtaactgacactgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattactctgtaatggaggaagccacttcggtggcaggaagacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggtcggtacaatgagatgcaacctcgcgagagtgagcaaaactataaaaccgatctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtgagctaacgcgtaagcgaggcagcgacctaaggtagggtcagcgattggggtgaagtcgtaacaaggtagccgtaggagaacctgcggctggatcacctcctttctatggagaaatctagcaaacatggcgtttgactagtacaaagatgcaaagcatctataaaaattacaacttgctcaaaggttacttaatagatattaatatctgttcaattttgagggatcttccttcaaaatactcatggggtatagctcagttgggagagcactgccttgcacgcaggggtcaagagttcgaatctctttatatccaccatgagggcttatagctcagctggttagagcgcacgcctgataagcgtgaggtcgatggttcgagtccatttaagccaccatattgttctttgaaaattgcatattaacaattgtatataatacaacaaagccaagaataaatattctttgtgaatgattaatataaccagttttgtatatcaaaacttaaaaaggtcaagctacaaagggcgcatggtgaatgccttggcatcaggagccgatgaaggacgtgataagctgcgataagcttcgggtaggcgcacatagccagagatccggagatttccgaatggggaaacccgcatgagaaacctcatgcatcgtaaagtgaatacatagctttatgaaggaacacctagggaactgaaacatctaagtacctagaggaagagaaagaaaaatcgattttcttagtagcggcgagcgaaaaggaaagagcccaaaccagagatttatctctggggttgcggacagaacataacgtgaaattatgattaaccgaacacaactggaaagttggaccgtaggaggtaatagtcctgtaagtaaaagtcataatgatcagttctgcaccagagtactacgagacacgtgaaaccttgtgggaagcagggaggaccacctcccaaggctaaatactacctgatgaccgatagtgaagcagtaccgtgagggaaaggtgaaaagaaccccgggaggggagtgaaatagaacctgaaaccatgtgcctacaaccgatcaaagcaccttatgtgtgtgatgatgtgctttttgtagaacgagccaacgagttacggtatgtagcgaggttaagtacttaaggtacggagccgaagggaaaccgagtcttaatagggcgactagttgcatgctgtagacccgaaaccgggtgacctatccatggccaggttgaagcgagggtaaaacctcgtggaggaccgaaccacgttgctgttgaaaaagcatgggatgagctgtggatagcggagaaattccaatcgaactcggatatagctggttctcctcgaaatagctttagggctagcgtcgtgaaatgtgagtactggaggtagagcactgaataggctagggggcatagcgcttaccgaaccttatcaaactccgaatgccagatactatcagcacggcagtcagactatgaaagataagttccatggtcaaaagggaaacagcccagatcgtcagctaaggtcccaaagtgtaagttaagtggaaaaggatgtgggatttctaagacaactaggatgttggcttagaagcagccactcattaaaagagtgcgtaatagctcactagtcaagagatcctgcgccgaaaatgtccggggctcaaacttaccaccgaagctacgggttcatactttgtatgagcggtagaggagcgtcgtaatcgggctgaagtcgtaccgtaaggagcggtggactgattacgagtgagaatgttggcattagtagcgagatgtaggtgagaatcctacaggccgaatatctaaggtttcctgagtaaagtttgtcttctcagggttagtcgggacctaaggcgaggccgagaggcgtagtcgatggacaattggttgatattccaataccactataatcgttattatcgatggtgtgacggagaaggataggatgtgccagctattggatgctggtctaagcgttgagggagttagaacaggcaaatccgttctaacaatcctagggcgtgatggggaaggttccacggaaccgaagtatctgatttcatgcttccaagaaaagcatctagaaagagaagtagtgcccgtaccgcaaaccgacacaggtagatgaggagagaatcctaaggccgacggaagaatcacagttaaggaactaggcaaattgaccccgtaacttcgggagaaggggtgcctaccatctggtaggccgcagagaataggcacaagcaactgtttaacaaaaacacaggtctctgctaaagcgtaagctgatgtataggggctgacgcctgcccggtgctggaaggttaaggggaacacttagcgcaagcgaaggtgtgaacttaagccccagtaaacggcggccgtaactataacggtcctaaggtagcgaaattccttgtcaggtaagttctgacccgcacgaatggcgtaatgacttgtgcactgtctcaactgtgaatccggcgaagttgtagtgcgagtgaagatgctcgctacccgcgattggacggaaagaccccgtagagctttactgtagcttagcattgaatttcggtattgtctgtacaggataggtgggagactgggaaattagggcgtcagccttaatggagtcgttgttgggataccaccctgatagtattgaagttctaactggatgccatgaaactggtgacaggacattgttaggtgggcagtttgactggggcggtcgcctcctaaaatgtaacggaggcgcccaaaggttccctcagaacggtcggaaatcgttcgtagagtgtaaaggcataagggagcctgactgcgagacctacaagtcgagcagggacgaaagtcgggcttagtgatccggtggtacctcgtgggagggccatcgctcaacggataaaagctacctcggggataacaggctgatctcccccaagagttcacatcgacggggaggtttggcacctcgatgtcggctcgtcgcatcctggggctgaagtaggtcccaagggttgggctgttcgcccattaaagcggcacgcgagctgggttcagaacgtcgtgagacagttcggtccctatccgtcgcgggcgtaggaaatttgagaggagctgtccttagtacgagaggaccgggatggactgacctatggtgtaccagttgtttcgccagaagcatagctgggtagctaagtcgggaagggataaacgctgaaagcatctaagtgtgaagcccacctcaagatgagatttcccatagcataagctagtaagaccccttgaagactacaaggttgataggtcagaggtgtaagtgcggtaacgtatttagctgactgatactaataggtcgagggcttgaccaataatcatgtatagtatataatgttaatatgcaattttgaaagaacaatagttttttcaattaaaatctcgtgacgatggcatagaggtaacactccttcccattccgaacaggacagttaaggtctataacgccgatggtactgcatgggagactgtgtggaagagtaggaagttgcgaggtaagatggctcgatagctcagtcggtagagcagaggactgaaaatcctcgtgtcactggttcgattccagttcgagccaccatatatggcgctatagccaagtggtaaggcagaggtctgcaaaacctttattccccagttcaaatctgggtggcgcctccaaataaaaatctgaagtttttacttcagatttttttgttatataagattatttaatattagtaagaaaaaatacgatatattgtataataaaataaaaaagatatgttgttaaaacatatcttttttatatagtataaatgctactaaggtggctattccagctattattgtcataacaatagcaaatgagtgtggtccattagagaatggtaaataatcaatgttcataccataaataccactgacgatagtaggaatcgcaagtaatatagtaacggaagccaacactttcattactatattaagattatttgatattactgatgcgaaaaaatccattgtacttgcaagtatattactataaatttcagtcatttcgattgcttgtttgttttctatgattacatcttctaaaacatctttatcttcttcatatttttgcattaattcaagtttaagcattttttccagtgttatttcattagcctttaaagaagtagaaaaataaacaagagatttctcaagtgaatgcaattggataagttctctatttttcattgatttatgtaatcttttttcaatcataaggctttttttatctatttgtcttaaataaataaggtagtatgttgatatcctgttcaaaatttgcaatatgaatcttgattttttaaatgtataaaaagatttcactttttgattagcaaagtctgttaaaattttgctgtttttaagacatacagttattatttgtttttctgtatgtattattgataatggataagtatcataagttaaagagttatcttccatttcagtaaagggaatatccacaattactaacaaagcatcatcttcaatttctatacgtgaagtttcctcatcatctagagcggattttagtagatctaaatttactcctgttttctttgaaattagaattaattcttcatctgatggagctactatatttatccaagatccattttctatagtatcaagtgtttttagtttgcagttagattcactctcacttttataaatttgaatcaatagatacacctcctaatagttcttttattattatactattatataaggttaaatgcctagaagaaatgtatttaataaagtcccattctgtaagaaactgaatgggacttgaatttatttttttatattgttataaaattctgccttaacttcttgtaaaagagtttcgttttctattaaatctattgctgtacttgcaagagatatggcagcagttaaacattgctttagagcaaattctgaaattgtattctgtgcaaattctaaacttccatactttatgttttgattttcttcgtttaaaacagatatataaggatgtattgaaggtacggtatggcttacatctccaatacttaaacctgcataaatatctttaggtggattaatatgaattattccattctctttaagattatgactaaataatctatttaaagttctattggttataagttctttattaggacattcatataagaaaaactcatgatcaatatttgttaattcacttacatgattagcaatagttctgattttctcatcacctaattcagcaagcttagtatttaaagcacgaatatagaatttgatttctgattctactggtaaaagtaatggagtaaaaccaccatttgatattatagaattaatttctaagttatcaggaaatcctttttttatagaatcaattatatttagtgtaagtaaagctgcatctaaagatgtgaaagattttttatttaaaaaacgtaggcctttatctccaataaattttagaccaagaggaattattgcagaagaagaaccgctttcacatgtctcagtatctggatgtgcaaccataactacatctatatcttcgaaaacaccttgtcttaccattgttccttttgtccctccaagatattctccagggcatcctattaatattgaagaaccaccaattttgtcaattatactacctaaagctatggcagcagccactgaaattgtagttacaaggttatgacctgttaagtgaccatcgtgttctatagcatcgtactcacaaagaaaacaaatttttgggtatccactgcccttttgtgcaaaaaaggcattatctatgtctacaaatttttcagtaacattaaaattatatttttttagtagatcaccaatatattttgaagaattatattcgttataacttatttcaggattttcatataagtaagttgctaaattttttatatcatcctcacatgtagataaaaaagagataatttcttgtttcatgaatttaatttgttacgaagactcatatttatttataatgtaggaaaagcctttcgtaacgtctcctttcttaaaatatttaactattaattttagtgttaccaataaaataaaaataatttatataatatattgtattaaattttatatttgaggaaataatctagatagatttaattttatatgtgtaaaagggggattagttgtggaaaactcaataaaaaaatgttttatatgtggacagattaattgtgatggtataataataaatggagaaatgatttgcagaaattgtgaagaaaaaattgtaaatacaaaagtagatgattcggattatgatgaacttaaagattcaataaaaataattttatttgatgaatgcaaaaaataatatatatatgaaggataaatagtttattctgctaaaatataaatattactttttatctactttaatatatttctctagtttatcttttaataaagtgaggtatatatgaaaaaaggtttatttatagtttttgaaggtggagaaggaactggaaaaacaacagcaattgaatcaatatatgattggattcaagaaaaagatttaaagtgcataaaaacaagagaacctggtggtataaaaatatcggaagaaataagacaagttattttagataaagacaacactaagatggatggaagaacagaagcgcttctttatgcagctgcaagaaggcagcatttagtcgaaaaggtaattccagcattaaatgagggatatgtagttctttgtgatagatttattgattcatctcttgcatatcaaggatttgcaagagggttaggaatagatgaggttatgagcataaataaatttgctataggtgaatatatgcctgatttatctatattatttgatttagaacctaaaattggtttagagagaataagtaccagtggagaaagagaaattaatagattagatttagaaaagatagattttcatgaaaaagtaagagaaggatacaataaagtttataaagaaaacagacatagaatagtaaaaataaatgcagaacaatctaaagagaatgttttaaaggaaataaaaaagatactagaaaataaattttttcagctataatatataaagaaataataatttaaaagtaaatttactaataatcaaagcaatataaaatacatcctatttgtggtaaaataaagaatatctaatattttattaaataagagataaatttattatttaaagggtgggatttgtgatgaaattagtaattgctattgtagaagatgaagattcaatggatctgatagatgctttaacagatggaaaatacagagtaacaaagcttgctactacagggggatttcttaaatcaggaaatacgacacttatggtaggggttgaagaagaaaaggttaaaggggttatagatataattaaagatatatgcaaaaaaagaaaagaaatactagctacgccaacaacgttgagtggaggagaaagtgcatacatgcaacagtatcctgtacaaataaatgtaggaggagctactgtttttgtaattgatgtagatcaatttataaaaatataatattaggagagtaagattttgaggaagatactaggacatgaaggtattataaatggaattaataaaaggaaattaaataattcattttctcatgcaaacttaattgttggtgctgatggaattggaaagagcgttattgcaaagtatctttcgaataatattatagagcctagagataatgctgaaagtgttgatatagtaagatattatccttcttcatcatcttttggggtagatgatgtaaggcatattatagatgaagttagtaaaaaaccttatgaaggtgataagaaggttttaattttatataaatgtgataaaatgactactcaggctcaaaatgcattacttaaaacaattgaagagcctccagtaggcgtatatttaatattgttaagtgattcgttagaaactattttagatacaattcaatcaagatgtcaggtatataagttaacacccctttcaaaagaagagatattagaatatatagaaactaatttcccagatatagagtctaatgataggcatgcagcattagcatttagtacgggtatacctggaaagatagataagtttattaatgatcaaaaattgaaggaattaagaaatacttgtgtagaactattttcagatattctcaaaagagaacatggattagtattaaaataccaagaattattaaaaaatttcaaagatgaaaagtatgatcttctagatatattaattttatttattagagatattatggtatttaaggaacttaataataaagaattggttgttaactttgataaaatagataatattatagatatatcaatgggaataacttataaaaaacttaatagtatgttagaatacataaaagaagctagaataaattttaatagtaatacaaactattcaatgaccgttagtgtaatgctgatgggatttgcggaggtataataaatgataaaagtaataggagtgagatttaaaaaagcaggtaaaatttattactttagtccgactgatcttgatataaaaagaggacagtatgtaatagtagaaactgcaagaggaattgaatttggagaatgtgtaattggaataaaggaaattagtgaagaagagattgtttctccattaaaatgtgttataagaattgcagatgaaaaggatattcttaaacataaagaaaataaagcaaaagaaattgaagctttagaaatttgtttaaaaaagatacaagagcataagttagatatgaaacttatagatgttgaatacacttttgataataataaagtaatattttattttacagcagatggaagagttgattttagagaattagttaaagatttagctactatctttaaaacaaggattgaattaagacaaataggagtaagagatgaagccaaaatggtgggaggtcttggaccatgcggaagaccaatgtgttgttcaacttttttaggtgattttgcatctgtttcaataaaaatggctaaagaacaaaacttatcgcttaatcctacaaaaatttctggaatatgtggacgtttaatgtgttgcttaaattatgaacaaaacacttatgaagaaattagaaagagactacccaaagttggatctattgtcaaaactgaatatggaaatggttcagttataggtaattcaatagtgaaagaaatggtaaaagttaaattgaaaaaaggcgacgaagaagtagtagaagaattcaaaattatagatgttgagttagttacaggagaatatgaagatactattgatgaaaataatataaagctaatagttgaatcagaagaagataagaagcttataaagaatcttataaatgaaaagtagggggatttctatgaagtcagtaataaaaatattaaatatgaattcacagaaagactcaaaaaagattcaaaatattttaatacatagcactggtgttatagcaagtcagacatctttaataaaaaaggaagtaacagtagtatatgatgacctatcaattaaaatagagaaaataatagaattaatagaagacttgggatatttagtaatataaataataattataaatattgattaaattttggaaatcataatataaaatactttaaaaacattatgatacatgataaaatgtaagaggttaattactacaatttattaggaggtgttctgaaatggcatttgttattaatgattcatgtgttagttgtggagcatgcgctggagaatgtccagttagcgctattactcaaggagatactcaattcgttatagatgcagatacttgtatcgattgcggaaactgtgctaatgtttgtccagttggagctccagtacaagaataatagtaaaaaaagactacgtttgtagtctttttttcttatacaattatattagaaaaatagcttataataaaatgtttagtatggaggttgtaatagaatagtctccatactttttgtttttaaatctaattttaataaatctatagagttagtattcacttttgaaacttttttcatagatattataaaatctttacaatcatttaaagcaaagtctgtaacaggtgttttatagtgcataggaataatgtatctaggcgttagcaatttacacaaatttgctgcctttttaccatctaaagtgaaatttccgccaattggaataagaagaaaatccaatgaattaagttcatctaatataggctgtgcaggaatatgacccaaatctcctaaatgtgctaatgttaaattgttaaatttatatatataaattgtattcattcctcttttaagtccattataatcatcatgaaaggaattgaatccttttaattgtagaaaatctaaattaaaattaccataggtatcaatgacttttgtatcattatttattggatttatagaagagtgatcaaagtgagagtggcttatcgttattaaatcgcacttagggaaatctatcttataacctaatgatttattaaacggatcaattagaattcttttaccttcatttgtttttatcataaaacatgaatgaccgtaccaaattaactgcataaatatcctccaagtttaaatactataaatatgttaataataatttgtgaaataaaatatatttatatgtataaatttatgcctgtttatacatataaatatagtatgggttttaatattaaatatcaaagctattattatttttgactaagaaagagagttttaatcaaaatccattttttaaatactctttaaaagaaaaaagaataatagtataattatataaagtcaaagtaagtcaaaaacaaatattttattaaaagtttaagtaggtgatgttatggcaagactttcagatataatagaagaattcataaaagaaatgtttaataacaatagtaataacaatgttatttttatacaaagaaatgaattggcagatcaatttagatgtgcaccatcacaaataaattatgtattaactacaaggtttacttatgaaaaaggatatttaattgaaagtaaacgaggtggtggtggtcatattgcaattaaacaacttgaaaaagattgttttaataatagagaagaagtaataaatgaaagtattggtgatacaataacatatcataatgctagtgcactattagatcatttgcatgaatcagaaattataaataaacgagaatgcgaaataatgaagatggcagtaaatgataggagccttgcgtcatcagaaaatagaaataaagtaagagccgatatattaaaaggcatgattatgataattttatcttaagggcggggatatgtatgttatgcgaaaaatgtaaaaaaaatgaagctagaataaatttagttaaaatagttaatggtgaaaaacaacagatatggttatgcgaagaatgtgctaaaaatatatctaatataccatttttaagttcaattccagaaggagcagggtttccatttcaagaagttttaaatgggttgttaacaggtgttgaaaatgcacaaaacaacgtaaaagaagaaaaaccagtatgccctacttgtggattgacttatgatgactttaaaaaaacaaaaaaagttggatgttctaactgttattttgtatttaaaaagtcaattaaggcaataattaaaaatactagtggtgaaaaaactcataaaggaagaattccgaagagaatacaaaatgaattttatcaaagagatagattgaagcatcttaagcaacaacttcaaatattagtttcagatgaagagtatgagaaagctgcaattattagagatgaaataagagaaatggaattatatataatagagagtaatattaattctgaaaaacaggattgtaaggaggaaaattgtaatggacaactggattcttaattgtaatcaaaatgacatagttataagcacaaagattcaactttcaagaaacattgaaaaaataccttttcctgagaaacttactgttgctgatggaagaaaaaatgttgaaacaatatataattctataaaggattcatttgaaagtgatgatttagagttatatgaaatctgggaaagagataaaagactttttaatgaatatttagataagaatttaataagtgatactttattaaaaaattcggataaggcatctttcattttaaatagggatgaaactatgagtatcatgataaatgaagaggatcatataaaaatacaatgtattacttctggattgaatttggaagaggttttacagaatgtagttaaaattgatgaagaaatagagaagaatgtaaagtatgcttttgatgaggaatttggatatttaacttcacgtatagaaaatgttggagctgcaatgaaagttcaagtattaattcatttgccagcaataactatgagtgaagaagttgaaaatctttcaaagaggttaaacaataaaggtctagaaataaaaggattatatttggaaggttctgattcattaggtaatatatatataatatctaataaagcttctttgggtgttactgaagaaaatattatatgcacaatgaaagaagaagttttaaaattaattgcggatgaatacaagtttagagagatactaacaggaaaatgtaaatacgaactagaagataaaatatatagggcacttgctattttacagcatgcagtacttctagattttaaagaagcattagatttaatatctaaagtaagattaggagtagaattatcactaataccgattaataaagaaaagattaataaattaattgtaaatattaaagattcatccattgaaaatatatctggaagaagattgactgaaaaagaaataaagtatgagagagctaatatagttagaaaattattaatataagtaggattgtgagggttagaagaaatggaatatagcaaattaacagaaagagctcaagtagttattttagaagcagaaggagaatcagaaaagtttaaacatggttatgtgggaactgagcatatactacttggcatattaaaggaaaatggttactcggcaacacttcttaaaaagcatggaatatatctagagaatataagagaaatgttgcaaagatacttgggctatggtgatattactaaaactggtgatgatattctattaactcctagaactaaaagactattagatgaaagtttttctgaagctaaaaaattagatcatagatttgttggaccagaacacatattgcttgcattagtggctcaagaagagggaatggcttatactatattgaagagtttaaaattaaactttgataatattaaagaagaattaactcagtttttatctggtggaaactatgaagataaagccgttgataatgaaagcgaacataacactaaaaaagaaaagactcctatgttagacaaatatggaagagatttaactcaactagcacaggaaggtactttagatcctgttataggaagagatatagaaaatcaaagagtattagaaatattatgtagaagaataaaaaataatccgtgtcttataggtgagccaggtgtaggtaaaactgcagttatagaaggacttgctcagagaataatagatggtaatgttccagaaattcttaaaaataaaagagttatatctttagatttaacatctatgatagcaggtgctaaatatagaggagagtttgaagagcgtttaaagaaaacaatggatgaaatacgtaaggataaaagcgttattatatttatagatgaaatacacacaattataggggccggtggagctgagggtgcaattgatgcctctaatatattgaaaccggctttagctaggggagaaattcaatgtataggtgctacaactattgatgaatatagaaagtatattgaaaaggattctgcgcttgaaagaagatttcaacctgtaactgtagaagaaccatcaaaggaagatactttagagatattaaaaggactaagagataaatacgaagctcatcacagagttaaaataacagatgaagctttggtagcggctgtaaacttatctgataggtatataacagatagatttatgccagataaagctattgatttaatagatgaaggtgcagctaaggtaagaattgaaagcttgactgaaccgccagaattaaaagagatagaagaaagaatagcattaatagataaggaaaaagaagatgctataatgatacaagattttgaaaaagctgctaatttgagggataatgaaaaagaacttaaaactgaattagaaaataagaaaaaagaatggaatgctcaaagttcaagcaagcttttaattgtagataaagagaagattgctaatgtcgtatctgtatggactaatataccaatagagaaacttactgaatctgaaagtgaaaaattactacatttagaggatattcttcataaaagagtaatagggcaaaatgaagctgtaaaatcaatagcaagagctgttagaagagctagagttggaattaaggatcctaataggcctattggaagctttattttcctaggaccaacaggagttggaaaaacagaactttcaaaggctcttgcagaagctatgtttggagatgaaaatagcatcataagagttgatatgtcagaatatatggaaagtcattcagttgctaaactaattggtgcacctccaggttatataggtcatgaagatggtggacaattaacagaggcagtaagaagaaaaccttattcaattgtattgttagatgaaattgaaaaggcacatcaagatatttttaatgtacttcttcagataatggaagatggaagacttactgatggtaaaggaaaggttgtaaactttaagaatacaataattataatgacatctaatgttggagcacatcaaattaagaaacagaaaactataggatttaattctgctcaaaatgaggagtcagattatgaaaaaatgaaagaaaatattttaggtgaacttaagaaacaatttaaacctgaatttcttaatagaatagatgatactatagtatttcataaacttaacgatcaagatttagataaaattatggacttaatgttaaagtctattaaagatagattagaacatagagaaatatatttaaattttgaagataatagtaaggaatttcttttaaataaggggattgatcttgagaatggagcaagacctttaagaagaattctaattaaggaagtagaagataggcttagtgaagaaattcttcaaggaaatattcaaattggagataaagttaaagtaagtaatttagacgataaacttatttttagcaaattaatataattatttagactgttttaatagaaatgtataaaactattaaaacagtctatttgttataattaatacattggaaaaagattgtcttagtagaaagttttatataaaatattaatttaaattttattgtgttaattaacttttttattgataaaatcttgtatttaaactagtatagttgattaaagttaagggaatattattattagataaaaataattatacacaaattaacttgttaatgataaaatcaatacaaagatataaatgattggttcaagattaaaactgttcctgataatttataaaatcttaagtaatggtattatatgaaaagtagtaatatatcatttacagtttgtattactgagccaaatggttaggagaagttatggttaaagaaattaaagagttagatttaataataataggtggaggtccagcaggattaacagcagctatatatgcaggtagagcaaaattaaatacattacttttggaaaataaaatcttaggtggacaggttagaaatagtttcactattgaaaattatcctgggtttaagagtattcaaggtggaaaacttgctgatttatttcaagaacaagctgctgaatttggagcagttatagatgaatttgatttaattgaaaaaatagatctttcagaagaagaaaaagttattgagacagaaacttttatatataagccaaaagcagtgataattgcgactggtgctgtaccaaggaaattaccgataaaaggtgaaaagaattttgctggaaagggtattcattattgtgcagtatgtgatggtgctatgtatgaaggaaaaaatattgcagttgtaggaggtggaaatgcagcacttgaagaagctttatttttgacaaagtttgctgaaaaagtatatttaattcgtagatataactactttaaaggggaacagtcagttatagatgaagtgtttaatcatcctaagatagaagtattattaaatgaagatgtaatagaagctaaaggacaagattttttaaatagtgttgtattaaagaatactttagatggaatagtttctgaattaaaagtagacgcagtctttggatatattggaactgaacctaaaacggaagaggttaaaaaatatttaaatataaatgagcagggttacataataacaaatgaagatatggaaaccaatataaaaggcgtatatgcagctggagatgtaagagagaaaaaatatagacagattacaacagctgtatctgatggaactatagctctattaaatgcagaaaagtatatattagaaaggaagaagtaaaaatgataaaagtatattcaacatcttggtgtcctgaatgtgtgcaggttaaaaaatattttgattttaaaggaatagaatatttagaaataaatgttgcagataaacaggaagatagagaggaagtattaagagtatctggacagagaacagtacccgttattgaatgcgatggaaacataattgtaggatttaatagggcattaatagataaagcaattaacaaataaggataataaataaattcatataaaaaaaggagctattcaataggctccttttttatatgaatttatttatctaaagcttttaaaatagcaggcttatcaaatcctattattatattatcattaatatctaaaactggaactcccatttgacgagattttttaatcatctcttctcttgcttccatatcatcttggacatttaattcagtatactcgaggttttgagattttaaataagctttaaccttgtcacaccaaggacacgaatctgtagtatatacttttatcataagaaaactattgcgtgcatataaaaataatgattttatgtggcaatagttttttcacctccttaatcaataattattattttatgattattattatagtataggtttaatatgcaagcaagagaataaacatgatattatttaagatttatttcataacttagttaaagctagactatttttaatacaatagactataattcattattttataatattagaatcatcaaggttagaattgaagactaaattattaaactggccctcagaacactttgtagatgataaatctgtcagatttttttcataagaattatgaagaatatttgatgttggttcgggaatattatcaagataattcttacttatcataaatatcaactcctcaaaattatttactatagtttttgtaataaatgccttaattatgctaaaaataataaatataattacgaatttattaaatacttttaatgtaagtaaattgaattattaaaagagtgtattatggtataataattaataaggttaagattttgatataaattttctaaggagacatttaatgaagaaaagaacagtgtatagatgctcaaattgtggattcgaaagcataaaatggcttgggaaatgtcctacatgcaattgttggaatactttagatgaagttgttgttgctgataaaaatactaaagcagcaaaagtaagggaagcaactaaaaagccattaaaaaaattaaatgaagtagtatcaaataagagtgataggataattactggtataaatgaatttgacagagttatgggaggaggaattgtaaaagattcaatatcgataattacagcaaggcctggtgctgggaaatcaactttattacttcagatttcaaatgaagtatctaagcgtggacttaaggttatatatgcttcaggagaagaaagtgatagtcagataaaaaatagagcagatagaatacttgataagataaatgaaaatatatgggtgcttcaagaaactagtcttgacaatgtattagatgcaattgaagaaattgatcccgatttagttataattgatagtattcagacatttacaatggagaatgcaatgccagctagagctggatcaccaacgcagactatggaatgtgcaaatgctttactaaatgttgctaagaatgaaaaaagacaaagagcagtgattattgtagggcaaatgactaaaaatgatgaacttgcagggttaagggcattggagcatcttgttgatactgttcttataattgaagacgacaatgatgaagaacttagagtattggtgagttctaaaaatagatttggtggaatagaaaatggattttttcaaatgtgtgaaagaggaataatatcaatagataatccatcggaatttttcatgactaaacgtgatgaaggggaaattgtttctggaagtgcactgacggttataaaagaagggacacgttctataataactgaaatagaaagtcttgtttcgaaaagttttacaccttatccaacacgtattggtgaaactcttggaaaagataagctaaatactttgatatctatattagaacaaagaggtggaataaatctttttgataaaaatgtaataataaaaactactgggggcataaaaattcgagaacaggggataaatttagctgttataatgagtattgtttcatcagtaaaacaacaaggaattgaatccaatatagcttttattgcagatgtagggttaactggagagttgaaaaaagtaccatcgttagaaagcagaataaaagagttggctagaatgggatttagaagagtttatgttcctaaagattcatttatcaaaaagcctaatattgaaggtattgatatcgttcagcttaaaacattagcaaatgttataaatcatgtatatgcgtaattaaatataacataggaaatgattgtatatttagaattattctgataaagtataaatgaatattattaacgaagctttaaataattagaattattattgagagtacaaatttaatatagtattatagaatttagagtttaactgttactacatattaaaaaatggacttattatatatccataaattatatttttataaattttgaaatattttattatgaaaaggggtgagtgtatgagattagaaaaaggaacaagtattaaagatgtattaaaaataatatgtcctggcactcagctaagagaaggaatagaaaatatattaagagctaaaacaggtggacttatagtagttggtgatgacgaagagataatggaacttgtagacggcggcttttatattaattcagaatatactccttcatatgtctatgaattagcgaaaatggatggagctatagtaataactggggatttaaagaaaattgtttgcgcaaatgctcagttgattccagactcatcaataccaacttatgaaacaggaacaagacatagaacagcacatagagtagcaaaacagactaataatattgttattgcaatatctcaaagaagaaatataataactatgtacaaaggtgatataaaatatgtacttagagaaagtagtgttattttaagtaaagcaaatcaagctatacaaacactagaaaaatacgtagctgttttagaacgtgtaataaataatttgaatttacttgaatttcaggatttaaccacattatttgatgtagttagtgccattcaaaggactgagatggtaatgagaattgttgaagaaataaatatgtatattttagaacttggaaatgaaggaagattaatttctatgcagcttaatgaacttgttaggcacatagaaagagatggtatattgttaatacaagattattgtgctgaaggatttgaacacaatgatgtttatgaacatattcaaagacttaattcttctgaacttcctgatttagatgccatagcaaaaactttagggtatggaggaatacctcttatggatactttaatatcgcctaaaggatatagaattttaagtaaagttccaaggataccttcaaatgttatagaaaaccttattaaggaattcgaagatttaagtagtataattgaggctgatatagatgacttagataaagtagaaggtattggtgaagcaagagctacagcaataaaaaatggtttaaagcgtataaaggaacaggttttattaaaaaaagaattataattatgtatatttaatcagaaaagtaaaatggataaattaatctcattttacttttctgaatttttttatactttaaattagcgtaggttgtatttgcctaaagtaactgatttattatattccttaagaagtatatcatatagattaatatctaaatgattgcataatgcagtaagataaaataaattattgccaatttctctttctattatttcacgacagttatcacaaaggttaccattgagatgagaagttagatagttattcaagtctacttcagaatcagaaggctcttgtggaatatgttgtttctgagcagaaatatttatgcaaccacattgagttacagctttagcaacagacctatttactttggaagtagattcactatatttagtgagtatatctaaaatacttttatgacgtattaatgaatcattcacacaattttgaaaatcatcaaatattatatctttcatatttttcagctccttaactaaattaaaatagagaaagacaatataagtaaaattaaatatcggcaataatttgatttgaaatatgtaaatataatacaaaaaaaataatgaaattaatagggggactaataaattaaacttaataatttattcattttagataaagatattgtatgttataattaacaatatagtgtaatttttaaaaaagggattaaaacaatgaaaatgtgtaaataatttagaaggaggtgaaatagatgttaaagaagctaacaaaaggagtattttccgcaataggattaagtattggttatattatagcggaaactttacttgaaataccacaaattgctgagttgtcatatttttcaaaaagtgtttcacgaatcagctttataattattctttctattatatttggacttatattatatattatttctcctgcaatatataagggtatttctaacttgattgaatacattgaaaaaagtatgcaaaaaatgagtataacagaaataatctatggaactgtaggtgctgttatggctctaattattatgacatttattgctaagccaataaatgatattcataaattttatggacctatacttttagttttattaaatttattagctgcttttattggagctgaaattttagtgaaaaagaatgaagatattacttcattactagtaaatataaaaaggccaatcaataaagaaaaaaaagttaaggatggatctaaagaagtagcaaaagaagaaaaaggtgaaattcctaaaatcttagatacatctgtaataattgatggaagaatttttgacatttgtgaaacaggatttattgaagggccattaattatacctaactttgtattagtagaattaagacacgtatcagattctgctgattcactaaaaagaaatagggggagaagaggtctagatatacttaataagattcaaaaggaattaacaattgaaactagaatagtagacgatgatttccctaaaatacctgaagtagacataaagcttttgaagcttgcacaaaaaatgaatggtaaagtaataactaacgactataatttaaataaagttgctgaatttcaaggcgttccagtattaaatattaatgaattatcgaatgctataaaaccagtagttttaccaggagaagaaatggtagttgatatagttaaagatggtaaggaatcaagtcagggtgtagcatatttagatgatggtacaatgattgttgttgaaggtggaagaaaacacataggtaaaacaacagatgtgctagttacatctgttttacaaacagcagcaggaagaatgatctttgctaaacctaaagaaaattaaattaaaaacaaaggagacttttctaaatggttagtgcaatagtattagctggaggaagaggtaagagaatgggctctgttcaaagcaagcaatacatagatttgaatggaaagcccattctttattacactctgaatcattttataaataataagaatatagataaagttatattagtaattcctgaagatgaattagaattttgtaggaacgaagttttagataaatataacttaaaaatagattcaattgcttttggtgggaaagaaagacaagactcagtgtataatggtttgaagaaagctgatggatcagatatagttcttattcatgatggtgcaagaccttttgtatctgaaagaattatagaagaaggaattaaatatgcacgtatgtatggtgcagcagctccaggtgtaatgcctaaggatactataaaagtaaaaaatcaagaaagtttttctttagaaactccagatagaaacaatcttgtggctgttcagacaccacaggtttttgattataatattatatttgggtgccataaaaaagttaaagaaaaacatctggatgttacggatgatacaatggttgttgaactttttggaaatgatgtttatctatatgaaggtgaatatactaatattaaaataacaactccagaagatttaatattggcacaatatttggtcgaatcttaatatattgacagttaatttttaaaaagttataataaactaaaataaaatgaaattttagagcaatgatggagaatagtagaagtcgccctttaagagaaaaagtccttaggctgtaagacttttaatagactttgaaccagcttcggagcagtaggaaaaaactatcggtttaataccgttatcattatttagagaacaaatttaggtggtaccgcgagttgattcgccctaatatatattattagggcgaatttttttattgttcaaaatgtataaatacttatattttaagtgttttttgataactataatttatatgtaatatggacatttttaaatattacttttgagcaaattacacataagatatttttagtgattaaaatcgtaaaacatttaatcattgttataaataaaaacataaagttagtaggaggaattttaatatgaaaatgtcaaatatgttaatctctacattaagagaagtaccagcagaagctgaaattgatagccataagcttatgttaagagcaggaatgataagaaagatggctgcgggaatatacaattatatgccattaggattaaaagtgcttaaaaatgtagaagatattgtaagagaagaaatgaatgcagcaggagcgcaagaatttcttgcatcagctatgataccagctgaattatggcaggaatcaggaagatgggatgcttatggagcagaaatgtttagagttaaagatagaggcgcaagagatttctgtttaggacctactcacgaagaagtatttacagatatcgcaagaaatgaaattaagtcatataaacaacttccacttaatttatatcaaattcaaactaagtacagagatgaacgtagaccaagatttggagttatgagatctagagaatttataatgaaagatgcttatagttttgataaagatcaagatggattagacatagtatttaataaaatgcatgatgcatatgttaaaatatttaatagatgtggattagatgctaaatgtgttgaagctgattcaggtgcaataggtggatctaactctgctgaattcatggttaaatcagaagttggagaagatgatgtagtattctgtagtaagtgtaattatgctgctaatatagaaaaagcagtatcaaatccagaaaaagaagaaaagacagaattaaaggaactaaacaaagttgaaacaccaaattcaagaacaatagatgaagttgctgctttctttaaggctgattcaaagaagtttgctaaaactattttatttaatgcagatggaaagatagttgcagtaatggttagaggagatagagaaattaacgaggttaaggttgcaaatgccataggtgaagttacaaactttgatttagcaagtaacgaagaagttcaaaatgctacaggtgcagctgtaggatttgcaggaccaattggaataaaagtggatatactgttagtagatgaagaagttgctaatatgtataattttatagctggtgctaatgaaacaggatatcatgttgaaaatgtaaactatggaagagattttgaaggaactgttggagatttcagaaatgtaactgaaggtgaaaaatgcccatgttgtggagctccaattaatattgcaagaggtacagaagtaggtcatatatttaagcttggaacgaagtattcagatgccatgaatgcaaatttcatagatgaagatggtaaggaaaaaccatttgtaatgggatgttatgggattggagttacaagaactatggcttcaataatcgaacaacatcatgatgaaaatggaataatatggccattatcagttgcgccatatcatatttcagtaattcctgtaaatgttaaagatgaagaacaggtaaaaattgcaactgaattatatgaccaattagtttctatgggagtcgaagtgcttttagatgatagaaatgaaagagctggagttaagtttaaagattcagaacttatgggaataccaatgagagtaactgttggtaaaaaaattactgatggagaagttgaatttaagcttagagatggagatatggaagtaattaaaataagtgatgtttgcaatatagtaaaaggtgaatttgaaaaaaataatatgaaattaagataagtattaggaggtaattcgatgagactatataatagtttaacaagacaaaaagaagaatttgttcctattgttccaggtgaagttaagatgtatgtatgtggaccaactgtatataactattttcatattggtaatggaagaacatttataatattcgatacaataagaagatatttagaatatagaggatacaaggttacatttattcaaaattttacagacatagatgataaaatgattaataaagcaaatgcagaaggtataacagtaaaggaacttggtgataaattcatagatgaatattatcaagatgctgatggacttcaagtaaaaagggctactattaatcctagagcaactgagtatatcgatgaagttgtagaatttgttaaggatttaatagatagaggttttgcttatgaaattgatggcgatgtttactttagtactaagaagtttgaagagtatggaaaactttgtggtcagaatttagaagatttacaatcaggtgcaagaataagtgttgatgaaagaaagaaagatccaatggattttgcagtgtggaaatcacaaaagccaggtgaaccagcatgggaaagtccttggggactaggaagaccaggatggcatattgaatgttcatgtatggcaaagaaattattaggagacactattgatatccatggtggtggaatggatttaaaattcccacatcatgaaaatgaaattgctcaaagtgaagctgtaacagggcaaaaattcgctaattattggatgcatgcagcatttgttaatgtggataataagaagatgtctaaatctgaaaataattttgtcactgcaagagaagcattaaagaaatataattcagatgtaataagatttttaatgttatcaggacattatagaactcaaataaattttagtgcagaacttttagattcagctaaatcttcggttgaaagattatacaattgcgtaaataatcttgaaaatttaatcaatgaagtcaatagaaaagaagctaatgattcagaaaaagcttacttaaaatctttagacaaacacagagaaaagttcattgagaagatggatgatgattttaatactgctgatggtatttcagtaatatttgacttgataaaagatataaacaataatgtaagtatagattcatcatctgaattgtgtgaaggtgctttaaatttaataagagaattaggaagccctcttggaattcttcaaaaaactgaagagaaatctctagaagtggaaatccaagaattaatcgacaaaagacaagaagctagaaaaaacagagattttgcattggcggataaaataagagatgatttaaaagccagaaatataattttagaagatacaccacaaggtgttagatggaaaaagattgattaattaaaataagggttgcatgatttgcaacccttatttaaaggagaatttattaatgttagatgattttagaataagagaatttacagagatggaagcgaggatgcttaatccacttcaattggctttaattggtgatggagtatatgaaatttttattagaaactatatactagctaataatacagctttatcagcaaataaaattcatgttaaggcaatacagtatgtcaaggcaaaaagtcaggcgtctataatgcataaaatagaaggatttttagaagaagatgaagaagctgtttataaaagaggacgtaatgcaaagtcggcaactgttcctaagaatgcagatgtaagagattatagaatggcaacagggtttgaagctttagtagggtatttgtatttatcgggaaaaaaggatagactggaatttatatttaataagagcatagagatgatggaataaattcaaaagataagtaagggaggtcttgaaatgcagaataaaccaaaaaagactagtaatttaactgttaaaaaagatagaaaaaatgaacctttgaaaaaaaataaaagtataacatgtcaggaagaaagagaagatattgttataggaagaaatgctgttatggaggctttgaagggtgatagaactatagaagctatatatgtatctaacaataagcttgaaggttccataaatgctattatgggaatggcaaaagagcagaaaatacttataaaagaagttgataagagaaagcttgatagtatgtgtgatggtgaaacgcatcaaggtgtaatagctaaagttactccgtttaaatatagtgaagtgtcagatatatttgaactagcagaacaaaaaggagaagcaccatttattgttatattagatgaggttgaagaccctcataatcttggatcaatagctagaactgcagaattgtttggtgtacatggtattataattccaaagaggagaagtgcatctgttactgcaaccgtatataaatcatctgttggagcaatagaacatgttaaagtagcaaaagtgaataatataaattcaacaatagaggaacttaaagaaaaaggagtctggatttatggagctgatataagagcagaagaatatagtcatgaagtagattatagtggtccttgtgctcttgtaataggaaatgaaggaagaggtatgtcaaagcttactgttcaaaagtgtgataagcttataaaaatacctatggtaggaaaaataaattctttaaatgcatcagttgcaggtggaataatgatgtatgaagtattaaaaggtcgctttaaataagaggtatactatgaaaaatattttcgtagatggatacaatgtaataaatagctggccagacttaaaagaaaagaaagatgttagttttgaaggtgcaagacagagtcttattgataagttacataattatggagtgtttaaggcttgcagaattatattagtttttgatgcacataaagttcaaggaagtatagaaaagaaggaagaaattaataaaaatatatgtgttgtatttaccaaagatggagaaactgctgatgcttatatagagagacatgtaaatgaaatagggagaaaacatgaggtagtggttgtaacctcggataatttggagcaacaaacagttttccaaagaggagcagtcagaatgtcatctattgaattttataatgagattctaaaggtagaaaagagtataaacataaaaacaagtaaaattaaagttaatcagaaaaatagtgtagctgataatataaatgaagatatagttaaaaagttagaggaaatgcgcagaggtaagtagaactggttgacgaaagcgatttttctagagtataattgtttaaaaggtatagcagtttaattttagaagagagttgagagattatagttggaaggatttttagaatttaaagacaaactagatgaagagattgttatggatgctaaagctggaaataacaaagcacaagagtatttaatttccaaatatgaaaattttgtaaaagctaaagctaaatcatattttcttataggcgctgataaagaggatatttatcaagagggtatgattggattatataaggctatacgtgatttcaatcctgaaaaatctacatcttttaaagcttttgcagaaatatgtgtaactagacagattattacagccattaaaactgctactagacaaaagcacatacctttaaatacttatgtatcactaaataaaccgatatatgaagaagaatcagaaagaactcttttggatgtgttatctggattaaaaatatctgatcctgaagagttgatgattagtaaagaacaaatgcattttatagaggataaaatttcgaaagtcttgtctgagcttgaaaaagaggtgttaacatcttatctggatggtaaatcgtaccaagaaattgcgtgcgatttagaaaggcatgcgaaatctatagataatgcacttcaaagagtgaaaagaaaattagaaaaatgcttgaaagtaaagtgataatttatattgacaaacaaaaaaattaatagtaaactttataattggtatatcaaggaacgatatgatttcgaaacgctcacatagctcagttggcagagcgtcaccttggtaaggtggaggtcgtcggttcaatcccgattgtgagctccaaaataaaaaaataaaaaacgctaggcaaagtttattacaagattaaaggaggaattttcaatggcaaaagagaaatttgaaagaagtaagccacatgttaacattggtacaataggtcacgtagaccacggtaagacaacattaacagctgcaatcacaactgtattagcaaataaaggattcgcagacgcgttcaactacgcagatatcgataaggctccagaagaaaaagaaagaggaatcacaatcaatactgctcacgttgaatacgaaacagaaacaagacattacgctcacgttgactgtccaggacatgctgactacgttaagaacatgatcactggagctgcacaaatggatggagctatcttagttgtatctgctgcagacggtccaatgcctcaaacaagagaacatatcctattaggatcaagagttggtatagaatacatagtagtattcttaaacaaagctgatatggtagatgatccagaattattagaattagttgaaatggaagttagagaattattaagtgaatatgacttcccaggagatgatattccagtaataacaggatcagcattaaaagcattagaaaacccaacagatgatgcagcaaacaaatgtatcatggaattaatggaagcagtagatagctacattccaacaccagaaagagctacagataagccattcttaatgccagtagaagatgtattcacaatcactggtagaggaacagttgcaacaggtagagttgaaactggagtacttcacgtaggagacgaagttgaaatcgttggattaagtgaagaaaagaagaagactgtatgtacaggaatcgaaatgttcagaaagttattagatgaagcacaagctggagataacatcggagcattattaagaggggtacaaagaactgatatcgaaagaggtcaagttttagcagtaccaaactcagtacacccacacactaagttcgtaggtcaagtatacgtacttaaaaaagaagaaggtggaagacatactccattctttgatggatatagaccacaattctacttcagaacaacagacgttacaggatcaatcaaattaccagatggtatggaaatggttatgcctggagaccacatcgacatgaacgttgaattaatcactccaatcgctatggatgaaggattaagattcgcgatcagagaaggtggaagaactgtaggttcaggagttgttactagtatagttgaatagtagatagttaatatgtttatatggactaagtttttggacttagtcctatttaaaggaagattgacaatttacatattctatgctattgtttaaaagtgacatttttaaggcaataaatttgaatgaaacaaaagaaaaactcttttgtttaatatatataaaactggaggtgcagtcatgagaacaaaagtaactttagcatgcacagagtgtaaacaaagaaattatgattcaatgaagaacaagaaaaatgatccagatagattagaaatgaaaaagtattgtaaattctgtaaaaagcacactcttcatagagaaactaaataattagccgcatagcaatgacatatgtcaatttgatttaaggatgtgaaaatatgtcagcaaaaaatgaaacaaaaactgaaaaagctgttaagaaaaatggcttgtttggtttttttagagaggttaaggcggaagttaagagaataacttggccttctaaagatgagacaaaaaaagcatttgttgcagttgttatattcgcactaatatatattgtattagttagtggattggattttattttcagcaacctctttgaaatgattttaaaattgaagtaaaagggaggtttggtgatttgttataatcacctaacaagtatgagtgatagagcaagatggtatgtagtacatacatactctggatacgaaaataaggttaaagcaaacttagaaaaagcaattgaaaatagaaatcttgaatcattaatccaagacatacaagtgcctatggaagaagtgattgaagaaaaagatggaaaacaaaaagtctcattgaagaaaaagtttcctggatatgtacttgttaaaatgttaatgagtgatgaatcatggtacgttgtaagaaatacaagaggcgtaacaggtttcgttggaccaggatctaaaccagttccactatctgatgaagaagtagaatcaatgggtgttttagaaatgccagttgatattgatttagaagtaggggaaagtattaaaattatttcaggtccacttagagattcagtggcaacaattcaagagatagttttagaaaaacgtaaaattaaggctttagtagatatgttcggaagagaaactcttgctgaactagactttaatcaagtagaaaaattagtttaatatacaactgattttaattaagtgggagaacaaaaagttcgtatttaccacagtaataggaggaataacaaaatggctaagaaagtaactggaatgattaaacttcaacttcaagcaggtaaggcaacaccagctccacctgtaggtccagctttaggtcaacacggtgtaaacataatgggattctgtaaggagtttaatgctaaaactgctaatcaagctggattaataataccagtagttataacagtttaccaagacagatcatttagttttatattaaagactcctccagctgcagttttaattaaaaaagaattaggattagacagcggttcaggagtaccaaatagaacaaaggttggaaacttaactcaagaccaacttagaaaaattgcagaaacaaaaatgccagatttaaatgctgcaaacattgaatcagcaatgagaatgattgctggaacagctagaagtatgggagttacagttgaagaataatatcaactaactcaatttcgtaaaaataagtgggaggtcaaaaccgttactaccacagaggaggcaaattatgggaaaaaaatatgttgaaagcgcaaagcttatcgataaaagtgcattatacaatccaaatgaagcattagaacttacattaaagactgcaaaggctaactttgatgaaactattgaattacatgtaagacttggtgtagatccaagacatgctgaccaacaagtaagaggagctgttgttttaccaaacggaactggtagaacagttagagttcttgtatttgctaagggagctaaagctgatgaagctacagctgcaggagcagatttcgtaggagctgaagaattagttacaaagatccaaagcgaaaactggtttgactacgatgtagttgttgcaactccagatatgatgggtgttgtaggtagaataggtagagtattaggacctaagggattaatgccaaacccaaaatcaggaacagtaactttcgacgttgctaaggcaattgaagaaatcaaagctggtaaagtagaatatagagttgataaaactgctatcgttcactgtccaatcggaaagaaatctttcggaactgaaaaattaaaggaaaactttacagcattaatggaagctttagttaaagctaaaccagcagctgctaagggacaatacttaaagtcagtttctgtttcaagcacaatgggaccaggagcaaaaattaatccaacaagagcgttagattagtattgacataaatataatattgtaatataatatttgatgttgtgaaaattgaaaaatagttttttccgtagacagtgggtgcgaaagcataaaaggtaactacccgccgagggatatataatagatgatattatagatctccctatgtctacggggagatcttttttgataaatatgatttaaaactatgaggaggtggaccgtagtaatgaacaataacagatcacttaaagaagcaaaggttgctgaaattaaggaaaaattagaaaaagctaattcagttgttcttagccaataccaaggtttaacagttgaagaagatacagttctaagaaagaacttaagagaagctggtgttgaatacaaagtatacaaaaatactttagttatattagctgctaaagaattaggtttagaaggtattgttgaatacttagaaggaccagtagctatcgctttcggatacgaagacgtaactgtagctgcaagagtacttaatgattttgcaaaagatcataagaaattagaattaaaagctggtatcgtagaaggagaaatctacgacactgacaagatcaaacaacttgctactattccatcaaaagaagttcttattgcaaaacttcttggaagtatcaagtcaccaatctcaagctttgcacgtgtaattaatgcaatagctgaaagtaaagcagaataatattaaagattaaataattttagaaaaattttcggaggtgctattaaaatgacaagagaagatataattcaagcaataaaagaaatgagcgttttagacttaaacgaattagtaaaggcttgtgaagaagaatttggagtaagcgctgctgctgctgttgtagctggtggagctgtagctggtggagctgctggtgaagaaaagactgaattcgacgtagtattagctaacgctggagataacaagatcaaagttatcaaagctgtaagagaaataacaggattaggattaaaagaagctaaagaaatagttgatggagctcctaagacattaaaagaaggcgtttctaaagaagaagctgaagacatgaaagctaaattagctgaagttggagctactgtagaagttaaatagtctacttaactaaaggtgctttatataaagcaccttttttaaactctttttataaagctatataaaatgcttgtttaaaaaataggtattttatatagctttataactaataaaagagtaaaaaaataattgacaataaaattgtaatatgatattataatataatgtattattcactatggaatagtatatattcatggtggaaagatgtagtataatctggcgaataatggttatactataataaagatgctgtccgaaagctaaagtccttagggaaagtacgcttttggctattttagtttattttatacaaggggtgaaaattcatggtacatcctgtccaagttggaaaaagaacaagaatgagtttcggtaaggttaatgacgttactgaaatgccaaatctaattgaagtacaattagattcttatcaatggtttttaagagaagggttgcatgaagtttttgatgatattaatcctatcacaaacttcactggaaacttagtgcttgaattcgtagactataaacttgatatggaaaacatcaagtattcagtggaagaatgtaaagatagagatgcaacttatgcagcaccattaaaagtttcggtaagattacaaaataatgaaacaggtgaaattaaagaacaagaagtttttatgggagatttcccgctgatgacagaacaaggtacatttttaattaatggtgccgaaagagttattgtcagccaattagtaagatctccaggtgtatactacagctacactatagataagagtggtaaaaagctgtattcttcaactgtaattcctaatagaggagcatggttggagtatgaaacagattctaatgatattatttatgtaagaatcgataagactagaaagctaccaattactattttagcaagagctatgggtatgggaagtgatcaagaattaatagatttctttggagaagaagaaagatttagagcttctatagaaaaagataatacaaagacaaaagaagaagcattacttgaaatatataagagattaagaccaggtgaaccgcctacagttgatagtgcgatatcactaatagatactttattcttcgatgcaaaaagatatgatttatcaagagtaggaagatataagttcaataaaaagcttgcattagctttaagaatagctaatcaagtggctgctacagacataatcaaccctcaaactggtgaagttatggttgaagaaggtcaaaagataagcagattaatggcagaagacatccaaaatagtggtataaaatctgtagatttattagttgaagataaagttataaaagtaattagtaataactttgttgatttaagcaagcaagtttctttcgatgtgaagggattaggaattaaagaattagttcactatccaacattaaaagaaatcttagataacttctcagatgaagacactattaaaaaggaaattaagaaaaatattcatagacttattcctaaacatataataagagatgatatatttgcaactattagttatgaattaggattagcgtatggaataggttacgttgatgacatagatcatttaggaaatagaagattaagatcagtaggggaattattacaaaatcaatttagaattggtttatcaagaatggaaagagtagttaaagaaagaatgactattcaagaccaagaagcgataactcctcaaatgttaataaacataagaccagttgcagctgctattaaagaattctttggaagttcgcaattatctcaattcatggatcaaactaatccattatcagaattaacacataagagaagattatctgcattaggaccaggaggtctttctagagaaagagctggtttcgaagttagagacgttcaccattctcattatggtagaatgtgtcctattgaaacacctgaaggtccaaatataggattaatcaactctttagctacatttgctaaagttaatgaatatggatttattgaaactccatatagaattgtagataaagaaaatgcaagagcaactgatgaaataagatatttcacagcagatgaagaagaccaatacttaattgctcaagctaagactcctatggatgaaacaggaaagttcttagaagacaaagtaatggtaagatacttggaagatgttttatttattccatctaatcaagtagatttaatagacgtatcagcaagacaaatggtttctgttgcaactgcaatgattcctttccttgaaaatgatgatgccactagagcactgatgggatcaaacatgcaacgtcaagcagttccattattaaaaactgaagctccagttgttggaactggtatagaatttaaggctgcggtagactcaggagttttaccaaaagctaaaaatgcaggtgttgtttcttatgtatcaggaagcgaaattagaattaagagagattctgatggaggaactgatgtatataaattattaaagttcaaaagaacaaatgcaggtacttgtgcaaatcaaagacctatagttgataaaggtgaaattgtatttaaaaatcaagtaattgcagatggtccttctactgatttaggagaaattgctttaggtaaaaacatcagaatgggattcataacttgggaaggttataactacgaagatgcgatgcttatttctgaagaattagttagagaagatgtgtttacatcaatgcatattgaagaatatgaatgtgaagctagagatactaagcttggaccagaagaaataactagagatattcctaatgtaagtgatgatgcacttaaggatgttgatgatagaggtattatcagaattggtgctgaagttagatctggcgatatattagtaggtaaggtgactcctaagggagaaacagaacttactgctgaagaaagactattaagagcaatctttggtgagaaggctagagaagttagagatacttctttaagagtacctcacggtgaagcaggtataatagttgatattaaagtctttacaagagaaaatggagatgaattaaatccaggagtaaatgaacttgtaagatgttatattgctcaaaagagaaaaatatcagttggagataagatggctggacgtcatggtaataaaggggttatctcaagaatattacctgaagaagatatgccgttcttaccagatggtagaccacttcaaatctgcttaaatccactgggagtaccttcgcgtatgaacattggtcaggttttagaagttcacttaggatgggctgcaagtaatttaggatggcatatatctacaccagtattcgatggtgcaactcaagatgaaataactgaatgcatgattaaagctggatttaatgctaatgctaaaacaattttatatgatggtagaacaggtgaaccatttgataatgaagtaactgttggtatcatgtatatgttaaaacttcaccatttagttgatgataagattcatgctagatcaactggaccatattcattagttacacaacagccattaggtggtaaggctcaatttggtggccaaagattcggggaaatggaagtttgggctttagaagcatatggtgctgctcatacattacaagaaatattaactgttaaatcagatgatgttgttggtagagttaaaacatatgaagctattgttaagggcgaaaatattccagaaccaggtgtaccagaatcatttaaggttcttataaaagaacttcaagctttatgtttagacattaaggtattaaatgatgataatgaagaagttgaattaaaagaatttgctgatggagacgtggcagatttagaagttaatatagaaggtgcagaagattctgtagttgctgaaccagaaatcgtagatgatggttatgaagaaaataaagaagaagatttagacgatatagattatgacgaaaatgcagatatcgacgagtttgaaggtcaattagaacttgatgactttaatgatgaacactaattttgaagggaggacttacccttgtttgaattaaataattttgatgcaatacaaatcggtttagcatctccagatcaaataagagcttggtcaagaggagaagttaagaaaccagaaacaattaactacagaacattaaagccagaaagagatggtttattctgtgaaagaatttttggacctatgaaggactgggaatgtcactgtggaaaatataagagagtaagatacaaaggtatagtttgtgacagatgtggtgttgaagttacaaaagctaaagtaagaagagaaagaatggggcacattgaactggctgccccagtatctcacatttggtacttcaaggggattccatcaagaatggggttaattcttgatatgtcaccaagagctttagaaaaagttttatattttgcatcttatatagtgacagatcctaaggaaacacctttattaaagaaacaacttcttaacgaaaaagaatatagagaagcttgtgataaatatggtgaagatagctttgttgctagtatgggtgctgaagcaattcaagaacttttagcagaaatagatttagaagcaggttcaaaggaacttaaagaagaattaaaacaaagtacaggtcaaaagaaagttagaattataagaagactggaagttgttgaatcatttagaaaatcaggaaataatcctgaatggatggtaattaacgtaattccagttattccaccagatttaagaccaatggttcaattagatggtggtagatttgctacatctgacttgaatgatttatatagaagagttattaatagaaataacagattaaaaaaattattagatttaggtgctccagatatcattgtaagaaatgaaaagagaatgcttcaagaagcagttgatgcacttattgataatggtagaagaggtagaccggtaactggaccaggaaatagacctttaaaatctctttcggatatgttaaaaggtaagcaaggtagatttagacaaaacttacttggtaagagagttgactactctggtagatcagttatagttgttggtccagaattaaaaatgtatcaatgtggtcttccaaaagaaatggcgattgagttatttaaaccatttgttatgaagaagcttgtacaagatggaattgcacacaatattaagagtgcaaagagaatggtagaaagagttcaaccacaagtttgggatgtgttagaagaagttattgctgatcatccagttttacttaaccgtgctccgactctacatagacttggaattcaagcattccaaccaatacttgttgaaggtagagcaattaagttacatccattagcatgtacagcgtacaacgctgacttcgatggagaccaaatggctgtccatcttccactttcagtagaagcacaagcagaagcaagatttttaatgcttgcagctacaaatatattaaaaccttcagatggtaaaccagtttgtgtacctacacaggatatggttcttggttcttattacttaactatggataaggatggagctaagggtgaaggaatgacattctcaagtaaagatgaagctataatggcatacgaaagtaaagctattgcagttcatgctaaaattaatgttagaatgtttagagaaattgatggagttgttagacataaagttattaagactactgttggtaagcttatatttaatgaatcagttcctcaaaacttaggatttgtagatagaaaaaatgaagatgaaatgtttaacttagaaatagatttcttagttactaaaaaatctttaggaaaaattatagataactgttacttagaacatggtcctgtaaagacttctataatgcttgataatataaaagcattaggatatcattattcatctataggagctgtaacagtagcaacatctgatatcaaagtaccacctgaaaaatttgagttacttaaagaagcagatgaaactattgaaaagatcgaaaagatgtataagagaggtttcatatcagatgatgaaagatatgagagagttatagaaaaatggactaagacaacagaagaagttgccgatgcattaatggatagtatggataagtttaatccaatattcatgatggctgactctggagccagaggttctaagtcacagatcaagcagcttgctggtatgagaggacttatggcaagtccatctggtaagattatcgaattaccaatcagagcatcgttcaaagaaggtctagatgtactagaatatttctcatctacacatggtgctagaaaaggtaatgccgatacagccttaaagactgccgattcaggatacctaacaagaagacttgttgacgtttcacaagatgttatcgtaagagaagaagattgtggaactgatgatggattatatgtaagtgaaattaaagaaggcaacgaagttgttgaagaattaaaagaaagattaattggtagatatactgctgaagatataattaatcctgaaaatggtgagattattgttgcaaacaatcaatatatggatccatatattgcagaaagagttgtagcagcaggtatcaaaaaagttaagattaaatcagtatttacatgtaactgtaaagtaggtgtatgttcacactgttatggtatgaatatggctactgctaagaaaatcgatattggtgaagctgttggtatcatagcagcgcaatcaatcggtgaaccaggaacacagcttacaatgagaacattccatacaggtggtgttgccactggtgcagatatcactcaaggtttacctagagttgaagaattattcgaagctagaaaaccaaagggtcttgcaatagtaagtgaagtgactggtacagttaaaatggaagaaactaagaaaaagagaacagttgttgtaatgactgctgacggtgaagaacgtagctacgatattccattcggttcaagattaaaagtaactgatggagataatatagaagctggagatgaaatcacagaaggttctgttaatccacatgatatcatgagtattaagggaattgatggagcaagaagatacttactttcagaagttcaaaaagtttacagacttcaaggggttgatatcaacgataagcatctagaagttgttgttagacaaatgactagaaagattaaggtaactgattctggagatactgatttattaccaggtacaatgatagatatgtttgactttagagaagaaaatgctagagttagagaatttggaggagaagaagctaagggtgaagaaacattattaggtattactaaggcagccttagcaactgatagtttcttatcagcagcatctttccaagaaactactagagtattaactgaagcagcaattaaaggaaaagttgatccattagttgggttaaaagaaaatgtaattattggtaagcttattccagcaggtactggtatgatgagatatagagatcttaaagtagataatgttgaagaagtagtagaagaagctataactgaaactgtagaataatagaatttaattgtgttgacatgtgtatatataaatgataaaatacattttgtgtgatttaagatatcaaattacataaattaatgtcaacacgattgtttttgtgtaaaaatggatataatatattataacttgagttgagttttagtatttatatataaatagtctggttgaacattaaattttaatgtactaccataaaatagttttatcttaattaaaaaatagataaataaatttcaggaggtgaaaaaatgccaactattagccaattagtaagaaaaggcagaaaaacaactgtagttaaatcaactgcaccagcacttaaagagtgtccacaaaaaagaggagtatgtacagtagttaagacaacaactcctaagaaacctaactcagcgttaagaaaaattgccagagttagattaactaatggatatgaagtaactgcatatattggtggagtaggtcacaacttacaagaacatagtgttgttcttataagaggtggaagagttaaggaccttcctggtgttagataccatatcgttagaggtgcattagactgcgctggagtagctaacagaatgcaaggaagatcaaagtacggtgctaagaaacctaaagctaaataatagtctataggatcttaactattaatagtgctcatcttcaacggaaattatagatttgaaatgaagtttatatatagatgtaaagatagcactttgcggtatagtaaataataccgagtaccgatgaacttaaattcaaaatgttaaggagggaagaaaagtgccaagaaaaggacatattgcaaaaagagatgtattaccagatccagtttataattcaaaagtagtaactaagtttataaacagcataatggaagatggtaagaagggtgttgcccaaaaaatatgctacgatgcatttgaaattatagctcaaaagagtggaaaagaagctttagaagtatttgaagaagctatgaataacgtaatgccattactagaagttaaagctagaagaataggtggtgctacttatcaagttccaatagaagttagacctgaaagaagacagacattaggaataagatggatgttaataggagctagaaaaagaggcgaaaagttaatgtgtgaaagagtggctggtgaattactagacgcatctaacaacacaggagcagctgttaagaaaagagaagatactcataagatggcagaagctaataaggcattcgctcattacagatactaatatctacaacaaaactgttttggcttcatgctaaggcagttttgtcaaattataaaataattatttactcactgagaggaggaagaatataatggctagaaaatatcctttagataagttccgtaacttcggaataatggctcatatagatgcaggtaaaacaacaactacagaacgtatattattctacacaggagttaaccataaaataggtgaaactcatgatggagaatcaactatggactggatggttcaggaacaagaaagaggtataacaattacttctgctgctacttcatgtgaatggaagggtcatgaattaaacatcattgatactccaggacacgtagactttacagtagaagttgaaagatctttaagagtacttgatggtgctgttacggttcttgatgctaagagtggggttgaaccacaaacagaaactgtttggagacaggcggataaatacggagttccaagaatgatttacgtaaataagatggatgctacaggtgcaaacttcttaagatgtatacaaacagttaaagatagattaaaggctaatgctgttccaatacaacttccaataggtgcagaagataacttcaaaggtatggttgaccttataaagaacgttgctttcgtattctatgatgatcttggaaaagacatgagagaagaagcaattccagatgatttagtagatcaagctgaagaatatagagcagcaatgatagaatctattgctgaaactgatgaaactttaatggaaaaataccttgaaggtgaagaattaacagttgaagagttaaaaatagctttaagaaaagctactatagctaatgaaattgttccatgtatttgtggatcttcatacaaaaacaaaggtgttcaagaaatgatcgacggagttgttgatttcttaccatctccattagatattcctgctgtaacaggaacaactttagaaggggaagaagacaagagagaagctgatgataaagaaccattatcagcattagcattcaagattgctactgacccattcgtaggtaagttggcttatacaagaatttactcaggtgtaatgaatagtggttcttacgttcttaattcaactaagggtaagaaagaaagaataggaagactagttaagatgcattctaattcaagatcagaagttgaaacacttgaagctggtgaattaggagcaattatcggattaaagaatactacaactggtgatactttatgttcagaagataagccaattgttcttgaatcaatggaattcccagaaccagttattgatatagctattgaaccagcatcaaaagctgctcaagaaaagatgggattagcgttagctaaattagctgaagaagatcctacattcaaaacttggactgatgaagaaactggtcaaacaataatcgctggtatgggtgaacttcacttagatatcatcgttgatagacttaagagagaattcaagattgaatgtaatgttggagctcctcaagtttcttacaaagaaacaataagaaaaggagttaaagctgaagctaaatacgctaaacaatcaggtggtaaaggacaatacggtcatgctgtaattgaaatggaaccaactgaaggtgaatatgtatttgaaaatgcaatcgttgggggagctattcctaaagaatacataccagctatcgatgcagggattcaagaagcttctaaaaatggtataatagctggatacaatgttattaacttcaaagttaagttagtacacggttcataccatgaagtcgattcatctgaaatggcattcaaaattgctggatctatggcatttaagaatgcaatggctaaagcagaaccagtattacttgaaccaatgatgaaagttgaaataacagttcctgaagaatatatgggagatgttattggagactgtagttcaagaagaggtagaattgaaggaatggaagatgttaatggtgctaaggttgttagagcattcgttccattatcagaaatgtttggatatgctacttcattaagatctagaactcaaggtagaggagtttactcaatggtattcgatcactacgaagaagttcctaagaatattcaagaagaaatcgctggtaaaaaagttaaatagttttaactggttgatttttaaattagtatataatgaaatagtgatattttaataaaaaatatcactatatcatcattattataaataaatatttaatttttaaattaaatataaaaaaatgaatgttaaatatggatattagtatatctataagttataataattacgaaacattcttataaaaatttatgtctataagggaggaaattcaaatggcaaaagagaaatttgaaagaagtaagccacatgttaacattggtacaataggtcacgtagaccacggtaagacaacattaacagctgcaatcacaactgtattagcaaataaaggattcgcagacgcgttcaactacgcagatatcgataaggctccagaagaaaaagaaagaggaatcacaatcaatactgctcacgttgaatacgaaacagaaacaagacattacgctcacgttgactgtccaggacatgctgactacgttaagaacatgatcactggagctgcacaaatggatggagctatcttagttgtatctgctgcagacggtccaatgcctcaaacaagagaacatatcttattaggatcaagagttggtatagaatacatagtagtattcttaaacaaagctgatatggtagatgatccagaattattagaattagttgaaatggaagttagagaattattaagtgaatatgacttcccaggagatgatattccagtaataacaggatcagcattaaaagcattagaaaacccaacagatgatgcagcaaacaaatgtatcatggaattaatggaagcagtagatagctacattccaacaccagaaagagctacagataagccattcttaatgccagtagaagatgtattcacaatcactggtagaggaacagttgcaacaggtagagttgaaactggagtacttcacgtaggagacgaagttgaaatcgttggattaagtgaagaaaagaagaagactgtatgtacaggaatcgaaatgttcagaaagttattagatgaagcacaagctggagataacatcggagcattattaagaggggtacaaagaactgatatcgaaagaggtcaagttttagcagtaccaaactcagtacacccacacactaagttcgtaggtcaagtatacgtacttaaaaaagaagaaggtggaagacatactccattctttgatggatatagaccacaattctacttcagaacaacagacgttacaggatcaatcaaattaccagatggtatggaaatggttatgcctggagaccacatcgacatgaacgttgaattaatcactccaatcgctatggatgaaggattaagattcgcgatcagagaaggtggaagaactgtaggttcaggagttgttactagcatagttgaatagtaataatacacatctttgatgtgatttaaaagtagggatttatccctactttttttattttgaaaaattaaacaatttatcaaaattattttagagataaatctgtgaagaattataagattataatgaagtaaatgtattaataaagagaataagcaaaaaaataaaaacaattatgctaatttataaaaaaacaattatgtattatttatagattgaaagaccaaaatatacatgatagaatgtaataagcgtgtttgagaaaaatacataactttatacataacgttatagaatgcatatatattttatgagaaattgagtgaaaagattaaaagagattgttgaattttttataaaataacattaaaataaaaaaataaataaaataaaaaataaatttgtaaagttaaaaaaagtctaaaaaaaacttgaaaagagtaaagaagaatagtataataaagaagttgcatagcatacagcgaagattcaagaggttgccggacttccgggtaattcttgatgagtaagtttggatctagaatccgacgacagggactcgtaaatttgttcggatagttatgaaacacctggaacagtttacagataaccgctgttgtgcgttagaagtaaaacgtacataaaaaggagggaaatgaaatgtcaaagcaaaaaataagaataagattaaaagcttttgatcacacaatattagatcaatctgctgaaaaaatcgttgaaactgcaaaaacttcaggagctaaggttgtaggtccagtaccattaccaactgaaaaagatgttgttacaatattaagagcggttcacaaatacaaagattcaagagaacaatttgaaatcagaactcataagagattaatcgatatcgttaatccatcaccaaaaactgttgatgctttaatgagattaaatcttccagctggtgttgatatagaaatcaaactataatactggaaacttaattaatacgactatttatgattggattcaatccgctaattagtttgggaggtgtaaatacatgaaaaaagctataataggaaagaaaataggaatgactcaaattttcgatgaaaatggtaaagtagttcctgtaactgtagtagaagctggcccatgtgttgttgttcaaaagaaaacattagaaaatgatggttatgaagcaatacaagttggttttgaagaaataagagaaaaattagctaataagccaagaaaaggtcaattcgctaaggcaggagtttctgtaagaagaactcttaaagaatttagattagaagacataacttcttacgaagttggtcaagaaataaaagctgatgtatttgaagctggagataaagtagatgtatctgctgtatctaaaggtaagggattccaaggatgtattaagagatggaatcaacaaagaggacctatgactcacggttctaagttccacagagcaccaggttctatgggagcttcatcagatccatctagaacattcaagaacaagagaatgccaggacatatgggatctgttaatacaacagtacttaatttacaagtagttaaagtaatagctgaaaagaatttaatactaatcaagggtggtatcccaggacctaacaaaggtacagtagtaattaaaaacacagttagagcttaattagtgaagaaaggaggaaattagaatgcctacagtaggagtatataatatagaaggaaaaaaagtttcagatatggaacttaacgaaagcgtattcgcaactgaagttaaccaatatgcattacaccaagtagtagttgcattattagctaacaagagacaaggaactcaatcaactaagactagatctgaagttagaggaggcggaattaagccttggagacaaaaaggaactggaagagcaagacaaggttctatcagagcacctcaatggatcaaaggtggtatagtattcgcaccaaagccaagagattacagagtttctactccaaagagtatgagaaaggtagctatgaagtctgctttaactagcaaagttcaagataactcaatgatcgttcttgaatcattaaacttcgacgctccaaagactaaaaatgtagtagcaatgttaaatgctttagaagcacctaaggctttaatcataactgcagaatcaaacgaagctgtatacaaatcagctagaaacatccaaggagtaagtgttattccagcaaacaacatcaatgtttatgatttattaaagtttgataaagtaatcatgactaaagatgctgtatcaaaaattgaggaggtgtacgcataatgaaattaacaagccatgatataatcagaaagccagttataactgaaaagactatggcatctatggccgataaaaagtacactttcatagttcatgctgatgcaaacaaatctcaaataaagagagctgtggaagaagtattcaacgtaactgttgaaactgttaatactataaacggtttaggaaaaactaagagaatgggcgtacatgtaggaaagagagctgactacaagaaagctatcattactttaaaagaagatagcaacgcaattgaattcttcgaaggaatgcaatagtattatcaaagccattattggtgaataatcaccagagaagcttaaagaaggagggaattttacaatggcagttaaaaagtttaaccctataacaccatcaagaagacaaatgactatgcctacatttgaagaaattacttcacaatcaccagaaaagtcacttcttgttgcgttaaagagcaaagcaggtagaaatgctcaaggtaaaatcactgttagacatcgtggtggcggtgctaagagaaaatatagaattatagatttcaagagaaataaggatggtattccagcaaaagttgctactatagaatacgatccaaacagaacagcatatattgctttagttgtatatgcagatggagaaaagagatacattcttgcaccagctggattaaaagttggagatgtaattgaatcaggtgtaaacgctgatatcaaagcaggtaatgctcttccattaaagaacataccagtaggtacagtaattcataacatagaattacaaaaaggaaaaggtggtcaattagttagagctgcaggtaactcagcacaattaatggctaaagaaggagattacgcaactctaagattaccatcaggtgaaatgagatacgtaagaatcgaatgtagagctacaatcggaacactttcaaatgctactaacgatatcgttaatatcggtaaagctggtagaaagagacatatgggattcagacctacagtaagaggttctgttatgaatcctaacgatcaccctcatggtggtggtgaaggtaagtcaccaatcggtagaccaagtccagttactccttggggtaaaccagcacttggatataagactagaaagaataagaagtattctgatagattcattatcaaagatagaagaaaatagtgtgaggagaatgaattctcttcacagctaggacttcgtatttatgaagggaggcatatttagtgagtagatcaacaaaaaaagcaccttttgttcatgaaggacttttcaaaaagatagaagaaatgaacgcaagcggagataaaaaggttgtaaagacttggtcaagaagttcaacaatcttcccacaattcataggacacacaattgcagttcatgacggaagaaaacacgtacctgtatatgtatcagaagatatggttggccataagttaggtgaatttgtattaactagaacttacaagggtcacgacgataaaacatcaaagagatagcctggaaaggaggatcattaaatggaagctagagctatagcaaaatatataagaatgtctccaacaaaggtaggagtagttcttgatttaatcagaggaaaaaatgttaatgaagcttttgctattttacaatatactccaagagaagcagcagtagtaattaacaaagtattaaagtcagctgttgcaaacgcagaaaacaatttagaattaaatgctgataacttatatgtttctgagtgtttcgtaggtcaaggatcaacattaaaaagattccaaccacatgcacaaggtagagcatttaaaatattaaagaaaacaagcaatataacagtagttgttaaagaaagagcttagtttatagaaggagggaaacgcaagtgggtcaaaaagtaaatcctcatggccttagagtaggtgtcatcaaaggatggaacgcaaaatggtatgctaataagaagaattttgcagataatcttatagaagataataaggtcagaaaatttgttaaaaaagaactattctcagctggtatttctaaaatagaaatcgaaagagctgctaagagagttaagttaaacatatatacagcaaaacctggagttattataggtaaaggtggagcaggaattgaagctttaaagggtaaattaactcagtatataagcaacaagaatgttttaataaacattgttgaagttaagagtgctgaagcagatgctcaattaatggctgaaaacattgcagcacaattagaaaagagaatatctttcagaagagctatgaagcaaacaatgcaaagagctatgaaacatggtattaaaggtgttaaaactgcatgttcaggtagacttggcggagctgaaatcgctagaactgaacaataccatgaaggaacaattccactacaaactttaagagctgatatcgattatggatttgcagaagcagatacaacatacggtaaaattggagttaaagtttgggtttacaatggagaagttcttccaactaagaaagtagtagaaaaggaagaggctaacgcataggaaaggaggaataagtcatgttaatgcctaaaagagttaaacatcgtaaggtacaacgtggtagaatgaaaggtaaggctactagaggtaatttcttagcttatggagattacggaatacaagcacaaacttgtggatggattactagtaaccaaatcgaatctgccagaattgctatcaatagatacatcaaaagaggaggaaaactttggataaagattttcccagataagccagttactgaaaagccagctgaaacaagaatgggttcaggtaaaggttcaccagaatactgggttgcagtagttaaaccaggtagagtattatttgaattatctggagttgcagaagaaactgcaagagaagcaatgagacttgcttcacataaacttcctgtaaaaacaaagtttgttacaaagagagattttgaggaaatgggtggtgaaagataatgaaggctagagaattaaaagaattaaaatcaagcaatcctcaagaattagcagttaaattaggagatcttaaaggagaattattcaacttaagattccaattagctacaggacaattagaaaatccaatgagaataagagaagttaagaagtctatagcccaaataaaaaccatcttaagagaagaagaattaagagcattggaacaataagatttggaaggaggtatttcctaatggaaagagctttaagaaaaaagagaatcggtagagttgtttctgataaaatggaaaagactatcgtagttgctgttgaaactaaggtaagacatccactatacggaaaaactattaatagaactactaagttcaaagttcatgatgaaaagaatgaagctaaaattaatgatagagtatcaataatggaaactagacctttatctaaagataagagatggagacttgttgaaatagttgagaaagctaaataagcgtaaagctgaaaggagggtaacttaatgatacaacaacaaacattattaaaagttgcagataattcaggtgcaaaagaaattatgtgtatcagagtcttaggtggatctaagagaaagtttggtaacatcggtgatgttatagtagctagcgttaaaagtgcaacaccaggtggagttgttaaaaaaggtgaagttgtaaaagcagttgtagttagatcagttaaaggtgtaagaagagcggatggttcatacatcaaatttgacgaaaatgcagcagttataatcaaggacgataagcaaccaaaaggaactcgtattttcggacctgttgctagggagctaagagataaagaatttaataaaatattatcattagcaccagaagttctataagaggaggtggctaacttgaagatacatgtaagaaagaatgatacagttattgtcgtttctggtaaagataaaggcaagactggagaagttttaaaagcatatccaaaaacaggaaaagttcttgttcaaggagttaatatagtaaagaaacatcaaaaagctaacagaagtcaacttgaaagcgctataattgaaaaagaagcagctatcaatagttcaaaagttatgttatattgtaacaaatgcaaaaatgcaactagaattagtaacaaagttttagatgatggtactaaagtaagagtttgcaaaaaatgcggagaaacattctaatttttgaaaggaggtaactaatatgacaagacttcaagaaaaatacgtaaaagaagtagttccagctatgattgaaaagttcggatacaaaaacataatggaagttccaaagctagaaaaaatcgtaattaacatgggagttggagaagctaaagaaaaccaaaaggttttagaatcagctgttgctgacttaactctaattgcaggtcaaaaacctatattaactagagctaagaaatctgtagctaacttcaaaattagagaaaacatggcattaggatgcaaagttactctaagaaaagctcaaatgttcgaatttgctgataaattaatgagtattgctttaccaagagttagagacttcagaggagtttcaagcaaggcttttgatggtagaggaaactactcattaggaattaaggaacaattaatattcccagaaatcgaatatgataaaatagataaagtaagaggaatggatataatcttcgtaacatcagctaacactgatgaagaagctagggaattattaagattccttggaatgccattcgctcaataattaaggagggaacacaatggcacgtaaggctattattgaaaagtggagcaaaactcctaaatataaaacaagagcttatacaagatgtagaatatgtggaagaccacattctgtattaaagaaatacggagtatgccgtatttgtttcagagaacttgcgtataagggcgaaattccaggttgtagaaaagcatcttggtaatacaacaatgtaacgaaaggaggcacatttaaatggttatgacagatccgatagcagatttattaactcgtgtaagaaatgctaactctgtaagacatgaagtggtagaagtaccttcttcaaatgtaaagaaggaaattgcaaatatattattacaagagggttatataaaagaaataaacgaatataacgacggtgttgttccaatgttaagattatctcttaaatatggagctaacaaagaaagagttataactggtataaagagaatttctaagccaggtttaagagtttactgtaagagagacgaagtaccaaaggttcttaatggattaggtattgctgttgtttcaacttcaaaaggtatcatggttgatagagaagctagaaagaacggtttaggtggagaagttatctgctacgtttggtagtatttatataaattttaagtaaatataattgtatgtaaaagcaattttaaataatacaggaggtgcaattatgtcaagagtaggtagattaccaatagctattcctgctgatgtaactgtaactgtaacaccagacaacgttgttacagttaagggacctaagggtgaattagttaaaactatgcatagcgatataagcatagcagttgaaaacaatgaagtaattgttactagacatagtgaacaaaaagaacatagagctcttcatggtttaacaagagcattaattaataatatggtaattggagttaaagaaggttaccaaaagactttagatttagttggtgttggttatagagctcaattacaaggtaagaagcttgtaatgaaccttggatattcacatccagttgaaatagaacctatcgatggaatcactttcgaaactccagctgctactaaagtagttgttaagggaatcgacaaggaaaaagttggattcgctgcagctgatataagaaaatggagagtaccagaaccatataagggtaaaggtattaagtacgaaaacgaagttatcagacgtaaagaaggtaaaactggtaagaaataataggaaggagtgactctatatgttcaaaaaggcagacaaaaaagcaagcagagcaaaacgtcaccttagagttcgtaagaaagtatctggtactgcggaaagaccaagactttcagtatttaagagtgaaaagaatatatacgcacaagttattgatgatataaacggtgtaactttagtagctgcttcaagcttagacaaagatttcgctgctaaaggcggaaacaaagaaggcgctaaacttgttggagaaacagttgctaaaagagctgtagaaaaaggaattcaagaagtagtattcgacagaggtggatacgtatatcacggaagagttcaagaattagcagaagcagctagagaagcaggcttaaaattctaattaacgaggagggaaataaatgagaatcgatcctagtacactagaccttaaagaaaaggttgtttttataaacagagttactaaggttgttaaaggtggtagaaacttcagattcagcgcattagttgttgtcggagacgaaaacggacacgtaggcgttggtatgggtaaatctatcgaaattccagaagcaatcaaaaagggaatagaagatgctaagaaaaacttagtaagtgtttcaatggttggaacaactgttcctcatgaaatacacggtaagtttggaacagctgatgttctaatcatgccagctaaagaaggtacaggagttatcgctggtggtccagcaagagctgtattagaattagcaggattaaaagacgtaagagctaaatcattaggttctaacaacccaagcaacatggtaaaagctacaattaatggattagcaagtttaagaactgcagaagatattgctaaattaagaggcaaatctgtagaagaaatattaggttaggaggttttgcagaatggctaaagtaagagttacattagtaaagagcttaataggtagaaagaaagaccatattgctactgcaaacgctcttggacttaaaaagataagaaatactgttgaagttgaaactaacgatgcaattaacggtatgattaaaaagatagactacttattaaaggtagaagaagtataataaacaaggaggtgcactagaatgaaacttcacgaattaaaaccagcagcaggtagtagaaaagcacctaagagaatcggtagaggtactggttcaggattaggaagaaacgctggtaaaggtgaaaagggtcaaaacgcaagatcaggtggtggagtaagacctggttttgaaggaggtcaaatgcctttatacagaagactacctaagagaggattcactaatcctttcagcaaggaatttgtttgtatcaacattgacagattaaacatcttcgaaaatggtacagaaataactccagaagttttacttgaaagaagagttgtaagtaaagtattagacggagtaaagattcttggaaacggaacattagaaaaaagcttaacagttaaaggatgtaagttctctaagtctgctatagaaaaaattgaggcagctgggggaaaagttgaggtgatgtaacgtgcttcaaaccctacgtaatgcatttaaagttcctgaacttaagaaaaaaatcttatggacaatattactagttgcagttttcaggatgggaagtcatattcctgttcctggaattaactctgaatatcttaagagtttgagccaatcgggtggtttattaggtttttatgatatgatttccggaggtgcttttagtagatctagtatattggcattaggagttatgccatacattaatgcatcgataattattcaattattaactgttgctatacctcaactagaacagctttctaaagaaggcgaaacaggaagaaagaagatacaaaacttaactcgttatgcatctcttgcaatagcttttgttttagcttatggaacatttgctatgatttctaatagtggaggagcagttggattaaatactatgggtaaagttgttgtaattttctcattagtagtaggtacaacattctgtatgtggttgggtgaccaacttacagttaagggaattggtaatggtacttcaatattgattttcgttaatataatttcgagaattccaactacaatagcttcaatgatgactcttaaagaggcaggaagtgctagtattgttgaaatagtattatttggagtatttattgtgtttttattaggcgcagttttatttttctcactatcagaaagaagaatacctgttcaatatgcagggaaattcggtggtggaaatgctgcaatggtaaaatctcaatcttcgaatattccattaagtattattggatcagcagttcttgcgattatattctcaatgtcagtaatggaattcccaaagactatagcaaccttgtttggtggcgataaagaatgggcaaaatggattttaactaatccaacatgtgtatttaactctaaaagctggtcatatatggtattatatgcagtgcttacagttttctttaattggttctatactttaattactttcaaaccagatgaaatggctgaaaacttacataaatccgctggatttgtgccaggtgtaagaccaggagaagaaactgaaagatattttgaaaatgttcttaatagattatcattcattggaggtatattagcagcaatgcttgctataacaccagtaatgatagaaaattatacagcattccaaaatacagctttttcaggaacagcattattaattgttataaatgttgcattagattttactagacaggtagaatcacaaatggtggtaagacactataaaggatttcttaaatagatttaaataaatggagatgaagccagtgaagatagtattactaggtcctcctggagctggaaagggaacacaggctaaatcaatcagtaataaatattctataccccacatttctacaggagatatttttagaaaaaacatttctgaaaacactcctttaggggtagaagcaaaaagttatatggataacggacaattagttcctgatgaagttacaattaacatggttaaagatagacttcaacaagatgattgtagagcaggatatttattagatggttttcctagaactgtggctcaggctgaagctctaaacagttttcttattgaaagaggggaacaattagatactgccttattaataaaggtacctaatgagtttatcttagaaagaatgactggtagaagagtatgtccatcatgtggagcaagttatcatgtaaaattcaatcctccatcagttgaaggaaaatgtgatttgtgtggaagtgaagttatacaaagaaaagacgatacagttgaaactgtaaaggaaagacttgatgtatatcaaaaagaaacacaaccattaattgatttttatggtaataagcaattgctttcagaagtagatggtactaaagctataaatgaagttttcagaggaatatgcgaaatattggggaataactaatgattatttataaaaataatgatgaaatatccctaatgagaaaagcaggcaaaatagtaggagaaacattgctattgctcgaaaaagaggtaaaacccggtataacaactgccgagttagatataatggcagaagaatttataactaagcatggagcaaaaccttcatttaaaggcttatatggttttccttcgtcactgtgtatttcagttaatgagcaagtaattcatggattcccaggagggtatgttcttaaagaaggagatatcgttagtatcgactgtggagcatgcataaatggatttcatggagatgcagctagaacatttccagtaggaaaagtttcaagtgaagctcagagattaatagatattactaaagaaagtttctttgaaggtataaaacatgcaaagataggaaatagattaagtgatatatctcatgaaatacaaagctacgtagaagcagcaggtttctcaattgtaagagactttgtaggacatggaattggacgtaatgttcatgaagatcctaatgtgcctaatttcggtaaatccggtagaggtccaaagctagttgagggaatggtattagccatagaacctatggttaacgcaggaactcatcaggtaagaacgttaaaagatagatggacagttgtgacagcagataattgcttatcagcgcattatgaaaatacagttgcaattttatcagatggacctgaaatattgacactgattaagtagaaaaaagagtgttgcttagttataaatttgcataataccattgtggtagtgttaatttatactaaggtaatcatagaggtgaaaaatttgcaaaacaatgacttgattggaaaagtagtactttcaaaagcaggaagagatattaatcatttatatgttgttgttaggcagatagataatgattatgtattgcttgctaatggggatacaaaatcaattgatatgcctaagaaaaaaaagattaaacacttaattattttagaaaatatagatgaagaattattatcattgataaaatcatgcgataagagtacagatttaaagataaaaagattcctaaaagttagaggcattgttaaggagggttgattaccttatgtcaaaagatgatgttatagaaatgcaaggtacagtactagaatcattaccaaacgctatgttccaagttgaactagaaagtgggcataagattttagcacatatatcaggtaaattaagaatgaacttcataagaattctaccaggtgataaagttactgtagaactttcaccatatgatttaacaagaggtagaattacatggagagctaaataaggtagagttacttacttaatatctaccacaaaagtaatatgaggagggttagctatgaaagtaagaccatcagttaagcctatttgtgaaaagtgcaaagttatcagaagaaaaggaaaagtaatggtaatctgtgaaaatcctaagcacaaacaaaaacaaggctaacaatcactttaacagtattattttgtaataaatgatattgacatttcagcaaaagtcaaatatgattatatagtcgtttaattaatcaaaattattttagggcggctgacaatggtttaatctattggcctaaaattttaatatatataaataaattaaaaaataacacatttcaatcatcaggaggtgtaaatttcaatggcaagaatagcaggcgttgacctaccaagagaaaaaagagttgaaataggtttaacttatatctatggagtaggtttatcaacttcacaaaaaatcttagctacaacaggaataaatccagatacaagaatcaaggatttatctgaagaagaagttaatgaaattagaacttatataaataagaacttaatcgttgaaggtgacttaagaagagatgttgctttaaacattaagagattaatagaaataggatcatatagaggaattagacatagaagaggtcttccagtaagaggacaaaaaactaagactaatgcaagaactagaaaaggtcctaagaagacaatagctaataagaagaaatagtaaggaggtaagataatggcagctcaaaaagtcaagaagactagaagaagaaaagaaagaaaaaatgttgagcatggtgctgcgcacattaagtcaacttttaataattcaatagttactttaacagatgcagtaggtaatgctttatcatggtcaagtgcgggtgcattaggattcagaggatcaagaaagagcacaccatttgcagcacaaatggcagctgaaactgcagctaaagcagctatggagcacggcttaaaaagtatagaagtttatgttaaaggacctggttcaggaagagaagcagctatcagatccttacaagcagcaggcttagaagtaacattaattaaagatgttactccaatcccacacaatggttgtagaccaccaaagagaagaagagtctagtctaaccgtaataggaggtgtaatttaatggcaagatatactggcgctacatgtagattatgtagaagagaaggtatgaaacttttccttaaaggtgatagatgtttcactgacaaatgtgcatttgttagaagaagctacgcaccaggacaacatggagcaaacaaaaagaagatctctggctatggagttcaattaagagaaaaacaaaaagcaaaaagaatatatggtgtattagaaagccaattcagagcatattatgaaaaagctgaacacatgaaaggtatttcaggtgaaaacttacttaaattattagaaatgagacttgataacgtagtttatagattaggttacggtgcatcaagaaatgaagctagacaattagttactcatggtcatttcttagtaaatggtaaaaaagttgacatctgttcatacagcgtatcagctaacgatgtaattactgtatgcgaaaagagtagagcttctgaaaagttcaaaactttcgctgaaaatccaaaaactttaccagcttggttagaagcaaatgttgataactttgaaggaaaagttgtagcagtgccatcaagagaagaaatagatgtgcctgttaacgaaacacttattgttgagttatacagtaaataatattaatatatttgtttttattagagaaatttatcacaatatatgcaaatatagaatcagttgccctcataataaggttgccatttataatatagggagggtttgtcaatgttagaaatcgaaaagccaataatcgaatgtatagaatctaatgaagatggtacatatggtaaatatgttgttgagccacttgaaagaggatatggtattacattagggaatgccttaagaagaatattattatcatctcttccaggagtggcaccaacttctgttaagatagatggagttttacatgagttttctactgttcaaggtgttaaagaagatgttacagaattaattcttaacataaaatctttagctttaaaaatgaatggtgaagggccaaaggttatttatattgatgctaaaggaccaggagaggttactggagctgatataaagactgatggtgatgttgaagttgtcaataaggatttacatattgcaactttagattctgatggtagactttacatggaattgacagttaataatggaagaggttatgttactcagaacaaaaacaagagtgatgatttaccaatttcatcaattgcagttgattcaatctatacaccagtaaaaagagttaattttactgttgacaacacaagagttggtcaaattactgattatgataaattaactttagaaatttggactaatggaacaatcagaatagatgaagctattagtttatctgcaaaaatacttatcgaacactttaaattattcatgtcattaacagataatactaatgatattgaagtaatggtagaaaaagaagaagataagaaagaaaaagtcctagaaatgactgttgaagaacttgatttatcagttagatcatataactgtttaaagagagcaggaataaatacagttcaagaacttgctactaaatctatggatgatatgatgaaagtaagaaatctaggaaagaaatctttagaagaagttgaaagaaagcttaaagaattaggtttatgcctaaagttaagtgaagagtaaggaggtaaatccatggcaggttatcgtaaattaggtcttcctacagatcaaagaaaagctatgctaagaaatcttgttactagcttattaaaacatggtaagatcgaaacaactgaaacaagagctaaagaaactagatctatagctgaaaaaatgatcactcttggtaagagaggggatcttcatgctagaagacaagtattagcttacgttcaagaagaattagttgttaaaaacttattcgacaatgtagctccaaagtatgctgaaagaaacggcggatatactagaatgattaaaaaaggtcctagaagaggggacggagctgaaatagtaatacttgaattagtataatactaaagggattaaggaaacttaatccctgttttaatatatagaaatatattttctttttttatgttataatacatatgtatatacatttaagttgaagatatttaaaattaagataaattagtaatttactaatttattatagagatgttttttaatttgataaaatattcactttttattgaaaatatataaaattagtatataattaaactattaattgaaaatttatacagaataaagagagatttgtataataaattagtatatgaaccatggaggttaggtaatgaaggatgcaatggtacaatgcataaatgtatcttttaaatatataaaaaatacagaagaaggtaaaactgaagagaaatatgcagtcaaagatgttaatttagaagttaaaaaaggcgaatttttagttgttttaggacacaatggttctggaaaatcaaccatagctaaacatatgaatgcattggtgattccaaccgaaggtaccgtgttagttgatggtattgatacaaaagatccagaaagaatatgggacgttagagctaaagcaggaatggtatttcaaaacccagataaccagattgtagcgacaatagtagaagaagatgttgcttttggtcctgaaaatttaggtattgaaccacaagaaatccgtagaagagttgatgaaagtttggaaaaggtaggaatgagtgaatataaaagacatgcacctcatttattatctggtgggcaaaaacaaagagttgctatagctggtattcttgctatacagcctgaatgtattatttttgatgagcctacagcaatgcttgatccatctggaagaaaagaagttatgaaaactataaaagagcttaatgaaaagcatgggataacagtagttcttataactcattatatggatgaagctgctcaagctgatagaattgttgttattgatggtggacacgtaatgatggaaggtattccaagagaaatatttccacaggttgaacatatgaaaaaaattggtttggatgttccacaagtgactgaacttgcttatgaattaaaagaggctggtttagatataaatgaaaaaatacttaatgtagatgagatggtgaatgaattatgtcaattaaaacagaaaatttaacacatatttatatgcctaagagtccttttgaaaaagtggctttggataatgtatccgtagaaattgaagatggtgattttgtggctttaataggacacactggttcaggaaaatcaacccttatacaacattttaacggattacttgaggcatctagcggaaagataattgttgatggtgttgatataacagagaaaaatgtaaaattaactgatataagaaaaaaagtaggtttagtatttcaatatccagaatatcagatattcgaagaaactatttcaaaggatattgaatttggacctaggaatctagggttatctgaagaggagataactagaagagttaaaaaatcaatggagatggtaggtttagattatgaaacttataaagatagatctccgtttgatttaagtggaggacaaaaaagaagagttgcaatagcaggtgttatagctatggaaccaacaactctgatattagatgaacctacagcaggattagatccaaagggtagggatgatatattagggcagattaagaagttacataaggattataatatgactgtaataattgttagccatagtatggaggatgtagcaaatattgcaaaaagggttattgtaatgaaccatggtaaggtagctcttgaaggtactccagcagaagtatttaaagaagttgataagcttgagagtataggccttgcagtaccacaagtaacgtatttaataagaaatttaagagcaaaagggtttgatatttcagatagtatatttactatcgaagaagctaaaagggctattctatctatttttgcttcaaatagtataaagggggataagtagtcgtgttaaaagatattacaataggacagtatctaccaggtgaatcttttgttcataaattagatcctagaacaaagatattaatatctctaatatttataatatgtttatttatagtgaataaatttattggatacactgtggttattggattcctattagcagtaattttagttgcaaaaattccatttagattcatagttaaaggattaaagcctatatttttattagtagtatttacagcagtactaaatatttttatgattaaaggtactccagatacattactatacaagattgggttcttatctatatatgtagaaggtgtgaagacggcagcatttatggcaataagattaattctgttaataataggcacatcaatacttacattaactacatctccaatagagttgactgatgggattgaaaaacttttaagacctattggcaaagaaattgctcatgaattagctatgatgatgactattgcgttaagatttattccaacacttattgatgaaacagataaaataatgaaagcacagaaggcaagaggtgcagattttgaatcaggtggaattatacagaaggcaaaaagtctcgtaccgctattagtaccgctattcataagctcttttagaagagctgatgaacttgcaatggctatggaagcaagaggatatagaggtggggctggaagaacaagaatgaaagttttgaaatttacatctaaggatactgttgcttttatcgtagctacattaataatagtatggtcgttagtagttagatttatcctttaatattagggatggttttagttagaactattctcagtatatttttataaatgaattaattaaactaataagttttaacaatgatgctttgattttattaaatattattaaagcatcattatttttatttttcgttaatttgtaatatacttaatatgtttaaataggcagagaaaatttattagtgataagatgccatatataatattattaaaatttaattaacaagaggattaagatgagaaatataaaattaacaattgaatttgatggtagtgaattttgtggctggcaaaagcagcccaaaggaagaactgttcagaaggtaattgaagaagcaatttttaaggctactggtgaagaaattattattaatggaagttcaagaactgattcaggggttcatgctaaggatatgatagctaatttcttcactaatagcacgattccgggggataagtttagagaagcactaaatgtacgtttaccaaaggatgtgtctataataaggtcagaagaggtatctgaagattttcatgcaaggtactcatcaaagggaaaaacatattcatatacaataatccatagatatgagagagtatcttttggtcatcagtatgtataccattggaggcatgatttagatattgataacatgagagaagcctgtaaatactttattggaactcatgactttagagcctttatgtctccaggaagttctataaaaacaacagtacgtacaataacagatttgcatatagaacaaaatggagagaaaattaagatttttgtaagtgctgatggatttttatataatatggttagaataatagttggaactctaattaaggtgggaaataaaaagttaaaaccggaagatattcaggatataatacgtgaaggtaatagaaaacgtgctggaatggtagttccgcctaatggattagtcctagaaaaagttttttattaaatgtcaaaaaattgttgacacgcccgtaagcgtgtattataataatgtatgtttgttaaaacatttatgtatataagatccactagccccgggtcttgacataaacaattttactttaaattaaaagtaaatattaatgtaagttcagggagggaaacagatgaaatcatacattgctaaagcaagtgaaatcgaaagaaaatggtatgttgttgatgctgctggtaagccactaggtagagttgctagccaagttgcttcaattttaagaggaaaaaataaaccaacttttacacctaacgttgactgcggagacttcgttatcgtaataaacgcagaaaaggtagttttaactggtaaaaagttagatcaaaaattaatgagaaagcatagtctttacccaggcggattaaaagaaactccatacagagtagtattagataagaaacctgaattcgcattcgaagaagcagtaagaagaatgcttccaacaggcgtattaggaagacaaatgttaaagaaattaaatgtatacagaggtgcagaacataatcacgcagctcaaaaaccagaagtacttgagttaagatattaatatatactcgggaggaggaataaaaatggcaaaagttcaatacatgggaactggaagaagaaaaaaatcagttgcaagagtaagacttgtaccaggaaatggtaaggttgttgtaaataaaagagaaatagaaagcttttttggtttagaaactttaagagttatcgtaaaccaaccattagttttaactggaactaaagataagtttgacgttttagttaatgttcatggtggtggattcacaggtcaagctggagctatcagacacggtatagctagagcattagttaaatctgatgaagctttaaaatcagaattaaagaaggctggattcttaactagagattcaagaatgaaagaaagaaagaaatacggtcttaaaaaagcaagaaaggcttctcaattctcaaagagatagtttggagctattcaaatcctgcaagcagtatgtttgtgggattttttttatggaaatttataaaggttctctttagttagattaattaatctatgttatcagtaatttagtttgagtatttatattttcttttataggataatcatatgaatttaaaattcttttcagaaggatctagagttataagactacaatcatattatttcctttaatattataattaatattttaaggaaagttttatggaaataaatatgtaagcataagcttaaaatgtaagaaaaatacatgttatattaaaaataggttaaaaatcaagcgaaaatattaacataaggttaaaaataagataaaattaatatgtaatataataaataaattaaccgaaggagaataaattgtggatacaataaaggttattattcaattaatgggtggattagggctatttatttatggtatgaaattaatgggggatggattagagaatgcagcaggggaaggtttaaaaactatccttgaaaaggttacaagcaatcgtattatgggggttggaattggtgcgattgttacagctgttattcagagtagtagtgccactacagtaatggttgtaggatttgttaatgcaggtcttatgacattagcacaagcggcaggtgttataatgggtgccaatataggtacaactattacagcacaacttgtagcttttaagctagatcaggttgctcctgtattcgtatttgtaggtgcagcattagttatgtttgctaaagctaaaaaaagaaaagaaataggaaatataatccttggttttggtatactatttactggaatgggtgcaatgagtggagcaatgaagccattagcatcatcgccaatgtttacagacgtattattagcaataggggataattggtttattggaattatagcaggtgctgctattacagccgtattacaaagttcatcagcaacaactggtatattgattgctttagcatcaactggacttatagatataggactagcattaccaatagtttttggatgtaatataggtacttgtataacagctatgcttgcaagtgtaggaactaacaaaactgcacataaagcagcattattacatttagtatttaatatagttggaacaattgtattcctaccttttataggacttatagcaaagtttgttcagcatgtcagtccagatgatgtaagcagacagattgcgaatgcacatacggtatttaatgttgctaatacagcattacttttaccatttactaattacataattaaatttataaacaaggcaattccttgtgaagaaaatattgaaaaagctggaccaaaatatattgatgatagagttttagaaactccagttattgcggccggacaagttattaaagaaactataagaatggctaataaagcaaaagagaatgttgaattatctatgaaggcttttgttgatggtgatgaatcactaattgaaaaggtgtatgaaaatgaaaaaataattaatatacttgaagaaagcataactgaatatttagtgaaacttgctaagtgtgatttatcagataaggaaaaaggtattgttgcatcaacattccatgtaattattgatattgagagaataggagatcatgcagataatattgcagatttaactattgaaaagataaataaaaatttaaaatacagtaaagatgctattgatgaattatatgaaatttataactcaacactagaagcattagaaatagctattgattcttatgtaacaagagatattactaaagcaaagagtattatcgatgttgaagataagattgatgcatatcaaagaacttatagagaaaagcatattcaaagattatatgatggtaaatgtaatgcatttgcaggtgctgtgttcttagatttaataagttcttttgaaagaataggagatcattcaactaatattactgagagtgtattagaaaattacgttaattaatgatttgtaaaaagagattccaaatgaaggagggcactgaaaaagtgcctttcggaataaaagacctaaaaaattatttaaaaacaattttttaggtcttttatgttatacttaacttataaaataatgtaggtgattcgtatgataaaaaagcaagaaacaatgattttaagtgaatattcaggaatttatgatttggttgttccaagagataatctgttaagaaagattaatgaattaattgatttttcatttatatatgatgagattttagataagtattgctctaataatggtagaaatgccattgacccgatacgtatgtttaaatatcttttattaaaatccatatttgatttgtcagatgtggatattgttgagcgttcaaaatatgatatgtcatttaaatattttcttggcatggctccagaagaagctgttattgagccaagctcattaactaaatttcgtagacttaggcttaaagatataaatattttagatatgttaataaataaaacagttgaaattgctcttgaaaaaggaatcctaaaatcaaaatctatcattgttgatgctacgcatacagcagctagatataatcaaaaatcaccacgtgaagtattacaagaacgttctaaaagattaagaaaatcagtttatgaaatagatgagagcattaagaatacttttccatctaaaaatacagttgatgatttagaatgcgaaattaaatattgcaaggaattaatagaaattatagaaaagaacgaaggtatttcatcttatccaaaagttagagaaaaattaaatattttaaatgaaatattagaagatgatattcaacacattcaggctagcgccgatgcggatgcgaggattggacataaatctgtagattcatctttctttggatataaaacacatattgcaatgactgaggaaagaataataacagctgcaactattactactggtgaaaaaaatgatggtaaagaattagaaacattaattaataaaagtcaagaagctggaatagagattgaaacaattattggtgacgctgcgtactctgaaaaaggtaacattgaatttgcaaatataaataatattaaacttgtagctaagttgaatccttctgtaacgcaaggctttagaaaaaaggaagatgagtttcaatttaataaagatgctggaatgtatgtatgtaaagaaggtcatatggctatccgcaaagcccgtcaaggaaaaaggaatgtttctacaaatcaagtagatacttattattttgatattgaaaaatgtagagattgtctgcaaaaagacggatgctataaagaaggtgctaaaagcaaaacctactcagttactataaaaagtgatgttcataaatctcaaatagagtttcaagaaagtgaatttttcaaggaaaaatctaaagagagatataagatagaggctaaaaatagtgagttaaaacataggcatgggtatgatactgcatcatcctcaggtctaattaacatggaaatgcaaggagcattagccatcttttcagtaaatgttaaaagaatattgaagctattaggatagaaatatcctttaatttgattaatatctaaagaaaaaagagttaatgaaactaaattttttaagtttcattaactcttttttatctagatataaccgcactaaaaaaactttaagtttttcagtgccctccaaatgaaggagtctcttttttgattttaaataaattttattaagctattttttatttagagatattgataattgaaagaaaggaccactttcattttatttatgaataaattactccttagtgcagacaatattctagaggataattttattagaaggagaagtaataatgaagtttagaagaattttatctttaatgtgtattttgcttattatattttccatgcctataaaagttaaggctgaagatgaaaaagatcagcatataatattaattgatgcaggtcatggtgggattgatggaggagcaaaatcaaaaaatggaactatcgaaaaagatataaatcttgctatagcatcaaaactaaagaaaaagcttgaagatggtggatataaagtatatatgacaagagaagatgattcccagttagctaaaaagaaagtagaagatttaaccaagaggtgtcaattaaaaaaagaaactcaatgtgaagtatttatttcaatacatcagaatatgtttccacaggcaaactgttttggtgcacaggtgtggtatgcatcaaatgataagagcaaagaattggcagaaggaattcaggaatcattaaaagagcagattaaggataataataaaagaatagctaaagctgcaaaagatcagtataaaatattaagggatggttatgatggagcttgtattttagtagaatgcggtttcttatctaattcagaggaagagcaaagattaaagtctgatgaacatcaagaaaatttaacagaaggaatcaaaagtggtttagataagtactttgaaagtaagtagttttatattagaaactattatttataaatttatttttaaattatatgtaaaactcaattgagttaatgtaattgtttttgagttttacatatttaatttttgaataataccaaaagagattacattaacttaatttatatacaagaggtttttaaacaatcaatagaaatgggtccaaccttaatactatttctaggtggattactggaaaaataatcgccattaaataacaagaaagcattatatattattaggcatattaagcagagggttaatgcatagataataaatgttagtagttgatttaatttgttatcattcataaaaataaatcctttcctatgtatattgcttatgtttaaatatagtatcaaatttttataaatatgaaattaaaaacataaaatctcctcttaaataaatattttattgttgtaaatacagagaaaaaattttaaacttaaatagagtaataagtagaggagttgttataatgcgcgaagtaaatgtagctttaattactgatactgtaaaaaggttatcaatagaagctaattattttttaggggctgatataaaagaatcattagaaaaatcaagaaaagaagaaacatacgaactagcaggacaagttcttgataaaatcattttaaactctgaaattgcatgcaaagaaaaaatgcctatgtgccaagatacaggtatggcatgtgtattcttggaaataggacaagacgtacactttgtagggggaaatttagaagcagctataaatgaaggtgtaagaagaggatatgaagatggatttttaagaaaatcagttgtagatgatcctataagaagagttaacacaaaggataatactccagcagtaatttattatgatattgtggatggagataaagtaaaggttactttggctccaaaggggtttggttcagaaaacatgagtaaaataggtatgctgaaaccatctgatggtttagaaggggttaagaattttgttatagaaacagtaaaagcagctggacctaatccatgtcctcctatggttgttggtgtaggtattggaggaacatttgataaagcagcatatttagctaaaaaagctttaattagaccaataaacacaagtaacaaagatgaattttataaggatttagaaatagagttattagaaaaaataaataaacttggaattggaccacaaggatttggtggaaagacaacagctttaggtctgaatattgagacatatccaacacatatagcaggtcttccagtagcggttaatattaattgccatgctactaggcataaagaagcaataatatagaaagtttcaattttgaataatagattaaattgaatattacatagattgggggataaaacatggaaataaagttaaatacacctcttacagctgataaaacaaaaggtttaaaagcaggggacagtatactgttaagtggcgtaatatattcagcaagagatgcagcacataaaagacttgttgatttattagatgagggcaaggaacttccattgaatataaaagatgagactatatattatgttggtccatcacctgcaaagccaggaagtgttataggatcagcagggccaactacaagttatagaatggatgcttatgctccgagattaatggatcttggattaaaaggaatgataggaaaaggtgcaagaaataaagaagtaattgatgcaatagtaagaaataattcagtttattttggagctattggtggtgcagcagcacttattgcaaaaagcatagtaaaatcagaaattatagcatatgaagatttaggtgctgaagctataagaagaatggaagtaaaagatatgccattagtagtaattatagattcagaaggaaacaatctgtatgaattaggccagaaagattatttgagtacaataaagtaatttgcattatatatattgaaaaaattgaattttaggttaaataaaacattgtaggtttaaattctaaataagttctattatgataaataaaagctcaaagagataattaaaattttcttctttgagctttttatatgtaattataattattcacaggatttacaaacaaatgtgaataatttctttatttcataaaataattgtggataaaatttcagttatgaatagattatatattcataaagcctttacctcttacttctgatatatcaacaattgttataaatgctgatggatctatctgatatattgtattttttaattcaaccatttggcgtgcagttactatacaatataacattttctttctatcatgcgtatattcaccttcagcaagtaatgatgtaactcctctatgaagatcttttataacataattaattacatctgcttcttttttagtaagtataagaagtaattttttactactaaatcctttaagcattttatcaagtactatactttgaataaaaagagaaatcaatgtgtatagagcttgaggaagtccgaatataaatgcgccgattataataattattacgttaagagaaaatcctaaacttccaatattaaaattagaatgcttttttctaattagcattgttactacatcagtaccaccagtagaaccatttctcaaaaaaacaagtccatatccaattccgcaaagtacaccaccatatatacaatagagcaataaatcaagcccatcgatatttatagcagaagctataggtttagttatcataagtgaaattgatagtgaaagcattccgatagtagtataaatagtgaatgatctactaagctttttaaaactcacagctagtagaggaatattgattaagaataatgtaatacctgctggaatatttgtagtatattcaacaagtaatcctagaccagtagcaccaccacttaaaagctgtgcatgagataaaaaaacattaacgcctagagatgcaataatacaacctaaaaatatgattaatacatcaaatatattagctctgtatttgtaatatgtgtccatggtatactcctttaagttataattctctataatattaagacattttataaactaaaattcaacccttagaaaattgtaaaatcagtaatgaaaaaatacttttaatgagatatattaagtacagcaaattatgtaaaaaaacaaaaaagtaattaacttattaataaaaaagtatgactaaaaatatgaaaataatttttagcactttttatacatatcatattaatatttttttgtgataatatatttaatataggatgtagtattaggctcgtaatttacatattattatttatgtgcttatttttaaaatattatttatgaataatgtatgttcattattaatttaatgaacatttaagtttataataaatatatatgatgctatatttactttagttacaattaaattataggtaacagtaattgcaatataaggagaatgagtatgaatagaatatcattgccaggaaaagcaaaaaataaaagaattattttatttattttaatattaatttcagttggaatattgatttatgaatttattaataatacaaaaaataaaaatactaataaagatattaacaatatcactaatgaacaattaataggagcatctgaaaagaataatgattctataactgaatctcaaaatgaaaatattaagaataatgaagttcaggatatatcagaaagagaaagagagttatataataatgcatatacaacctttttttcaggagattatgcaatggctataaataaagcagatgagttagtagaagaatttcctaatagttatatgggatataatataagaggcatagcaaaggcctatgatggtgattttgacggaggaatgtcagatataaataaatcattggatatgaattctgattatggatatgggcgatttaataaagcacttacatatgagttatacaatcagtttgatgaatcacttaaatggtataataaggctcttgaagttgaagaatatgtatggacctattatggaattgcatctatatatggaagaagaggagatgttaataggactgtagagtatttgactaaagctattaatatggatagtgcagtaaaagaagaagcaaaaaatgaatcggattttgatccagtaagaaattcactggaatttaaaaatcttattgaagaataaaaaatgacatgagattgtaatagttatattttaatataacatagggagcaggaggtaaagtaatgtttaatgtgttggtagtagatgatgaaaaagaaataagagatgcaatagaaatatatttaagaggtgaaaatttaaatgtattaaaagctgaggatggactcaaagccctagatatattagaagaagagaaggttcatttaataatattagatgtaatgatgcctaaacttgatggaataagaacatgcctaaaaataagggaaactgagaatcttcctataataatgctttctgcaaaaggtgaagattcagacaagattttaggattaaatgtaggggctgatgattatataactaaaccatttaatcatttagaattagttgctagagttaagtctcagcttagaagatatgaaaagcctttgaatgtagaggaaggaaaagacataataaaggttaaagatttggttattgatacaatagctaaaaaaataacagtaagaggagaagaaattaaggtgactgcaacagagtataaaatactccatcttcttgcatccaatttaggaaaagtattttcaataaaagaaatatatgaaaaagtatgggaagaaattttttataaaagcgaaaatacagtaacagttcatattagaagaatacgagaaaagatagaaataaatacgaaggagcctgaatatattaaggtggtgtggggtattggctacaagattgaaaaggaagattaattcatatataagcagcatttattttatagatattctgattatttcaataataacattaatgctattttcaatattaggagattatgcacaggtcaatagaactcagcaccagttagcagtacaagagatacaggaaaatacacaggaacttattacactaataattataaatacaatatttataacaaagattatgttggttataaaaagaaatcccagatcacctaaaattaaatctaatataatcaataatgttatttttgttttaaaaaagggttttaaatataaagaaacaagaactacattattagtttcaataatacttggagtaataactcttgtgacgtacttatattttctggcaactggtggatatgaaaataatatatttgttagattctttcagacatatccatttaaaggcagtatttttatgatcatgatactatttttaacaatgatctatggagcaaaaaaaactttagatataagtgtagttaatgaagcacttagaaaagtaaatgaaggaaatcttcaggatgacataatacttgatggttcaccagctattagagaacttgcacataatataaatttaataaaagctggatataaggagatactagaagaaggagtacgaagtgagaaattaaagactgagttaatttcaaatgtatcccatgatttaaaaacaccgttaacatcaataattaattatgtaaatattataaaaagtaaggatataacggaagaggaacgttcagattatattgaaattttagaaaaaaaatctcttaaattaaaggcgttaattgaagatttatttgaaatgtcaaagataaatagtggtaagcttaaacttaataaagagcttatagatattttatctcttgttcatcaaggtgtaggtgaatatagcagtctttatgaagaaaaaaatataacttttaaagtcacatgtgaggaagatgctatatatatggctcttgatggaaaaatgatatcaagagctatagaaaatcttataataaattctcttaaatactcccttgaaaacacaagagtgtatatagagatagaaaaaaatgaaggatacgttactatatctatgaaaaatatagcaaattatgagatggactttagtgaagaggagatgtttgaaagatttgcaaggggagataaatctagaaattctaaaatagaaggctctggattaggtcttgcaataactaaaagtatagttgagcttcacggaggtattataaaaatacgaagagaaggcgatatgtttaaaatttatgtaaaacttccattggaagaataaaaaatattaataaataaattttatcaattaggtagttaatctgtagaaaataaaagattaactacttttttgtatagataatttataaatttgaagttttacaattaatatattaactactataatatacgatatgttgtatgaggatattaatatatttatatatagacacaagatatagtggagggaagataatatgtcagctttaaatgaattatgtatagatgctgtttctagtataaaagatgaagaaggagtttattcagaaaataaactattagaggcattaaatttaataataagagatggaatgagtgaaaaacacataagaaaatcacttattcaggttgctttagaattaactacagatatggagccaaattggcaatttgcagcatctaaaatatatacatatgagctttatgatgaagtaagggaaaacagaggattaaatagcagtgaagatttatataagaactattatgattttatatctcagctaacagatagaggtctttacggaaaatatatattagataattacacaaaggaagatatacttgaattggaaaagacaataaaaccagaacgagattttctttttaattatagcggaataaatcttctatctaagagatatttggttcaagattataatagaaatcctgttgaattgcctcagcagatgtttatgggcatagctatgcatcttgcaattccggaagacaagtctaaaagagtgtactgggcaaagagattttatgatgtattaagttcattaaaagcaacaatggcgacacctactatgtctaatgcaagaaaaccattttatcagttaagctcgtgctttattgatactgtagaagatagtctagaaggtatttataagtcacttgataattttgctcaagtatctaaatttggtggcggaatgggaatatatatgggaaaagtaagagcactaggttcttcaataagaggatttaaaggtgcttcaggtggaataattccatgggtaaaattatttaatgatacggcagtggctgtagatcagctaggagttagaaatggatcagtagctatatggctagacgcatggcataaagatattccagagtttttacagataagaacaaataatggagatgacagaaaaaaagcacatgatgttttccctggtttgtgttatccggatttattttggaagttagcagaaaataatatagactcagattggtatatgatgtgtcctcatgagattaaagaaataaagggttattcacttgaagatttttatggagatgagtgggaagaaaagtattatgaatgtgtaaatgatgaaagaatagaaaaaagagtaatgtctgtaaaagacatagttaggcttataattaaaagtgcagctgaaactggtgctccatttgctttttatagagatactgttaataaaatgaatcctaataaacataatggaattatttattcgtccaatttatgtacagagataatgcagaatatgagccctatggaaataaataaatcagaaataattaatgaagatggttcatgtatagtaactcagaatataattccaggagattttgttgtttgtaatctttcatcagtagtattaggaaatatagatgtatgtagtgaagaagaagtagagtatgttgttgaaactcaaataagagctatggataatgtaattgacttgaattattattctgttccttttgcagaagttacaaataagaaatatagagcaataggtcttggaaccagtggatatcatcacatgctagcgaataatagaatccattggacagaagaaaaacataaagactttgcagatgaagtatatgaaagaattaattattatgcagtaaaagcaagtatgaaaattgcaaaagaaaagggtgcgtataatttattcaaagaatctgattgggataatggagattattttgaattaagaggatataaagatgaaaaatggtgtgcattaagaaaagagataaaagaaaatggaatgagaaatggatatctcttagcagtagcaccaaacggttcgactgcaaccatagcaggaacatcagaaggaatagatcctgtaatggcaagattttatttagaagaaaaaaagggaagtataattcctaaaacagctccagatcttaatgatgataattattggtactataatccagcatataatatagatcaagggtggtctgttcaaatgaatggaatacgtcaaagacacatagatcaaggtcaatcttttaatttatatataaccaataattatacaatgagacagataatgaatttatatattgaagcatgtaaatgtggagtaaaatcaatttactatgttaggtctaaatcactagaagttactgaatgtgaaagctgctcagcttaatttagttaacagttttgtatgaaatatttatgaaagtttcattggagtttatatgttttttaagaaaggcttagcctttcttaatttgacatgatattcatttaaaatacaaaaaaatttcttgggaaataataataatagaaaaaataacaagaatattgaaattagaaacttcatttttcaatacatgaataaaatacatcaatgaataggagtattaataatgagtataaacaagaaacctctttttaatgaatttggagatagggaaatcactaagaagagacttataaatggtaatacaaccaatttaaatgattttaataatatgaagtatacatgggtttcagactggtatagacaggggatgaataacttttggattcctgaggaagtaaacttatctcaagatttaaaggattatcaaaacttattagatgaagaaagaattgcatatgataaaatattatcttttttgatctttttagattcaatacaaacagcaaatttaagcaatataaataactatataacagcaagtgaagttaatttgtgcttgacaatacagagttttcaagaggctgtgcactcacaaagttatagttatatgctagatagtatctgttctcctgaaaaaagaaatgaaatattgtatcaatggaaagatgatgagatattgctaaacagaaataaatttataggagacttatataatgaatttatagataaccctacagaagagactctattaaagacacttatggcaaattatattttagaaggaatttatttttattcaggatttatgttcttttacaacttagagagaaatggaaaaatgcctggatcagctcaagaaataagatatataaatagagatgaaaatacccatttatggctttttagaaatattataaaggaacttcaaaatgaaaatgcagaattattcactgagaaaataaaaaatgaacttagagagatgatgaaaacaggagttgaacaggaaattctttggggacattatgttatcggtgataagattcaaggaattaataaaaaattaattgaggaatatataaaatatctaggaaataagaggttaaaggaaataaatcttgaacctttatttgaaggacatgatgtaaatccagcaccgtgggttgatagacaatctaatgcaaattctgttaaaacagatttttttgaggctcgttcaacagcttatgcaaaagctgcaacattagtagatgatctataaaaaaccaatgtaaaaaaatgggaaagtgatataatgttaatatatccaaaattttttggggatttttacgaagaatttatataaaaaactacaaatcaagttaaattctcataaaattatggtataatggtaatggtttaaactcaaataaaaactcacaaatatgatgaggaaaaaaacaaaaactttataataaaattaactatcaaggaggaatcccatattatgaaaaaaggtattgctgcttctaaaggatatgcaataggtacagtattcttacaagaacatgaagaaatcgttataacagatgctaaaattacagacgtagctgcagaaaaagaaaaaatgcaaaaagcattagataattctagatctcagctagaagcaatcaaagctaaggctgcagaagaaatgggagcagaaaaggcagaagtattcgaagctcacataacattattagatgacccagaatttactggtgcaatgatgaatgaaatagaaatgaacagtataaatggtttaaaggctattgaaagtgttacaaatacatttgttgctatattcgaatctatggataatgaatatatgagagaaagagcagcagatatcaaagacgtatcaaagagaatattatcaaactttgcaggaaaaggcggagatgattttgcaattactgaaaataatacaattgtagttgctcatgacttaacaccatctgatacagcaggattagatagaagcaaagttgtaggatttataactaatataggtggaagaacttctcatgcagctatcatggctagaacattagaaataccagctgtacttggattaggagacataactacttctgttaaaagtggagataaagttatagttgatggtattactggggatgttattataaatccttcagaagaagtactagctgaatatgtagctaagaaggaaaaattccaagctgaacaagaagaattaaagaaattaatagatgttaaaactactactaaatcaggtagaagaatagaagtttgcggaaacatcggtaagccagaagatgttaatggtgttatagcaaatggtggagacggtgtaggattattcagaactgaattcttatacatggatagagaaagcgctccaacagaagaagaacaatttgaaagttacaaatacgttcttgaaaaaatgaatggtaaacaagttgtaataagaactttagatatcggtggagataagactcttccatatttaccattaccagaagaaatgaatccattcttaggttacagagcaatcagactttgcttagacagaaaagaaatattcaaggttcaattaagagcattattaagagcttctatatacggaaatctttgcgtaatgttcccaatgatttcaggtcttgaagaattcttacaagcaaaagaagttgttgatgaatgtaaagcagaattaaaggcagaaggtaaagaatactcagaagctattcaatggggtatcatggttgaaattccagcagcagcagtttatgctgatgaattagctaaacatgttgacttcttctcaataggaacaaatgatttaattcaatatacattagcagctgatagaatgagtgaaaaagtatcatacctttataatccaatgcacccagctgtattaagattaataaagatgactatagatggagctcataagcatggtaaatgggttggaatgtgtggagaaatggcaggagatgaagctgctattccaacattagttgaatatggcttagatgaattctcaatgagtgctacatcaatattaaatgctaagaagatcatgttagatcaagaatagtatttagaattatataaagttggtaaacataattaaatgataatttgctaactaataaaaatggctatccaaaaaggatggctatttttatttgtaattataggtatttatagaaatgtaaaactaatagatgttagtttataagatattgaagtaaaaatatatattactaacatgtattagtttaatacaggggttagattaattttaattattacttactcactaaaaatgagatataataaaatcatgttatttttataatggtaaggggatatttatgaagaatgattacataaaacagtacaataaagctatgaacttttacaataatggtcaaatgaatcgagctttagaaatatgtgaaaatatattagctaatgatttaagttgttcagaagttttaaatttgaagggacttatgttatatcagaagggtctattaaaagaagcaaagattgtctggaagcttaattgtgatattaatactgatagcgtagctaaaaagtatatagaagactgtaaaagtgatgatgagagaatagaaaaatacaaagatgctgaatataatttaaaaaatatgaatattgataaagcaatgatgttgtttagagaatgtatggaaagtgaatttaattccataaaagttaacacaggaattgcaatgtgttatatgagaaaaggagacaattacagggcgaaagaatttatagacaaggctttacatatagataatgaagcggtgacagctaatgcattaaaaaaggatttgataaatttaggtttatattcgaacgagaatagagtttctaaaaaagttttatcagttattactgttttatttattattggagctatttgtgtaggtggatattctatatatacaaaaacaagtttaaataattcaagttcaaaagattcatcttcgaatactgaagaagatataaaaaaggatgaattattagattctgatagcaataaggatacaaatgattcatattcagataaagaaaatcagaacttagaaaatgaacaagctgataaaaaagaaacaatattcaataatgaaaatgtagcgttattattgaaaaataaagatgtagataaactatatgatgaaataaatatggttaataaagaaacactttcaggtcaggatttagaactttataataatgcaattgagttattaaaaacaaatggagtttcaaagttttatgaatatggagtatggtattttaataatggaaattataattctgctaagattgaattagaaaaagcttataaatattgtgataaaagtgacttgaaagagcatattgtattttataaaggaagtactgcatctcaacttggagataattctgaagcattaaaactttataaagaatattatagtttatatccaaaaggtgcatatatagaaggcgtgttgtatgaattagcgcttctaacaaatacaacaaataaggatatgggaaaagaatatgcaagagagcttgtaaataattatccaaattcgctatacataaatgattatattagagatatagtaaagtaaataaaattaaatagaagacataataaaatctcgagattaatagttattttatcttgagattttgttatattaactttaatcataggataagctaaatatataattaaacttttgatgaggagtgtgaaaaagttatgatatctttaattaaggggtgtagggtatattctccaaatgatattggtattaaagacgtattattagcaggaggtaaaattgaaggaatatatgacaatatagaactaaaagatgatttattaaagattaatattattgatggaaataaaaaattaatgttcccaggatttattgattcacatgtacatataataggtggcggaggtgaagggggatatcatactagaacacctgagatacagctatcaagtttgattgaaagtgggataacttcagttgtaggatgtattggtacagatggtgtatgtagagatatgaactcattaattgcaaaagttaagtctttaaaagaagaaggcataagtgcatatgcttatactggatcatatgaagtaccagttaaaacagcaactgaatcaataaaaagtgatcttatgctaatagatgaaataataggtgttggggaaatagcgttatcagatcatagaagttctcagcccagttttgatggtttcgtaaatttagtagctcaaagtagagttggtggattattatctaataaagcaggaatagtaaatgttcatttaggcgagggtatgagaagactaaaatatctttttgatcttattgaacagacagagataccagcagaacagctccttccaacacatataaatagaaatagtgatttgtttgaaatggggcttgagtatgttaaaaaaggtggatatattgatttaacaacaagttgtgatttagaacatatggaaaatggtgaattaagagcaggagaaggattaggtgtatttttagagaagggaatggaaattgaacacatgactttttcgtctgatggaaatggaagcatgcctagatttgataagaatggtaatcttgcaggtctcggaatatgttcagtttcatcattatatagggaagtaaaatttgctataaaagaatttaatgttccgatagataatgctatttctgttataacatctaatgtagcaaaattattaaaattgaataataaaggtagaattgaagaaggaaaagatgcggatcttgtaattgttgatgaagacaatttagagatagatattgtttttgcaaatggcaaaaaggtagttgaaaaaggaaaagcagttgtaaaagggacatttgaacagtaaatattattaaaaataaataaaaggagctatcatataagtgataagctccttagtaagttaaactaagttttaattttgaagaatgtatgatgacctattgtagtctgattaaatttaggtgtttgcttcatccaattacaagttgctgtacttggattataaaaaaacaatgcttgattagtaggatcataaccctttatagcatcatatacagcgttatagcaatcttgatttgttttagcatttatctgaccatctttaacacatgagaaggcgtttttttgaaatataactccttgtattgtgtttggaaaacttggatcaagagtacgatttaaaactactgatgcaactgcaacttttccttcatatggttcacctatgctttcagctgaaaccagctttgccattaagtctatatcttctcccgttatatataattgttgattattatgtttaaaaacttctaaaacttcatctgtttcttgagtatttagtgatatatattgtatattctcagtcgaactgttttggactattttattatttgaattttcattataggtctcacctaaagtgccagcataaactggtcttatgttaataacggaaaggtatagtattaaagcaataacaaaaatactacatgtctttttcataaaaaacctcctttggtatatgcgacaaataatattattaccaaagaaagtaattatatacatggtcatattttataaactaatgaataaatacagaaataaaagattaggtgaaaaaatataatttataaaaataaaggaaatactaaatttagatgattttattctatttaatttttgtatattacaaacgtatttaagaaagttttaggataaaaataattaaaaagtaataaaatagttttttgtatgtgtgtaagggaatgagatttgttgtataattttattggaagaatagaagagaggtgagataaatgaatgaattaataagtgccatacaaaagggtttttcacatatgtcgttgtggtctgctttagatatactagtggtatcatacatattttataaaggatatatgttaataaaagaaacaagagcagaacaactgttaaagggattaatattattaatagttctaataccaataagttatttattaaaattagatatgctttattttatattaaataaaacattgactatcggagtgttatcggtagtaattatatttcaacctgaaattagaagagcgcttgaacatttgggaagatctgcatttgatgatattcatggaattcaagatgaagaaatcttacataagataatgagtgagattacacatgcagtagagaatcttgctgaaacaaaaaccggagcacttatagtaatagagcagagtacaggtttaaatgaattagtatcttcaggtacattaatagatgcgaatataacctcaaaccttctagaaaatatctttgtggtaaatactccattacatgatggtgcaactataattagaaatgataggatatttgcgtcaggatgtgttttacctttaacaaataataatacaataaataaaaaacttggaacaagacatagagcagcaattggtttatcagaagtatcagatgctttaataataattgtttcagaagaaacaggaataatatctttagctatgaatggaaaaataactagaggatatgaaagagagagattaaatactgttttagtaaaagtaattgaaaatagatataaaagtaaacagagagttaagacggctagggagaaggtgaagttatggataaaatcaaacataaaaataaaacgctgatacctaaattgataagtctattactttcgcttggattatggatttatatatcaaatgttgaaaatcctatgagaacatatgaagtaagaaatattcctgttgaactggttaatttagatagtcttaaaaattcaaaatttgctgtttcgggtaatcagaactttactgttgatttaaaacttgaaggaccatcaacggatattgctaaagtaaagccggaagattttaagattgtagcagatatgtctacttatgcattgaaggtaggagaaaacacagtaccagtacaaataataacttatcctgaaaatattattataaaaaataacggttttttgggcataaaagttaatctagaggaattagttacaaaaaacttttcaatacaatcaaaagttaaattaaattataaagataatatatacgaaatgagtaaaaaaatagctcctgatacggtaactgttgaaggcgccaacagtaatgttggcagaataaactcagctgtaatagttggcgaggaaaatggaatatcgggaaattttcaaaagagttttgatataaaattaattgactcaaatggagcagaagttacaggcgttacatctagtattgatactgcaaaactatcagttgaagtttcaaaggggaaaagtgttccaataaatttaaaaactacaggagaactcaaagctgggctagaattaaaaggatacgaattaagttctaattatgtaaatattactggagttggagatgctttatcaaaagttcagtcaattgatactgaggctgttgatatatctaaattagaaaaaacaggagagcttaatgttaaattaatagttcctgaaggtgtaactgtagctagtggaaatgaatatgtgaaagtcaatgtaattttacaagcaaaggaaaataagcctgtagagaatgtaactgaagaaaatataagtaaaaatttaagtatagcagttcattataataatttgaaagatggactacttttagaatcatcatctgagaaagttaatgttacaatatctgggcttaagtctgaattagataaaattacagaagggtcattaaaggcttctgtagatttatcgagtactacagaagagggttcatattcatacaagccagaagtatcatttaatagtcctacaacagcaacagtaagtacaattgaaaatgtagatgttgttgttaaaaagaaagttgaataattataataatggtggatatattttatatccacctattgttattttaaggcttatttacagatgtatgataagtgtgatttatgatataattatgtaactcattttatagtaatttgaaaggaaaacggtgattgtaaatggccataagaataaataatataactttaaatttagatgatagtgaagaaattttagagaaaaaggtatgtaagaagttaaagatagataaaaatgatataaataaattgattattataaaaaaagtatagatgcaagaaaaaagcatgatataaaatttaattattgtttagatgtaatatgtgataaagaaaaaaaattctttcaaaaatacatgataaggacgttaaatttgaagaaataaaagaaagagaactaataactaaaggagatatagaattagaatcaagacctgtagttgtaggatttggtccggcaggaattttcgctgcattaacgttagcacgagaaggttataaaccagttgtgtatgaacgtggggaagatgtagataaaagaactgaaactgtggataagttttggaaaactggtaagttagatactgagtctaatgttcagtttggagaagggggagcaggaactttttcagacggaaaattaactacaagaataaaagattttagatgtacttttgtacttgatgaattaataaaagctggagcaccagatgaaattaaatatgaaagtaaggctcatgttggaactgatcttttaaaagatgttgttaaaaatataagagaagaaattaagagtcttggaggagaagtacattttagttctaaagtagaaaaaatagagtatgaagatggaaaacttaaatatatagttgtaaatggtgaaaaaaggccttgtcaggcacttgttctagctataggacatagttcaagagatacatatgaaatgttaaatgaaaagggcgtttcaatggaagcaaaagcttttgctattggagttagaattgaacatccacaagaagtaattaattttagtcagtatggagaaagctataatcatcctaagttacatgcagcagattataggcttacatatcaaagcgaacgtttaaaaagaggagtttattcattctgtatgtgtccaggaggggttgttgttgcagcatcttcagaacatgaaagattggtttcaaatggaatgagctatcacgctagagatcttgaaaatgcaaactcagccttagttgttactgtatctccagaagattttgagggagattcgccacttagaggaatggaattccaaaggtattatgaaagcttagcttttaaattaggtggaggagactataaagcaccagttcaacttgtgggtgatttcatgaatgatagagtatctactaagcttggaaaagtgaaaccaagttatacggcaggttatgtatttaaagaacttaaagactgtcttccagattatgttatagaagcacttaaagaaggaatacagaattttgataaaaaaataaaagggtatggagatgatgattcggtgcttacaggaattgaaacaagaacttctgcaccagtaagaatacacagaaatgaaactctagaaagtattaatgtagaaggtctatatcctacaggtgaaggtgctggatttgcaggtggaataatttcagcagcagttgatggaataaaggttgcagagcatataataaataagtatagggctccacaaaaatagtatgaaaaaattgttaaaataattacactctgttttgtgtaaaattaattattaatttttttgtgtaatataaaagctgttatcttttaaagatagcggctttttatttggattattaataaaaaaatacataaaaattacagaaatattaaaataaattttcagaaaatttagcatttaaagttattttttgttacaatagtattataaagaaattattgacataaatttgattgatataattttaacaatgctaagtaattaaatttaaataaagaggtgcaagaaatgagtaaaaattttgatgatttattttcaagattacaagaaattgaaactaaaaaagtagctgttgcagtagctcaagacgaacctgttttagaagctgtaaaagaagctaatgaaaagggaatagctaatgctgtattagtaggagataaagataagattcatgaaattgcaaaaaaaatagatatggatttaactaaatttgaaataatggatgttaaagatccaaagaaagcaactatggaagcagttaagcttgtatcaagcggaaatgctgatatgttaatgaaaggtttaatagatacagctacatttttaagaagtgtattaaataaagaagttggtcttagaactggtaaagtaatgtcacatgtatctgtatttgaaatagaaggatgggatagattgttcttcttaacagacgttgcattcaatacttatccagaattaaaagataaagttacaattattaataatgctgtttcagttgcacatgcttgtggccttgatatgccaaaggttggggttgtatgtccagttgaagttgtaaatcctaatatgccatctactgttgatgcagcattgcttgcaaaaatgagcgatagaggacaatttaagggatgcgttgttgatggaccatttgctttagataatgcaatatctttagaagcagctgaacataaaggcgttaaaggtgaagttgcaggacaagctgatattttagtgatgccaaatattgaaacaggaaatgtaatgtataaaacattaacttattttgcaccagcaaaaaatggatgtcttttagttggaacatcagcaccagcaattcttacttcaagagcagatacttttgaaacaaaagttaattcaattgcattagcagcattagttgcagcaaaaaataaatagtagaatattaaatgtaaactttaggatataattcttgggaatttatattaaatcacagtgtagatagattttaatgaaaatatggaggaaagaaaatggcttacaaattattaataattaatccaggttcaacatcaacaaaaataggtgtatatgaagatgaaaaagaattatttgaagaaacattaagacatacaaatgaagaattaaagcagtttgatgcgatttttgatcaatttcaatttagaaaagatgtaattttaaaagttttaagtgaaaaaaactttgatataaaaacattaagtgctgttgttggtagaggtggaatgcttaaaccagttgaaggtggtacttatgctgtaaatgatgcaatggtagaagatttaaaggtaggagttcaaggacctcatgcttctaacttaggaggtatacttgcaagatcaatagctgatgaaataggagtaccatctttcattgttgatccagttgttacagatgaacttgcagatgttgcaagattatctggtacaccagatattccaagaaaaagtaagttccatgcattaaatcaaaaggcagttgcaaagagatatggaaaagaaagtggaaaaggatatgaaaatttaaatcttgttgttgtacacatgggtggtggagtttctgttggagctcacaatcatggaaaagttgttgatgtaaacaatgcacttgatggagatggtccattttctccagaaagagctggatcagttccagctggagatttaattaaaatgtgttttagtggtaagtatagcgaatcagaagtatacagcaaaatagttggtaaaggtggattcgttggatatttaaatactaatgatgtaaaaggaactattgataagatggaagctggagataaggaatgtgaaaacatatataaagctttcttatatcaaataacaaaagcaattggagaaatgtcagctgcattaaatggtaaagttgatcagatagttttaacaggtggtattgcatattctccaacacttgtaccagatttaaaagctaatgttgaatggattgcaccagtaacagtatatccaggagaagatgaattgttagctttagctcaaggtgctataagagttcttgatggagaagaaaaggctaaagtttattaatttcaattttatatacatacttagtgttattattactaagtatgtatttttttttttttgaatttttattttgtcatttaaaacaggaaaaaatggaatttataaaaatgaatttgataattctagctactaattattaaaatcttaaatataactatcacttttatcaaatttaataatatgaaaaaaaatacggtgaataataataataatgttaaatttgtctaaaaagtaagtatcataatagaatgaattttagaatatatactaattatgtgaagtattttaaatattaatcatctttttaaattaagtatacattgacaaaaacaaccagtattgttatactaaaaataataacgaaatgatagaaaatcgttaaaaaagtaaaaataaagttattaaattactattaatttaatacttatattgaaatttaagcaatgattttaaagttacagaacttacaatatcatattatagaagctgtaagtaatgcaaatttaagacaataataatttatctttttgggggttgtataaacatgaaagacgcaagaattttttatcaacaagactgtgatttatcattattagatggtaaaacaatagctgttattggttacggaagccaaggacatgcacatgcattaaatgcaaaagagtcaggctgtaatgtaattataggtttatatgaaggaagtaaatcttgggctagagctgaagatcaaggatttgaagtatttacagcagctgaagcagcaaaaagagctgacataatcatgattcttatcaacgatgaattacaagcatcaatgtataagaaagatattgaaccaaacttagaagctggaaatatgttaatgtttgctcatggtttcaatatacatttcaatcaaatagttgcacctaaggatgttgatgtaacaatgatcgctcctaagggaccaggacatacagtaagaagtgaatatcaagaaggaaaaggtgttccatgcttagtagcagtacatcaagatgctacaggtaaggctttacaaatggctcttgcatatgcatcagcaatcggtggggcaaatgctggtgttcttgaaacaacatttagaacagaaacagaaacagatttatttggtgaacaagcagttctttgtggtggtgtttgtgcattaatgcaagctggatttgaaacattagtagaagcaggatatgatgcaagaaatgcttactttgaatgtatccatgaaatgaaattaatagtagatcttatttatcaatcaggttttgctggtatgagatattctatatctaatactgctgaatatggtgattatattactggaccaaaaataatcactgaagaaagtaagaaagctatgaaacaagttctaaaggatattcaagatggaacttttgcaaaagatttcttattagatatgtctgaagcaggcggacaagctcactttaaggcaatgagaaagttagctactgaacatgagtcagaaaaagttggagaagaaatccgtaaactttacagctggaataacgaaaacgacaagttaataaataactaatagttaaaattagttgtattttataaatatataaaattagaagctattatactttaattagaaagtataatagcttttttaacatttattaataagtgattgagaaagttaatttagtaaagaatagaacgaaattatttacaaaaattaattcaaatggtataatttattaataaatttaataaatagggctatggcagtactaagagtaaatattcaaatttaaaagattgaatatttgtttttggtactttatttttttggggggtctgataaatgaatataaaaatgaaatatttaatgaatcgaaaattgcaaaaacattctatgaaggcatttgaaggaatttcaaatggaaggaaaaaggcattagataactggtttatagataaatgggctcagatagataatataaaaaattctcttacagcattagagaatagtgatgagataattaataactatctatataagttagttcaagaatatgaagatttttgtgagatatttatattagatcaaaatggaattgtaacagtgtcttcgtgtagcaagcatgtaggtttagatatgagctatcttcctaactatatggcaggaaaagaaaatagatcattaatgtatgggccatatatagatgaaaaaacattagaaattgatattagagaaaaaagtttcgttgatgaagttacacttatgttttcatgtgtatgtaaaaatcaccatggagaatcaaggatattgtgctgtaggacattaaatgatgatatgagtaatgttattcaagatgaagatactcatatatataaggattctggtgataattatttgtttatggttaagtctaatagaggtatagaaccaggaacggctatttccagaagccgctttgaagataatacttttactttaggtgaaaatcttaaagatggagtgaatacaaaacagtggggaaaagttaaaatagaaaagcatactgaatttgaaataatatttaaagatccggcaactaatgagcttcatcaaggtgtagcgaatactataaagaatggtgaaaatttagactgttggccaggttatccagattataggcatattatggtaggaggaaaggggacaataattacacctcctaattgtgatgaagtctgggggatgatgtgtgaaggcgatattgatgaaatttatgactttaaaggcgtaaattttaaaataccaggatacatatcactaatatcagcaattctattatttggtacggaagttttaagaagtataatacctgatatgggtatattagcagtagttttagaatggctgataatatcaatattatcagtagtaatatgtaataaatacataaaatcaccattaaataagacacttaatatattacaagaaatagctgagggagaaggcaatttaactaaaagagtagataagctttctaatgatgaaattggagaattatctagatggtttaataaatttataaacagtcaaatgactattttaggaagagtaaagaaatcagtaaaaactactaaaaattcggttggaattgtatctaagataacaaatgaagttaaagatggtatgtttaaaatagaagatacagttgtaaatcttcttgaaaattccaaagaacagaattcggtatttcaaaatactagagacaaattttatgatataactgcatctattcaagaaatggatagtttaatattagatatttcatctattgtacaagaaacaaatgatacttcaataaaagcaaatgaatcttctactggagtattaaataatatgaaggaacttgaaacagtaataaagaaaacagttttagcaattgaaaatctaaagaagaattctcaagaaataacaaatgtaatgaatttaattagcgatataagtgaacaaacacaattgttagctttaaatgctactatagaagctgcaagagcgggagaagagggaagaggattttccatagttgctagtgagatatcaaaattagcaactgaaagtcagcaggcaacaaaatctatagataatataataaattcaattcagaaacagacacaatgtgcgtttcaatacgcagaagatatcaattctaaagttgatgtttctatgaaaaatgtttcagaatcaattgaatcatttataaaagtaaatgaagatataaacatgatatcaaaatctatgagcacaatagcacaaataacttcaactcaaagtagtgatgtaagtgatgtaatgaataatgtcagtataatggctgataaagttaatgaagcgactgaaaatagttcaaataaaagcgaagaatctctaaatgtagttaaaaatatacttttagaaattaaacagttaaacaatgctacaaatgcgttagaatattcatcagaaaatatggatgaaatgataagttcgtttaaattatcataaaacaatacatattatggctaatattactgcattagtaattgaaatataacttgaaagaaatttataaatttgataagataattaataagtgaataagatgcctaagggctataaatttttctgtttctgattcaaacagatgaatttatagctcttttttgcgcttctaaaaattaatgtaaggaaaggaagaaaatatgaacaaaagtaaaaatgtaatggaatcaaaaccaatattaagcttacttcttacaatgtcggtacctccgataatctctatgctaatacaatcaatgtacaatattgttgacagtatctttgtagcacaaattggagaaaaggctttaacagcagtttcattgatatttccccttcaaaatatggtttcagcagttgccattggatttggtgtgggattaaactcatgcatagctattaatcttggtgcaaagaataatgaaaaaataaacagagcagtttctaatggaataattttgacattaatacatggaataatatttattttagtaggaatgtttttaacaaaaccttttttaagaatgtttacaaatgacccagagatatttaaatggggatatgaatatggagttattgtaatgtgttgttcaataggaatattgtatcagctcgtattagaaaaaatgtatcaggcaataggaagtatgattattccaatggtacttcaaattgtagggtgtattataaatatagttctagatcctatattcatatttggagggtttggaattccagctatgggagttgttggagcagctattgcaactgttataggacagatgtctgcattcataatatatgtaattatatttagaaaaaataatcatggaataatagtatctttcaaaggatttaaatttgataaggagatagttaagagtttatattcagttggtcttccatcgtcaattatgatggctctcccatcggtattagtaagtgttttaaatggaatattagtaacgttatctcaaagtgcagttgcatttctaggaatttattttaaacttcaaacttttgtatatatgccagcaaatggattactacaaggtatgagaccaattattggatataattatggagcaaaagagaaagagagaatgttaaaaacaataaaaacaagtattgctgtagtaattatgattatgatattaggaagctgtatttcaatatttttcccaagttatatattaaaaatgtttaatgcagaaagtgacctaatggcattaggtatcccagcattaaaaattataagtacaggttttatattttcagctatacctatagtgttttcgggagtatttgaaggtattggtgatggaatgcgatctttaactataacattgttaagacaactagttatcataattccagcagcaataattcttgcaaaagtttttggaataaatggagtttggatttcgtttccattatctgaatttgtagcaatgattatttcaatggtgcttatgaaagtaaagttaagaactattgatgtataatacttttaaatttagaaaagataattaaaaatacaattatattggagcatattatggagaaatgtttatattgtaaaaaacaattggatgataaatatgtatcaaataaagtagggaagttttgtaatcaggagcattatgaaaaatttttgaaatcattgagcagagaagaatatattgaacttcagaactcattttgtgtatgtagcgatgagtgaaattgattaggttaaacaatagaggttgtataagcatagtagtataaaaaatttatactactatgctttaatttatttactattaaatttataaatcttatggaattaaataaaataaatgtaaaaatattcttgacaatttatgtttacagacgtaaactgaatatataatttacaattgtaaactaaaaagtaaagaggtgtaaatatgactgaaattcctaaaatatcagaatcggaatgggaagttatgaaattactctggaataagagcccattaacatccgaggaaataatttgctgtctcagtgaggataagaagtggacaaagcaaacggtaaagacatttataatacgtttaactaaaaaagctgcaatagggtatgaaaaagaaggcagaatatataagtactatcctttagttgatgagaaagactgtagaaaatatgagaataaatcttttttacaaaaagtctatagtggatcattaggtgtgttgttaagtaactttttagaagaggaaactttatcaacaaatgaaattgaagaacttgaaagaatacttaaggaaaagaaagaggaaaatttgagggataattaataggggatataagaggagtgcttatataatgagatttttagaacagattttcttaatcgtgtttcaaacatcattaacagctggaattatcatattaataatttttgctattttaaaattatttaacaataatctgaatataagagttaaatatctgttgatgagtttgatactaatcaggcttgtagtacctgtaacaacacaaaccaatcttaagataaacataagtgaagttctaaagactattcaaggaaataatcaaaataaattatcagaggaatacactagtaattcaaaaattaagaaggatgagattggaacaatcaataaagaacccattacaagtaatcatgacaaattaaatgtaaagaatgatcaagttcagaatcaagtaaatgatattttaaaaaatattgtagatgcaggagcaataatttggtgtggtggggtaggaattctaacgtgtatattaatgatagtattaattaaatttaaaacagaatccaataatatggaaagaattaaagatgggaacattataaaaatactaaataagctaaaacggaatgtaaatttgaagagtaatattaatgtgtatatatgtgatgagaaaaagagtccgtgtattttaggatttataagacctaaaatatatttgccacactatgttttagaacttgatgaagatatgatttctcatatcttattacatgaattaatgcattataaaaggaaagatttatatattaattttatttgttggattattctattacttcattggtttaatccgttagtatggatagcgctaaagaaattaaaaacttatagagagtatggatgtgattgttttgtacttcaaattcttggggaagaaaaaaatgtagattatggcatgacgattatcaatttatccaaaatagtaactaataaaagaagtattcagttaggtcttgggtttgaaagaaataacttaattaaggggagaatagaaatgataaaaagttttaaaaatgattcatataagatttcagctaaagcagctttaggatgtctagtggcggcagtagttgtatgtacaaatggtattactgttaatgccttagatgtaaacagtgtatctagcaataatgcttacaatcagacaagcatagaaaatagacatgaatttttaattgatagtacattaaagtcatatgatgatttaaataaagtaaaagaagtttcaggatttgaatttaaacttccagactattcgttaggagatgggaaacttgattcaatatatcaggttataaagatttcagatgatagtaatgtaatagatgcgcattttagagatggcgatagtaataaaaatcttacattagaaatatttaaagatgatccagttgaagctttaagcaaaatttacgaaagccataatcgttttggtagaagtaatagcaaaattgaggctagtaaagaacaaatgaatgttggaagtgtttatggtaaaagtattactttaaaaataactactccagaaagagctatagataatcagatagttcctgagtcaattgatgaaggtaaatattttgtatgggagaatgatggaatattttatgctataccatatgcaaatagatatgaaaacaatggacaagttaaacaagataataaatttgaaaatgaagaattagataggatagctagttcattaaagaatatagatgaaataaaagatgttgactatttatcagtagttcctgaggaattatcaacagagacaggaataatgaatatttatgataaagatgatcttaataaggcacaaaaaatacttggatttaatccgaagatgccattaactattaatagcataaatatacaagattcaatggtaggaattacaagtgattctgatgtagaaaacaatactataaattatgaattaaataacttttataaagatggtaaaaatatgattacatttagtcaaagcaaacatgatacttttaatagatatgctaccgctaaggataaaggatatatttatataaatgaaactaatattaatactgaaaaaatctatatagatggtaatgaagtgtatagagatatagaaaaagatatagatcaagaaaattctaaggaaacaataagtgtagattatttttggcagcaagatgatatttattatactctgactatattcaatatagatggatatcatgatgaaatagcaaaagaatttattaattccaaaactatagactagaaataaggtagccaatagttaggaggtaaactattgaaaattttagagcaattattcttgaattttttagaaacttcattaacaggtacgatttttatattaactgttttgtttatatttaaaattttcaataagcagataaatgcaaggattaaacatatattatgctttttgatactattacggattcttgtgcctataaatccatacattgatattagttttgcacacatattgcgtagttatgataatgttaaagaaactcaagaatataatgatagagaatttaaaggaatgccatatgataatgccttgaaatccaatgatattttaaaatcagacgaaattgaaaaaaacaataatatttatttagaaaataatttaacaaattcagatggagttgaagaatataatcattctgtaaatatattgtatatatctactttgatttggagtttaggtgttgtaatagtagcattagtatttaatatgtcagttattaaatttaaaatattttcaaagtcagcagaaaaaattaataataatgaaattgaacaatatatgtacagtttaataaaaaataaaaacttaaaaagaaatattcttatttatatatgcaatggaatggatagcccatgcataataggaattattaaacctaaaatatatttgccacaatatattttgaagcttgataaggaaacaataagacatgtacttcttcatgagtttatgcactataagcgaagagatttatacattaattttttatcaggaattttacttgcttttcattggtttaacccattggtatggatattgataggtaaaatgaagatttatagagaatgtgcatgtgatttaagtgttcttgagattttaggggaagatagcagtattgattatggaatgacaattataaatttatctaaaatgttttttaataagaataatttaaatgctagattggagtttaaaggaaacaataaaattagggagagaatagagatgataaaaaggtttaagggtggatcatataaaattactctagcaaccgctttgggatgcatgttagttacaacagttctatttacaactggtattaaagtaaatgcattgaatttggataatgaggggaagggtaataatcaaatagatacagaaaaagttacacaaactaatatagatgataaacatgaatttctaattgatagtgatacaaagatttataatgatatagataggttgaataatgtgtttggagaaaattttaaattgcctgattttacgttagaaacattacctaagatgaaagaacttataaagatagatgataataaaaatgcagttaagatatttttctataataaggattatgatattagtaaagattcatttacattacagatttttaatggagatgtattagaaggtttgacaggggtggaaaaatcaacatttaatgaaagaattcaacttgataagctatcattggattatcaatttaatattgaagaaaatttcgataaaattgatggattgtatggaaaatgtattacaactactattgttgatgatgattttgaaagaataaggaaatattattcatggaatgatggagatctttgctactgtataaagtattatcagctaacaaagataaatggagagataactgatgaaaatagcatatcattagataatattaaaaaaatagttgaatcatttaagaatttggatgagttaaataatatagattataaatttaatatgaaaaatcaacagaaagctggaatattgagagatatatatgataaagaagatttaagatatgccagtgatatacttgggtttaatccaaatatgccactgcaaattaatggagaaccaattgaatttgctgaactgtcggttacaacagattctaatgtagatgaaaataatataaattatgaaatgtacaattgttatagttataatgaaaatagtattttgctttttactcagagcaggcatgatatattaaataagtatactaatgcgaaatcaaaaggatatttttatgataatgataaagttagtgttgaaagtattaaaatagataataaagatattttaagatatagtaaatattatgataatggaaacaattctgatttaagagatgcaggatatatgtgggagaatgatggaatttactattctgtaactatatctaatacagatggatatcatgatgaaatagtaaaagaatttatagattcaaacccaatagaatagaagtatgattttaaaagttaaactggacaatttaatatgtttggtttagctttttatttttaggtaataattttacagtagatagtagtatatatgttaaaattatcatataaaaccttaattgaggatttaagttactaagcaatatgctatattttagaaggagttttaactatgagaagttcattaaattttacaaataagttaagcaagcttgctgagatggagaatgactcaatatttcaaatattagaatacgaaaatttagaaggtgctacagatgtagaatcagcatttggactaaacataattagggaaagtgggataaagcttaaacagattagaatagctttagaaaatagtagtgtgatacttgagccaggagctttgagttatatgaaaggaaatataaagataagtagtaaaacaggtggtgtactaggatttggtaaaaagcttatttcaagtaagcttactggtgaaactgtttttaaaccaacttatagcggtacaggagaaatttttttagaaccatcctttggaaattttgctttaattgaacttgaagatgatgaaataattgtagatgatggattgttttttgcatgtgaaagtagcgttgaagttggagttactattcagcgaaacttatcagcagcacttttaggagatgagactttatgtcagactaaaataagtggtagcggtatagttgcattagaaataccagttcctgaaagtgaaatatttaaatgcatattaatagatgacactttaaaagttgatggaaattttgcaatattaaggactggcaatatagagtttacagtagaaaaatcgtcaaaatcaattgttggatctgttactagtggtgaaggtcttgttaatgtttatagaggatcaggagaagtatggcttgttccaacaaaaagcgtttatagtgatttaaaaagtaaagggttaaatgaaatgagaaaatctcaacatagaatgaatacagaagaagattaattataaattcaatgctatattagattaaagttgtaaagtgtaaagatgatagttataatgaagaggggagaatagataaatgaggtgagaaaatgagttcgttagaatcaaaaattaaaagcaaggaactagatttattttttaaggcaatattaaaacttgataatatagaagaatgttataaattttttgaagatgtagcaactataaatgaagtaaaagctttagcacaaagattacatgttgcaactcttcttaaagagaagaatacttattcagaaattgcagaaataacaggtgcaagtacagcaacaataagcagagtaaatagatgcttgaattatggtagtgatggatataatttagtattggaaaagctaaaagatagcatggatgaaaataattaattatatgcgtaattaagaatattaggttgaaaaatagtattttatatatatatttgattgtaaatctttgagaaaaagattatactattttaaggcgaatttttgtataaattataaaaattgatatcctttattgcttaattgaaatagtataataatgaaagaactatatatattatctctatgtatatatttttagacatatttgatacggagataataacagaataaaaaaagtgaggtaaaattatgggtagaatgtttggaactgatggagtaagaggagttgccaatacagagttaacagcacaaattgcatataatcttggaagagctggagcgtatgttttaactgaaggtgctcataaacctaaaatattagttgcaaaagatacaagaatatcaggagatatgcttgaatcagcattaatagcaggtattttatctgtaggagcagaagctgttgtacttggagttgtaccaacaccagcagttgcttatttaacaagaaaatacggagctgatgcaggtgttatgatttcagcatcacataatccagtagaatataatggtattaaattcttcaatgacaaaggatataaattatcagatgaattagaagatgaaattcagagagttattgaaagcgattttgaaggtgttccaagtccaataggaacaaatattggtaaagaaacaattgaaacttcagctttagatcactatattgaatttgctaaagaaacaattccttatagtttaaagggattaaaaattgcattagattgtgctaatggagcttcatataaatcatcagtaaaagcatttagagaattaggtgcagaggtttttgttatcaatgataacccagatggaacaaatattaatgaaaactgtggctcaacacatccagaagaattaatggaatatgtggttaaaaaaggatgcgatttaggatttgcatttgatggtgatgcagatagatgtttagcagtagatgaaaaaggaaaccttgttaatggtgactttatactaatgttatgtgctaaatatttaaaggaaattggtaagcttaaagatgatactttagtagtaacagtaatgagtaatcttggtttagacattgcagctaaaaaagaaggtattaatatagttaaaacaagtgttggagatagatatgttcttgaagaaatgattaaggacaactatgttttaggtggagagcaatctggtcatgttatatttttagattacaatacaacaggtgatggattagtaacagctcttcaaattgcatcaatagttaaaaagaaagaagctggtttatcagaattatgttctataatgaaagagcttcctcaagttttagctaatgcgacaatacctaatgaaaagaaaaacttatacttaactgatgatgaaatacagaatgagattaaaaagatagaagaagcattaaatggagttggaagagttcttataagaccttcaggaactgaaccattagtaagagtaatgcttgaaggtgaaaatcaagaagaaatagataaaatggcacatggattagcggatttaattcaaagaaaatatgcataattaaaaattatataactaattttatagagatacactttttatcttggataatagaatttatccaagtgaaaagtgtatttttattttctattaattataatgttactgaataacaaaagcgttagtaggggatatataaagttgacagacttaatgtattaggaggcgcaaattagtttatgaatagagaaccatataatgaatttttattaattatgccagaaggtacttgtaagggatttaatgattttgagtcagcgaaagcatatataaatatatattatgaaagagcaattgatgaaaatattgatgatgatgatgaaaatgacatgactgaaatcggatcaggagatacaagaataaacatatgcactaaacttggtgttgaagaaggaaaatgtgagttatataaaactgaggaggtaataaataaaattagtgatgaattagttttcgatacagaaaagaaagagatagtagaaagactatgtgaagcagacattgattttaatatttatgataataatttggatttattaatatcagatgtagaaccaattgatattatggaaacttatggagagatagattagtgcaaatactttattttaattatataactaaaattaaaaacaatatgtcaagtgataaaagaatacgatgataaaatgataaaaaaataccttaaataataataaaataataaaaagttaattctaaaaatatgttaaaaaataagaatggtaaaaaatataatataatgttgacaatggtaaaacacgagagtaaaatctactgtaacaggaaaattgaatatgtccttaaagcttgtaaatgctaagaaggagacagttatcaaacagaaaaaagtttaagagagtcgatggttggtgtgaatcgatactttagttttttaattatcactcctgagctgaatcgggaaagagaattatatgttcttgagtaaaagatatccggtgtgcatccgttatatgcaagggtttgttagaacctagtgatattaataaggcggaatattatcccacttcttatgatttatatcattaagggtggatttttttaactatttttaaggggggcaagcaatggaaaagcatgtattatctgttttagtaaagaattcatcaggagttttaagcagagttagtggattgttttcaagacgaggatataatatcgacagtttaactgttggaagtactgagaacccatctatttcaagaatgacaattacacttatggctgatgacgatgtgttagaacaggtaaaaaaacaattagataagctggaagacgttataagagttgtaaattttaaagttaatgaatctgtttatagggaattagttttaatcaaagtaagagcaaacgctgagaacagggcagcaattaatgaaactgtaaaaatatttagaagtaaaataatagatatttcaacagacacattaacaattgagttaacaggtgatgaagagaagatatcagcattgattaatctgatgaaagaatatggaatagaagaagttgcaagaactggagttacagcgcttcaaagaggtgaaaaaaccataaaaaatactatagagaattaaaaagagcagtagaataagcaatgaataaaaaaataggcatttaaacaaagcaatggcagtaaaaacaatgtaagcataataggcaatggaataatataaagggggataacatatggcagagaatcaggtaaaaatatttgattctactttgagggatggtgctcagggccagggaatttctttttctttagaagataaaattaaaattgttaagattctagatgatatgcatattgattttattgaagctggaaatccaggatcaaatccaaaggatatggaattctttaaacgactgaatgaaatagaattgaaaaattcaaaaatagcagcttttggctcaaccagaagacctaatattaaagctgaagaagataaaaacatacaagatttgctctcatcaggttcagatgtacttattatatttgggaagtcatgggattttcaagttacagatattataaaaacatcacttgaagaaaatctgaaaatgataagtgatacaattcattacttaaagaaaaagggtagaagagtaatttttgatgctgaacatttttatgatggatacaaatctaataaggattatgcaatggcaacaataaaagctgcagagcaagcaggggcagaaaccgttgtattatgtgatacaaatggagggacattaccacctgaaatatatgaaataacaaaatcagtaattgaaaaggtaaatgctgaagtaggcattcacagtcatgatgatatgggaatggcagttgcaaattcaattatggctgttaaagcaggggcaaagcaggttcagggaactttcataggcataggtgaaaggtgtggtaatgcaaacttaagctcaatcattccaattttaaaacttaaacttgaaatgaatattttagatggaattgatctttttggattaactaaaacatcaagatttatagctgaaatatgtaatatgactttatatgatgaaagcccatttgtaggaaattcatcttttgcacataaaggtggaatgcatatagatgcagtaacaaaatgctcaaaatcatatgaacacattgatccgaaactagtaggtaataagagaaggtttttagtttcagaagtaagtggaaaaagtatgatacttcaagaaattaaaaagatttttcctaatgtatcaaaagatgatgtagcagttcaaaaaattacagatagattaaaagaattggaatatgaaggatatcagttcgaaggtgcagaaggcactgttgaattaataataagaaaaattattggtaaatataaacctttctttaaactgaatcattttaagataattggtgaacaaccatatggatctgatgctttttcatcgacagctgtaataaatattacagttgatgagcaaaatgaaatgacagcagcagagggagaaggtcctgtaaatgcacttgataaagctataagaaaagcacttgaagtcttctatccagaattaaaaaaagcacgacttgttgattataaggttagagttcttgattcagaaagtgcaacagaggcaaaagtaagagtattaattgaatcaactgacggaattgatacatggagtactgttggggtatctagagacgtaatacaagctagttggatagcacttgtagattcaatagaatataaattattaaaagatatagagagaaaagttaaagcatatttttaaggagatgattagaaatgggtatgacaatgacacaaaagattctagctgcacatgcaggattagaatgtgtaaaagctggacaattaattgaagcagatcttgatttagtattaggaaatgatattacaactccagtagctgtaaatgaatttaagaagtttggaactgataaggtatttagtaaaagtcaaatagcaattgttccagatcactttactcctaataaggatataaaagcggcagaacaagtaaagtatattagagagtttgcaaataaaatggaaattgaaaatttctttgaaattggtgaaatgggaatagaacattgtttagtaccagaaaagggactagctgtggctggagatgtagtaattggtgcagattctcatacttgtacttatggagcacttggagctttttcaacaggtataggttcaacagatatggcagctggtatggcaacaggtaagtgttggttcaaagttccatcagcattaaagtttgttcttaaaaacaaaccagcaaaatggataagtggtaaagatataattttacacataatcggaatgattggtgttgatggtgctttatataaatcaatggaatttgtaggagatggtttaaactatctttctatggatgatagatttacaatggctaatatggcgattgaagctggtggaaagaatggaatattcccagtagatgaaaagactgaagaatatttaaaagatcatgctaaaagagaatggaaaaagtatgaggcagatgaagatgcacaatatgatgaggtttatgaaattgacttaagtacattaagaccaacagtttcattcccacatttaccagataacacaagaacaattgataatactggtgatgtaaagattgatcaggttgtaattggttcatgtactaatggtagaatttcagatttaagagtagcaagggatattcttaaaggcaaaaaagttgataaaactataagatgtatcgttattccaggaactcagaagatttatcttcaagctttagaagaaggaataattaaagatttaattgaagctggtgcgattgtatcaactccaacatgtggaccttgccttggaggacatatgggaatcttagcaaaagatgaaagatgtgtatcaacaacaaacagaaattttgtaggaagaatgggtcatgttgaatcagaagtttatcttgcaagtccagcagttgcagcagcatctgcaataacaggaaagataactgatccagaattagtgtagggggtatttagtaatgagcgtaaaaggtagagtattcaaatatggagataatgtagatacagatgtaataattccagcaagatatttaaatacatctgatgctaaagaacttgctgcacattgtatggaagatatagatgctgattttgtaaagaatgttaaagatggagatataattgttgcaaataaaaactttggatgtggttcttcaagagaacatgcacctttagctattaaaacagcaggtgtaagctgtgttatagcatctacatttgcaagaattttctatagaaattcaattaatattggattaccaatattagaatgtgatgaagctgtaaagaatatcgatgctggtgatgaattagaagtagattttaagagtggattaattaagaatttaactaaaaatcaagaatatcaaggggaaggattcccagaattcatgcagaaaatcatcgataatgatggtcttataggatacattaagaatagttagcagttaacagttaacaagtaacagttatttaagatacaaatttgaataaaaaataaagctaaatgtataaaaataagttggcaattaacaagtgcagtaacattactaaattagaaactacaaagtagtttccaaataaacttttaactgacacctgttaactgttaactaaaaaaatgggggttagtaaaatgaaatgtaatatagctgtagtaccaggagatggaataggtccagatataatagcagaagcaataaaggtattaaagacagtaggagataaatttggacatagatttgagtatgaatatgctattgccggtggatgtgcaattgataagacaggagaagcacttccaaaagaaacattagaaatatgtaagagaaatgatgcagtgttacttggagcagttggtggtcctaaatgggatgatccagatgcgaaagtaagaccagaacaagcattattaggattaagaagcggaatgaatctttactgcaaccttagaccagcagtattatatgcaccattaaaaaatgcatcaccacttaaagatagtattgttggagatggaatagatattgctatagtaagagaattaactggtggtatttattttggtgaaagaggaagagaaacagttgatggagtagaatcagcttatgatactgaaagatataatgtaactgaaataactagaattgttaaaattgcttttgaaacagcgatgaagagaaataagaaattaacttgtgttgataaagctaacattcttgaaagttcaagactttggagaaaagttatcggtgaaatgattaatgattatccggaagttgaagttaattatatgtatgttgataatgcagcaatgcaacttgttaaggatccaactcaatttgatgtaattgttacttctaatatgtttggtgatattttatctgatgaagcaagtatggttacaggttctattggaatgttaccatcagcatcacttggagatggcactttaggaatgtatgaaccaattcatggtagtgcacctgatattgcaggaatgggaattgcaaatccattagcaacaatattatcaactgctatgatgcttagatatagttttaatttagaagaagaagctaaatctatagaaaaagctgtattagaagttcttgaagatggatatagaactggagatataatgagcgaaggtaaaaacaaggtaggaacaacagaaatgggtgatcttgtttgtaaaaaaattgttgaagggaagtagaaacatatgaaaagcgatgtacttaaaaaaggtcctggaaaggcagctcaaagatctcttcttagagcattaggtttaactgatgaagaaataaatagaccaataataggagttgtatctgcacaaagtgatgttattccaggacatatgaatcttgataaaataactgaagctgtaaaaaaaggtataacacttgcaggtggtactccacttgtggttccagctataggtgtttgtgatgggttggcaatgggacatgaaggtatgaaatattctcttgtaacaagagaacttattgcagattcaattgaatgtatggcaaaagcacatgcatttgatgcattagttttaattcctaactgtgataagattgttccagggatgcttatggcatcattaagagttaatataccatcagttatggtaagtggtggcccaatgcttgcaggaaaacataaaggtaatgctatttctctttctacaatgtttgaagcggttggatcttatgaaaatggattaatagatgaaaaagaattatgtgatatagaaaaatgcgcatgtccaacatgtggatcatgttcaggtatgtttacagcaaactctatgaactgtctttgtgaagtactaggtattgctttacctggaaacggaactattccagcagtttattcagaaagaataagacttgcaaaacaagcaggtatggcagttatggatatgcttgaaagagatattaagccaagagatattgttaatgaaaagagtataatgaatgcactaagagcagatatggctcttggatgttctactaatagtgttcttcatattacagctattgcaaatgaagcaaaggttaatatgaacttagatataataaatgaattatcagctaagacaccagatctttgtaagcttgcgccagcatctaatattcatattgaaagattatatgaagccggtggaattcaagcagtgttaagtgaattatctaaaaaggtagaacttaatttagattgcattactgttacaggaaaaacattatgggaaaatatagaaggggcgtctgttcaagattatgaagtaataagaccaatagataatccttacagtgaaacaggtggaattgcaatacttagagggaatttagcaccagaaggagcagttgttaaaagagcagcagtgttaccacaaatgttagttcatgaaggtccagcaaaggtatttaactctgaagaagaagctaatgcagcaatatttgataaaaagataaatgctggagatgttattgtaataagatatgaaggacctaagggtggccctggtatgagagaaatgcttcaagcaacagcagcaattgctggtatgaaattagatgattctgttgcattaataactgatggaagatttagtggtgcaacaagaggagcatctataggtcatgtttctccagaagcagcagcaggtggagttattggattattaaaagatggagatataatttcaatagatattaataataataagcttgaagttaaattaagcgatgaagaattagaagaaagaagaaagaattttaaacctcttgaagcaaaagttaaagaaggttatttagcaagatatgctaaacttgtaagttctgcagcagaaggagcaatacttaaatagttaacagttatcagttaacaattaacagttagtgagaaaatttctacgaaattttttgaattacatacattatgtaaatttttaaaatttcgtagaaagtatttttatatagaaaattaaagtaagtgatgaatttaaatcattttatgagcaaaggagtgaataaaatgttattgacgggggctgaaatactaataaagtctttaattgatgaaaatgtagagacgatatttggatatccaggtggggctgtacttaatatttatgatgaaatttataaatataaggatacgcttcatcatgttttaacttgtcatgaacaaggagcagcgcatgcagcagatggctatgctagggcaacaggaaaagtaggtgtatgtattgcaacttcaggaccaggtgcaacaaatctggtaactggtattgcaacagcgtatatggattctgttcctatggtagctataacggggaatgttacaacaccacttcttggaaaagacagctttcaggaagttgatataaaaggaattactatgcctataacaaagcacaattacattgtaagtgatgtaaatgagcttcaagatataataaaagaagcattttatatagcaaagtcaggaagaccgggacctgtactaatagatattccaaaagatataactgctaataaagcagaatataaaaagattattccaaaagaaattacaagaagtattgaaagaattaaggattctgatattgaacaggttgtaagtttaattaatgaatgtaagagaccttttatttatgcaggtggaggaataggaatatctggagctacagaagagcttgttgtatttgctgaaaagataaatgcaccggtttcaacaactttgatggctaactctgaatttcctaacgatcatgaattatatactgggatgataggaatgcatggaacaaaagcatccaatattgcagcaacaaaatgtgatttattaataactttaggagcaagatttagtgatagggttattagcaatcaaaatcacattaagaatgcaaaaataattcacattgatgtagatcctgctgagattaataaaaatataaaagtagatgcagctattattggagatgtaaaagtagtattagagaaacttatacaattagtagataataagaaaaatcaagaatggcttgataaaatagaaggtttgaagattttaaataagcaaattaattgtgattgtataagtcctgaattattgtttaagaaattaaatgatttaaataaagaaggaaattttgttatttctacagaagttggtcaacaccaaatgtggacagctcaaaattttaaatttaaaaatcatagaacatttataacttcaggtggccttggaacaatgggatatggacttggtgctgcaatcggagcacaagtaggtagaccagacagacaagttataaatatagctggtgatggtagttttgggatgaactgcaatgagtttgttacggctgttaagaataaacttccgttagtagaaattataatgaataacaactgtcttggaatggttagacagtggcagaatctattttatggagagagatattcagaaacaactcttgatagaccaacagattatgtgaagcttgcagaagcatttggaggaaaaggctttagaataactaaggctgatgaaattgaaattatactaaaacaagcattagagtattgtgatggtccagtattaatagattatgtaattgattcagataaaaaagtatttcctatggtagcaccaggtgctcctattgatgaaataatgactgaagaataagaaaaattttagatagtgggtgaatattttttattcactctcttttttgagtaaaaatataaatattattaagttttgtattcataattgaattaattatatctaatataaatgaatagaattttcagtatagagttttgatatgtataagatatattgtattatagatagaagataatatgattttaatgaatggaaggataagatgatgaattacgtatatattatagaatgttcagatggaacattgtatacaggatggacaaataacttagataaacgtatagaacagcattgcaatggaacaggagcaaaatatacgagaggaagagggccggtaagattggtataccatgaagaatttaatgataagcgtgatgctatgagaagagaatatgaaataaaaagatattcgagaattaataaattaaagttaatcgagaacatgcaaaaatatgataaaaaataataacaaaactcaaaaatcatgaaaacggttgtaaaatgaagaaaatcatataaaagcaaaagtaaacaagctttttagtatgaaatttgggaaaaattagtcttgtaaaagtttacttaagctgatatactttaaatatggaaataaaagtatgagtgatgaagctcaaaacaaaaaagtatccttataaacatattaaatagttgcatagtctgaatttttttgcaagcgattgcatatatttaattagtcagcattataatttaaagcaattttaaataataactataatattttagtactcattgtgagggaaggggtatatattatgaaaaagaaaaaattattagcaacagttttagcttctgcattagcatgtggaacattatcaggatgtggaggaacagctcaaacttcaggttcagcaacttcagctgatggaagtggaaaaacagtgaaggtattccaattaaaagttgaaattaatgatgctcttcaaaaattagctcaagaatatgaaaaagaaaaaggtgtaaaagttgaaattacatcagttggtggtggtgctgactatggtgcatcattaaaggcagaattccaaaagggtactgaaccagatatatttatggttgctggtaagggagattacgaagtttggaaacataaaattgatgatttaagtgatcaatcttgggtaagcaatgcagtaaagggaacacttgatacagttactatagatggtaagatttatggtatgccagctgcaaccgaaggatatggattaatgtataacaaagatattttagataaagctggtatcgatcccaaaactataacttcatttgatgcattgaaagcagcatttgaaactttagatagcaagaaagctgaattaggtcttgaaaatgttgtttcttatacaacaaaagaaacttgggttacaggaaatcatacatttaacattccgtttgcagctcaagaagatcctgctaaatttgtagatgaatatgttcaaggaaaagctgatattgttaataataaagaatttaatgattggatgaatttggtagggttattatgtaaatatggcggaggaaagactcttgaaactatagactatagtaaccaagttggtaattttgcattagaaaaaactgcatttattcaacaaggtaactgggttgcttcagatttagattcattaggtgctaactttaaaatgggattcattccaatgtgcttaaataatgatgctaatgataaggttaatacatcaattcctgttggtgttccaatgtattgggtagttaacaaggattcatcagttaataaagaagcaaaagaattcttagattggatggttcaaagtcaaactggtcaagaatctttagtaaatgatatgaacatgattccagcatttacaaactttaaagttgaaagtaaaaatccattaaatcaatcaattagtgaatacaataatgcaggaaaaacattaaaatgggcatttacagatttcccagatggattcacaatggacaagataggacctgtattctctaaattcttagatacagatatgggtgatgcagctaagaaagaaatgttacaaaatattcaagatgcatctccaaaacaagctaaataattttattaagtaaacaagttaaatttatagtgcagatatccataaaatgaaatgttttatggatatctgcataagttaaaaaggaggagtttaggatgagtaagagaagcagagacaataaagatttctggatgtttgttggtccttgtttatttgctctttttatggttgtagtaataccgtttttcatgggaatttactatacatttactaactggaatggagcaaatccagattatgatttcgtaggattcagtaattacttatatatattcaaagatgcacagtttatttattcatttaaaataacacttatctatacatttgcaagcgtactcacaataaatcttattggattttctttggcatatatagttacaagaaatttaaaaacaaagaattttttaagaactggtttctttatgccaaacttaattggggattaattttaggatttatatggcagttcatgtttaattcagtatttacaggagtaggtcaaaagcttggaagtagtattctttcaacatcaatgctacaagaaccaagtacagctgtacttgcaatgcttatagtatcaacttggcagtatgcaggatatataatggttatttatgtatcagcattagaaaatgtaccaaatgatttaatagaagccgcacatattgatggagcgaatggaattcaaacattcaaacatataacaattccaatggttagacaaggtataacaatatgtttattcttaacacttgcaaattctttcaaaatgtttgacttaaacttctcattaagtcctgctaaagcaacagaaatgatggcattaaacatttataaagaagcatttgtagttaataatctaggtatcggtcaagcaaaggcagttatattctttattttagtaacaactatttctttaactcaggtttactttaacaagaaaaaggaggtagaagcataatggcagaagttaaaatttcagaaccagcagaagtaaatgtaaaagcatcaaaaaaattaaagactctggatagctatactaccaaatctaaagtactagaaggattttcgtggcttttactaatactttatatgacaccattttacttgatgtttataaattcttttaaaacaagaagagaaatttttgcaaatacaacaggtttaccaagtgcatggaactttaaaaactatgcagacgctatggatagaatgggaataacatctgcgtttacaaattcaataataattactgttggatcagtattgttgatattactcttttcatcaatggcagcatgggttttagttcgtgataaatctactaagagcaaaattgttttttatatttttacagcaggtatgatcgtaccattccaagctgttatgttaccacttgtaaaatggatgggtaaaattaattttggtggattcaatatgttaggaacacactatggattaatgtttatgtatctaggttttggagcaagtatgagtatattcctatatcatggattcataaagggtatacctgaggaaattgaagaagcagcaataattgatggatgtagtaaatggcaagtatatactaaaatagtattaccattattaaagccaacaacagttactgttgcagtactaaatagtatttggatatggaatgactttttactacctttcttaacaataaacggtaagttaaatacaattccacttgctatgaacaacttctttggtgcattttctaaacaatgggaacttgcaatggcagcattaattttagctatcattccaatcgttattttctatttctttgttcaaaagcaaattattgcaggtattgttcaaggttctataaaataattaaaagttaagttcatgatttacaaaagatgaataataacagataaaaattagaagattaaaattaataatatttataatgtatatgatatagctgcttataaactaaaaaatataaggcagttatatcaatttatgcaagcgattgcttagagtatatgatcaaaagcgaagaaggagagacggttatggaaagaaacagtggtatcattatgcatattgcatcattaccaggaaaatacggaataggaactttaggtgaggaggcatataagtttgcagactttctagaaaagtctggacaaaaatattggcagatactacctttaggaccaacaagttttggtgattcgccttaccaatcattttcagcatttgctggtaatccatattttatagattttgatgttttaaataaaaagggcttattaaaattagaggaatatgaaaatataaattttggagaaaataatgaagaaatagattatgcattaatattcacagagaagatgaaggttttaagagcagcatttaataagtttgctacaaatataagtgaagaatctgaaataaaaaataagtttaatgaatttaaaaataaaaattcattttggcttgaggattatgcgttgtatatgtcagttaaagaagaatttgatttaaagagctggcaacaatgggatgaagatataaagttaagaaaaccagaggcggttgctctatataaagaaaaattgaaagatgaaatagaattttggaattttattcaatatgaattttttgaagagtggaacaagttaaaagaatatgtaaatgaacttggtatagagataataggagatattccaatatatgtgtctgaagacagtgctgatgtatggagtaatccagatgcatttttaattgataaggaaacattaaaacctaaaaaagttgcaggatgtccaccagatatattttcagctacaggtcagttatggggaaatcctatatacgattggcaatatatgcatgaaactgagtataagtggtggatagatagagtaagagaaagtttgaaaatatatgactggttaagaattgatcattttaagggatttgaatcatattattctattccatatggtgagcctacagctaaaaatggtaagtgggtaaagggacctggaatggaaattttcgatgctataagaaagtctcttggagaagttaatataattgctgaagatttaggaacattaactgaggaaacaataaaattaagagatgacaataaatttcctggaatgaaaatactgacttttgcatttgattctggtagcgataatccatttttacctcataattatgaaaagaattttattgcatatactggaactcatgataatgatacagtaagaggatggattgaaaaaactgcacctaaagaacaagttgaaaaagcaatacagtatttgaatttaaatgaagaagaaggatataactggggatttatacgtggaatatggagtagtgtagctaatgtttcaatagcacaaatgcaagatttcttaaatttaggtaatgaagcaagaattaatatgccttctactttaggatgcaattggaaatggagagctaaaggtgaagcatttactgatgctttagcaaaacgtatatacagtttgactgagatatatggaagatgtacaaaaaaagaagaaattaaaactggtgaggataatatagaagaaaatatcgaagcagtttaatatattttattattataaattagtctagatatggtttttaaaattatatttagactattttaataaaataaattaaaatactatatttacttgagatttattgttgaagcatatattattaattttagaatgattaatacctttagaatattttgtagataaataaaaaaagatacatatataattcctaaaaagggaaattgggtataaaattagtataaagtttattggtttattaggaggagaaaatgaaggttacaattaaagaggttgctaaagaagctaatgtttcaacatctactgtttccagagttatatctgatagtcctcaaattagcgaaaaaacaaaggaaaaagtaagagaagttataacgagattaaattataagcctaatgcaattgcaaggagtcttgccaataaaaagacaagaataattggtgtagttctacctagtgaagcacaggatttatttttcaatccatttttcctaaaagctatgcaaggaatgagtagttatgcaaagaaaaagaaatattatataacttatgcctttagtgataatgaaaaagaagaagtaaattatataaaagattttataactagcaatttaattgctggaatctgccttttaagactaaggactgatgataaaagtatagaatatttaaaaagagcagattttccttttgtagttatagggcgccctgaaaatccagaaagtatgttatgggttgataatgataattttaaatcaacatataatttgatgaatactttaataaaaaaaggacataaagatatagcttttttaggagctaaagaagaattaactgtaaccaaggatagattaaaagggtataaggttgcatgtgaaatgaacggattgacatgtgctgataaaaatataattatgaagacagaattcaatgaagatgaaggttttaatggtgcattagaattatttgataaaagtaatcctacagcagttttggtacaggacgacttgcttgcgttcggattactaaaagcattaaaagataaaggtattgaaaatgtttctgttgttgcatttaacaacacacctttagcagaatttcaagagcctccgttagcatcagttgatattaacgcatcagaacttggttattatgcagcaaaagtacttatagaatatttagaaaataataatgttgatgataatcactatatagtagattcaaaattgatagaaagagaatcattaagatagtatttataatactatcttaatgattctcttattagtgcaagcgattgcaaaagaaacttactaagatggagcattttaaagaaaaaatatgaaaacatagcgtaaataaaacaatttcaaaaaaataattattgtaatagttttctttaaatgatatacttaattcataaaataagaaaaatacaaagattactgcaatattttacttttttttaagtgaaatattttttataaacaaacgcgcaatcgcttgcaaaggagtacgtatgaaaaaagtttggtggaaagaagctatagggtatcaaatttatccaagaagttttaaagactctaacggtgatggaattggagatttaaaaggaataatatctaagcttgattatttaaaggatttaggaatagatgttatatggatttgtccaatgtataaatcaccaaatgatgataatggatatgatattagtgattatcaagatataacagaagaatttggaacaatggaagattttgatgaattactaagagaagttcatcaaagaggtatgaaattaataattgatttagttgtaaatcatacaagtgatgaacataagtggtttattgaatctaaatcatcaaaagataatcctaaaagagactggtatatttggaaagaaggtaagaatggtgcagagccaaataactgggaaagcatctttaaaggttcagcgtgggaaaaagatgacattacagaagaatactaccttcacttgtttactaaaaaacagccagatttaaactgggagaatcctgaagttagaaaagctatctttgagatgataaactggtggctagataaaggaattgatggatttagagtagatgccataagtcatattaagaaagatcaaacatttgaagatcttcctaatcctgataaaaaggactatgtggaatcttttgataagcatatgaattataaaggaatacatatgtttttaaatgaattaaaacaagagactttttcaaagtatgatattatgaccgtgggagaagctaatggagtgaaagcggaagtagatgcagaactttgggttggtgaagaaaatggaagctttaatatggtatttcagtttgaacatcttgatttatgggaatcggacgatagtgatggaatatctaagataataaaacttaaaaaagctttaagtaaatggcaggatagtttatatggaatagggtggaatgctctgtttgtagaaaatcatgatatatcacgtgttatatcaacacttggaaatgatgacaaatatagatcagagtgtgcgaaagcctttgcattaatgtattttatgcaacaagggacaccatttatatatcaaggtcaagaaattggaatgactaatgttaaattccattctataaaagattatgatgatgttaagagtataaacatatataatgagttggttgaaagtggtgaaagtgaagaaaatgcactagaacatgtatggagtatttcaagagataatgcacgtacacctatgcaatggagcagttcaaagtatgcaggtttttcagataataaaccatggattggcttaaatgaaaattatttagaaattaatgtagaagatgaattgaaagatgataattctatattgaatttctataaaaatttaataaaaatcaagaaatcaaatgaagcgttaatatacggtaaatatgagttgatcttagaagaacatgaacaaatatatgcgtatatgagagttgaaaatgaggaaaagtaccttgtattatgtaatttatcaaatgactatgtgaattattgctatgatgaattacaactcgattcagataacttattgatttcaaattataaagtagataaacattctcaaagtcatagttttgaattgaagccatgggaatgtagattatataaaataaacaattagaaaaaatatagaaatatacagatgagtgtgttatacaaatgatgaataattagacttcataattttatgaagtctaattaaaaaaaataatgtatacgatgtaatgtaaaatggagggaaatgtaatggggaacagtaaaggtaaattattttcatttgaattctggcaaaaattcgggaaggctttaatggttgttgttgcagtaatgccagcagcaggtcttatgatttgtattggaaaattaattggaatgtgtggagatttatctcttttaaaaacagttgcaaacgttgtagaacaattaggttggggtattattggtaatcttcatgttttatttgcagtagcaatcggtggttcttgggctaaagaacgtgctggtggagcatttgcagcacttatagcatttattcttataaatcttactacaggatctatatttggagtaacatcagatatgctttcagatccaaatgctacagttacatctttatttggtcaaaatttaatcgttggtaattactttacatctattcttggaaatccggcgttaaatatgggtgtgtttgttggtattatttcaggtttcttaggagcttcattatataacaagtattataactttaataagcttcctaatgcattatcattctttaatggaaaacgttttgttccatttgttgttattgcaggttcagttgttacagctataattcttgcaatcgtttggccttttgctcaatcagggttaaatgcttttggtatgtggcttgcaaagtctaaagatacagcgccaattatatcaccatttatttatggatgtttagaacgtttattactaccttttggtttacatcatatgcttacaattccagtaaactatacagagttaggtggagtttatactgtaatgactggagctaacacaggaagcattatatcaggtcaagatccattatggtatgcatggatatcagatttaattaacttaaaaggagcaggtgatacagcagcatataataatttattagcaactgttacaccagcaagatttaaatttggtcaagttattctttcaagtgcttcgttaataggtgcagcattagcaatgtacagaaatgtagatgaagataaaaagaaaaagtataagtcaatgtttttatcagcaggtcttgcagtattcttaacaggggttacagaaccacttgaattcatgtttatgtttgtatcacctattttatatggaatatatgcagttatagctggtataggttttgcagttgcagatttaataaatgtaagaattcaggcttttggttttgttgaatttttaactcgtataccgatgtttgcaaaagcaggtataataatggatgtagttaattttgtaatatgtgcagttatattctttggattaaactactttgtatttaacttcttaattaagaaattaaacttagcaacaccaggtcgtagaggaaattatatagaagacgaagaagaaacaggaaaggaagcagcagttacaaaagtttcgggaaatgatttagctgtaaaaataatctctttattaggagaaaaagataatattgtagatgttgatgcttgtatgactcgcttaagagttactgttaaagataaagctctagttgcaggagaaaaggaatggaagcaaaatggagctatgggattagtggttaaggataaaggaattcaagcaatatacggacctaaagcagatgtgttaaaatcagacatacaagatattttaggagtgtagtaaaagtgaaactattaaccttaaattgtcattcgtggcaagaagaaaatcaattagataaaattaaatatttagcaaaagtaataagtgaaaaaaattatgatgttatagcccttcaagaagttagtcagtcaatagattgcaaaataatagatggcatcttgaaagaagataattttattgttctactaaaagaagagcttaataagtttactaaaagtaattacgagttttattgggatttctctcatataggatatgacatttatgaagaaggattagctataatgactagacataagtttataaatagtgaatcatttttcattaccaaaagtacggatagaacttactggaagacaagaaagataattaagagttcaatagaaattaataataaagaagttgatttctattcatgtcatcttggatggtggaaggacgatgaagagccttttacttatcaggcagataagttattagatacagtaaacagtaagaaaacagcaatttttatgggggattttaataataatgcttttgtaagaaatgaaggatatgattatttaataaataaaaatttgaaggatctatatttgaaaactgataagtcagaagaagagtgtagtgctacagtaaagggaaaaattgatggttgggatgaaaataaagaaaaacttagattagatttaattttaagtaatgagttattgaaagttaaaaatgctagggtgatttttaatggaataaacaaagaaataatatctgaccattatggggttgaactagaaatagatttttaaatgttaagtaaaagcagcatgaattagtaagtaattcatgctgctttaatttatatatttattttaattttttaaaaatagttgataaagtatctaaagaagaagtaagatcatttaagtcttcatctgataaagttgaaattttattttttatagcatcttttgcagcagattctacatattcaaataattctatagccttaggtgttaattctacacgtaaaatccttctgtctttactatctgtatatctatgtactaattctaaatcaataagcttatcaattataggagtcatatttgatttagatatatttaatttcttagcaatatgtgatatgggcgatgatttaacttttgctaaatataaaataacatttatatgagatggaggcattgataaggagcagatttttgtctgaaattcatttgaatttataggaaaattttttgtgaaatcattttctataaataagccatctctaaccaatgacaaaaaatctaatagcatacaacttgttttataaagtttggaatcactcatgtttagtttcctttcgagttataaaattcattaaatattatagcttaaaaatatattttaaacaagaaaaaaagttattgacttagaatagttctgaatttataattaaatacaacttaagagtttttaattaactcttaagtttaatgatttacatattaagaaaaataagtaaattaattaagcttaaattaagaaaacagtaagaaaatgaaacctttatattattataatagttattattaggattatattaataaaattgaataatatagtgtaattaaaatttaataatagtttactaaattttagaggaggaaaaaatgaaaaagtatttaatcgcattactattaacagtaagtacattcatgctgacaggctgtgggagtacagagcctgtacaagaagaaaaggctatagcagtttcagtacaatctgctaagggtggagatattgaaaatacaaacatattttcagggacaactaagataaaggatgagacagctgtaacagttgaaatgggtggaactattgaagaaatgaatgtacagttgggagaaaaggtaacaaaaggacaaacactattaaagataaaaggaactgatatagaaaacagtataaaatcagcacaggctgcagtaaattcagcacaggctgcatataatgatagtgatgtatccatggcaaatactgaaaatcagttagaaagtggacttactaatgcaaaagtagcatatgataaagcagtttcagggtatgaagaaacaaagagacaatttgataatacaactcagctttatgaagcaggagcaatttcagagaatgattataaacaagcaaaggcgaatcttgaacagacacaaagaagtgttgatcaagcaaaagcaagtttagatgcagctcaaaaatcatatgatacaggagttggaaatagagaatctgcaaaagcagctatagaatctgcaaaagtaggtttggaaagtgcattaagtaatagagacaagcttactttacaatcaccagttgatggagttattacagcaaagaattttgatgtaaatgaaatggcaacgcaaggacaacctgcatttataatttcaagtcctgatattttgcaaattgatcttagtattacacaagctgatataggcaagttttcagaaggacaaactgttagtgtaaagatagatgaacaagttattgatggaacagtaaattatgtaccaacagtagcagatgcttcaagttcactttataaggtagaagttcttatagataattccgaaggacaatttaaatcaggtatgtctgcggaagttgaagttagtatagaaaaagaaagcaatgttgtaaaagtacctaaaaaagcaattcttgaagaagaaggaaataaatatgtctacatagtaggggatgataacagagctgttaaaaaggaaatatcaacagggattgaaacagctgatacagtagaaataaagagtggagtagaatcagatgatacagttgttattggcggattatcactgatttcagacaacacaaagttatttcctgtagtaaaggaggactaatataatgagtatgacaaaaacttccgttaaacgtcctcttacaataataatggtatttttagtagtattaatgtttggtggaattgggtatagtaaaatgcctgctaacttaatgccagatattgatgtgccagttgctttagtaatgactcaatggtctggagctggtccagaagatattgatgatcaaatatcagaacccatagaaaaaagtctttcgtcaatttcaaatgtaaagacaactgtttccaagtctagtgaaggtgtatcgatggttgttgcacaatttgaatatggaactgatgttgatgaaaaacttaatgacataagaagtaaaatagatacagtaaaaatgacacttcctgatgatgttgatacaccaagtattttaaaaatggatatgaatgcacaggccattgcacagatagttgtaagtggagagggtagttcagatgacataatgaaatatgcagaagatacagttcaggttaaattagaatctatagatggtataacttcagctgatattaatggtggagataagacacagataaatgtcattgcagatcctactatactttcaagttacggtgtatcattagatacaattaaaggtcttttatcggcaacaaataagagttatccttatggatcaataactcaaggagatgacaaaattgttatcagaagtgttgataaagttgaagctttagaagatattaaggcaattcaaattcctatgtcaaatggtgaaactgtaagtcttgataagatatgtacagttgagtatgggactgtagataagcaatcaatttatagatacaatggtcaagaaagtttagttatggatgtacagaagcagcaagatgcaaatactgtacaggttatgaaaaatgttaattcaaaaatatctgaacttaataatgagaattcacaatttaatttaaaaatagttaatgatactagtgaatatataaatagctcaataaatgacgtaatgaagaatcttattttaagtgcagtaattgccttctttgttatattacttttcttaaagagcggaagggcttcatttgttgttgcagtttctataccaacatcaataattggtgcaattgcattactttattttacaggtgaaacattgaacatggtaacattaagttctcttgtaatagcagttggtatggttgttgacaatgctacagttgttattgaaaatatatttaagtatagaaaagatcctaatttatctttagaagaagcagctattcaaggtacaaatactgtttcaactgctgtaatggcttcaacattaacaacagtagctatattcttaccaatattgtttactgaaggatttacaaagataatgtttggttcattggctaaaacacttatttttgcattaactttatcattaatagttgcacttactttagtaccaagtatatttgcaaaacttagtggtggtaagaatggtgcaaagatggaggaaaaaccatctcctatatttgataaaataagtgagggttataaaaatattatagttttagcattaaaacataaagcagtagttattttaataagtgtaggtatgtttattggagcaatagttttaggtgcaactggagcaataggtatggactttatgtcaagtggtgatgaaggtatggttagtatatctataaaattaccagaaggcttagatttagaaccaagtgattattatgtatctatggcagaagagaaagtatctgatattcctgaaattgaaaccatgataactcaaataggatcaggttcagcaatggggtcaggtggttctacagcaagtataagtttggatttagtatcttcgaaagaaagaaagagaacaacagatgaaattgaacaagatgtagtagaaagattaaaagtaatacctgactgtgaaatcaatgtaagtcagactagtagtatgtctatgggtggaagcggagatgctcaagtagatattaaaggtccagatttagatgtattagaagaaatagttaatcaagcaaaagctaatgttgaaaaagtatctggatttagaaatatagaaacttctcttgcggattcaaataaggaagctcaatttaagattgataaaagaaaagcttcattattaggaataaatacatcgtcaatagcatctacattacgtacagcaattagtggatcagatgctacaacagtaacaattgatgattatgattatgatgtaaatttaaaattcaaggattcaagcataaatagtatagatgatattggacaaataaaagtaacatcagcaagtggtcagcaagtacctttaaatgcatttgcagaaattaaaatggctgatggattaaaatcaatttcaagaacagatggtgactattcagtatcaattacggcaaaagctgataatatggatacaagtacagcatcaagactgttgactcaagcagtaaatgaagttgatatgcctagagattacagtattgatgttggtggatcagctgaaatgatgaatgaatcaatgagtagccttgtaatggcaatggttatagcattaattcttgtttatatggtaatggtagctcaatttgagtcatttagtaagccttttataataatgtttagtataccttttgcttttgttggagtagtgattgcattagtaatttcgcgtatttcattaaatgtagttggaatgctgggagccatattactggtaggtatagttgttaataatggtatagttttaatcgactatattggtcagcttagagaggctaaagttcaaggaacacttgaagatatagttgcaaagggatgtgcagcaagacttagaccagtattgatgacaacaatgacgactgttgttggtatgataccaagtgcattggcatttggtgaaggtggagacatgatgcaacctcttgcagttgtaattattggtggtctttcagtatcaacacttgtaacactagtattaataccaacagtatacttaatatttgataagattgaaaattcattaagaagtaaatttggacaaatatttgataaaataaaaattcctcatattgggcctaaaaagtctaaaatgggcataaacatattatctaaagatattgaggataaaaaagaatcagaaaatgatgagtcccatgaagaagattcagatttaaagaaataaataagaaataaaatttagccatgaagaattttttgtaaactttcttcatggttaaatgactattagttcattttatggtaaaattatttattagaaatagttatgaaaatataattaaataaagaggtggagtaatgagaaaaaatttaaataaaattgttgcatttgcaattggtgttagtgtgattagtggaagtatagtacctgcaatggcggctgatataataaatacagatacaatagtaaatactcaaacacaagctagtacggaaaaaaaagttttaactgtagatgatgctgttaaggctgctatagctaatagtaattcattagcccttttggataaggagataaaatttaaacaaaatataaatagtattactgaaaaagctgaagatttaaaagatttaggtgatgttgatgaagattacaatgatagctatcgtaagcttacaatgcaacagcttgagcaaaaaagagattttcagaaggataaattagcacagagtactactgatgactttaatgtattagtacaaaaacaaattgatgttaacaatcaaaaaaatactatagagcttaaagaaaaatcattagaacaaaataagttacaacaaaaattaggtcttatgacatcaattaatatagatggagtaaatttagaaatacaaaaattaaaaaatacattaaaatcaactgaagcagatttggagaattgcaaatatagttttaaattagcaacgggtatagatgttgataattatatattagatgattcgattaagtatgtaaaatttgaacttgatagtgacttagatagttatatagatggggcagtggatgattatttatcatatactcaagaaatatatgaattagataaggattattggaatgatgatgataatagtggcgtagttaagaatacagaaatttctaatgctaaagatgagcaagacgaagcatataaaacaatgattgaaaagaaaaatgcatggattaatgctacagatgaagagaaagcagctgcaaaagatgcatttgatgaagcacaagaaaaatataaagattctattgaagaatatgggaaaaagctttctggcagaataacttatttaactcaaaagtatacgttagatgcaacagagtcaaatttattagatgctaagaaaagttgtaaagagggtctcagaactatatatatgaatatgaaaaatttagaagatagtattgatttattacaacagaatatagattacactaataagaatcttagaatagcaaaaataaattatgatttaggattaagcacagaattaacttataaaaataatgttaactctgtagaagatttaaatcttcaattaagaagtcttataaatacttataataaattaaaagctcaactagaaaaaccatggatagctttatcttaatatagtaaagaaaaactggactagctaaaatatatttaatattgtagctagtctatttttatattataaagttataatacatgttataatgatttcatggcataaatgtatatttgtggaggtcgtgtgtatgaagaatataggaaaagccactatactttcattaggattagcatttgtttgtagtgtcactgcatttgctgatacttcaagtaatgataagttagaaaatgaaatatataaccatatgattaatagagatgatgtcttttatttcacatattactctaatagtgcacttgatttactacaagaagtggctaaaaaagatgattatttagaacgttctatagcagtatataaaacaagaaaagctggatatttttttgaagcagaaatacagtatagaactaataaagagcaggaagattacattaattcagaattgtcacgaattgtgaataatttaattgattctagaatgtctacagaagaaaaaattgaagctataaataattatgttgtgaagatatataagtatgatgatacattaaaatctgataatgtttatactgcattgacaactaaaagtactatttgtcaggggtatgcaatgactgtatataaaatgttaaatatccttgggattgattgtagaattataaatggtgataaaagtggtacaagtcatgcatggaatctagtaaaaatagatggagtgtggtatcatttagattccactaataatgataatattgttagagataaatacttgttaaaaagtgatgattatatgattgaaaatggatttacgtgggataaaactcagtatccatctgcatcttcaaattattttttgaataaaacagaatatcttgattataataatgataaagaaaatgatatttcagaatattatgagggtggatattggtataaagataataactcaaaatggcattataaaagaaattcaggatatgaagtaatgggatggtttaagtataataataactggtattattttggtgaagattgcattatgaaaactggatggattaatactgatggaaactggtattacttatattcaaatggaatgcttgcaactaatactattatagatggatatagtttagatgaaaatggagtattacattaaagtttagagttataagttatcaacatataaagagatatataggaaataattgtggataaatcaatattgatttactaaaattgtggattatatatttctttttattttttttgtggaaatttaagaaaaaagcaatattatatattatagacaaaatttatttatatgataaaatatatgcagggtataaaatgtcgcgtgaaaggtgtgatggtgataggtaaacattatttaaagtgaaaatttttaaagcgccagaacttaagtaaattactttagttgattgaatgtggatgtttagagttttttttaaggaaactcgactcacatacgttcgctgagtaagttcgcttaactaaatcatagatttgaggaattgattgagtgaatgtggatgtttagagtattttttaaaggaaactcgactcacatacgttcactgagtaagttccactaaccaaatcatagatttggagtgtcacttaagttgacgaggttggggagttatcgaaacttcggcgggtgccccacggtatagcactaccgttaacagctggcaaaactttaaagtgatttaaagtacaaatccagtttggtgttaaaaccttctaaaaatttatgcttttaggttacgggattattatgcccttttatgcataaaatacttttacaaataattttatgagccgtatcaaagcattagatttagataaaaattaagaattaaagggcttattaaatataagctgaattgaggaaggaagattagattatgtgcggaatagtaggatatttaggaagcggaaaagcaacatcgtttttaattaacggattatcaaagttagaatatagaggatatgactcagcaggtgttgctgttgttaataatggaaatattgaagtaagaaaatttaaaggaagattagctaatttagcagaaaatataaaagaacatccagttgaaggatctatgggaatcggtcatacaagatgggcaactcatggtgcaccatcagatgtgaattctcatccacatttaaatagtaaagaaacaattgcagtagttcaaaatggtattatagaaaattatttaccattaagaaactggttaaaaggtgaaggttatacttttaaatctgaaacagatacagaagttatccctaacttaatcgactattattatgaaggtgacttatttaaagcagttactaaggctcttaagaaacttgaaggtagctatgcattaggtgttgtttgcaaaaatgaaccagataaattaatagcagtaagaaaagaatgtccattaatcgtaggtttaggaaaaggtgaatcatttatagcatcagatattccagctgtattaagctacacaagagatgtatatcttttagaagaccatgaaatagctgttcttgataagaatggtgttaaactttatactacagatggtgatgaaataacaaaagatatatatcatgttacatggagtgaagatgcagcagaaaaaggcggatttgaggacttcatgttaaaagaaattcatgaacaaccaaaggctataagagatactatggctggaagaatttctatggaaaagagcatgatattagatgatttaaaaataactaaggaagatttagaaaatacagatagagtatttatagttgcttgtggtactgcttatcatgcaggtcttgtaggtaagaatgtaattgaatcacttgcaagaattccagttgaagttgatattgcatcagaattcagatacagaaatccattagtaactgataaatctttagttattgttgtaagtcagtctggtgaaactgctgacacattagcagctttaagaaactgtaaaacaattggtgctacaatagttgcattaacaaatgttgtaggaagttcagtttcaagagaagcagatcatgtattatatacactagctggtccagaaatatcagttgcttctactaaggcttatacaactcaaattataggaatgtatatgatagctatgacttttgctaaaatattaggaaagttaaagagtgacagattagataaattaaaagaagaattattagatttaccaggaaaggtagaactagttttagaagataaagaaaaaatcaaagctattgctgaaaagatgtataaagaagatgatatgttctatttaggtagaggtatagattatgcagttgcattagaaggttctttaaagcttaaagaaatatcatatattcattcagaagcatatgctggtggagaattaaagcatggaccaatcgcattaatagaagatggtactgaagtaataactttattaactcaagaagctttaaaagaaaaaatggtaagtaatgttgttgaaattaaagcaagaggagctaaagttacaggaatatgttatgaaggaactaagggattagaagaagttttagatgaaataatctacattcctagaactttagatatgtttgcacctgtattaagtgttgcagttcttcaattattctcatattatgtagctaaagctaaaggatgcgatattgataaaccaagaaacttagctaaatcagttacagttgaataatttttaatagattaaataatactatgttatagcatatagtattatataaaaagttaatagaatcaatatgagcctatacattttaagtaattttaaaatgtataggcttttttataagatgaaataatgtttaaaagaaacacaatataaaattttcgatatattaaagaaacaaggaattagaaatagtaaacaccatagtttaacaaatgctggggtgtttattattgttcgaaaaattatatttaaagttgttaaataaatacaatcaaggaatatatatgtgtaaatagacgtaaatagaagtaaaaattagatattgagtgatattgttaatatatagattaaatctgtattatatagaataaaatagctataaatgaatttgaaaagtttgctatatgtatatataatgaaattacaaacaaaaaagaaataaaacaaacaataacgaacaaacaaaagataaaaatgataattgcatattaaaaataaattgtaattgaaaaaacttaagatgaaagtataaatttttgataatttaaatattaacgtttttatatataatgaatgtataattaaatagttgaaattttatatttggggatggaggtaaacattagtgttaaaggaagaaaggcatagaataatattaaataaggtaaatgagaagaaaataatcaaaatttgtgatttagtagatgaattagaagcaactgaaatgactttgagaagagatttaacatatctagaaagtaaaggattgcttataagaattcatggtggtgctagaagcaatgatagttttaaagaagaattatctctaagtgaaaaaagaaatataaatattgataagaaattagaaatagcaaagattgttggaagtttagtaaaagaaaatgacattatttatataggaccaggaactacaaatgaacttatatatgattatttaaatgtatcatatgcaaaaatagtaaccaattcattaagcgtatttgagaaatttaaagatgatagtagatatgatgttatcttaattggaggaaaactaagacatagaagtaatacatttatagggaattttgccaatgaaatttgcaaaaaaatgattgttgatttagcgtttgttggtactaatggaatacttgataatagagttacaactcgtaatgaagatgaaggaatttgtcagaatataattttagagaaatcaaaaaaaccatatattttatgtgactcaactaaatttgaattagaagatttttgtactttttataaattaaataaagatgttacgataataactgattcaaatatatcaaaagaattaaaagataaatatttaaaaatatgtaatgtaatagacagtatagaacaataatacttaaaactatataaaacttagtatatagccatttggtacaagctatatactaagtaaaaaaattaatatgttagaaatataatattaaattatattttaaaatacataaaggggaggattaggtttgaacttaattgaaaaagacttaatattcaaggaagattttgcgagtttggctcaagcatttaaatgcttgagcaaaagatttttagaaaggggactagttaaacaagggtatttagaggcactaatggaaagagaaaaaaattatccaacaggaattgatttgacagctgtatctcaagagtttccgaatatagcaataccgcatacagaaagtatgtattgtaatgcaactaaagtaatcgttatcaaacttgaaagagatatagtttcaaaagatatgatgaatcctgataaagatttaaatgttaaatacttatttatgatattaaataaagatggtggagaacaatctaatatattagcaaagataatggagtttgctaccaataaagaaaacataagtatgttagctgcatcagattcattagattcaatttatgatgtagttaataaactaaatgcatagtttaaaaaaatatttatatatataaggaggaattttattatgattaaaattttagcagcttgtggtgcaggagtaaattcaagtcatcaaattaaagatgcaattgaggaagaaatgaagaagagaggttatcaagtcattgctgatgcagtaatgataaaagatttaacagaggaaatgttaactaaatatgatatctttacacctataactaaaccagatactagctttgaaataaaaataccagttgtcgaagcaggaccaatattatataggatgcctatgatgagtaaaccagtatttgacgaggttgaaagagttattaaaagtttaaataaaaattgatataaaaggggattaatttgatgagtacaatagtagagttagccaataaaatttttcaaccaataattaatttaggagcagctccaatgatgctaatagtattaacattattagcattaataatgaaggttaagttttcaaaggcattagaaggtggaatcaagttggcaattgcacttacaggtatgggatctgtaataggaatattaacaaatgctttttcacctgcattgcaacagttcgttaaatcaacaggaattcaactatcagtaaccgatgttggatgggctcctttagcaacaataacgtggggatcaccatatacattatttttcttgtttattttagttcttgtaaatattgcaatgttaattttaaagaaaacagatactttagatgtagacatatttgatgtttggcatttatctatagttggacttttagtaatgtactactctaaaaatttatttttagcagcattattagtagtttttataggagttttaaaatttataaatgcagatttaatgaagccaacatttaatgatttattgaatatgcctgaatcaaatcctactacaactacacatatgaattatatgttaaatccaataataatggtatttgataagttgtttagtaaatttttacctttcatagataaatatgattttgatgcagctactttgaataatagaattggattttggggaagtaagtttgcaataggatgttacttaggtgtatttgtaggtattttaggtaaacaagcacctcaaagtatatttaatttagcatttacaggtggtatgtgcttagaattattctcattaatgggaagttggtttatagcagctgttgaaccattatcacaaggaataaccaattttatgagtaataaatttgcaggtagaaagtttaatataggtattgactggccatttatagcttcaagagcagaaatttgggcagcagctaatatacttgcaccagtaatgcttttagaagcagttgttttaccaggaaataaaattttaccacttgcaggaataattgcaatgggtatgacaccagcactcttagttgttactagaggaaaacttataagaatgataatcattggagcgttgatgttaccaacattcttatggtctggaactgcaatttcagaatttgttacctttacagcacaaaaagtaggagcattcccagcaggattagatgcatctacactaataactcattcaactttggaaggaccaatagaaaaatttgttgcaatagttgttggtaagtttggtcaaaatataaatttacaaaatactttaattcttgttgttacattagttgtatacttaggattatttatgtggtatgcaaatcaaatgaagaagagaaacaaagaatatgaagaaaaagtatcaaattaataacatcacagattggagaattaattatgaaagttttaataggagcagataaaaaaggatcaatattaaaagaacatttaaagaattatttagtaagtaaaggttatgaagttatagacaagacagaagatgaagttgatttagtagattcagctgatagagtctgcaaagcaatattaaacaatgaaggagatagaggaatactaatagatgaatatggagcaggttcttttatggcagctaataagcacaaagggattatatgcgcagaagtttcagatgaacattcagcttatatgacaagaagtcacaacaatacttcagttatagcaatgggatctggaattgttggaacaaaattagcagaagctttagtagataattatttaacttcagaatatgctggtggaagacatcaaataagagtagatatgttaaataaaatgttataggaaaagtaggaggaatataaaatgaagatatcagtggcatgtgaccatatagttacagatagaaaaatacacatagttgaatatttaacagcaaaagggcatgaagttatagattgtggaacttatgatcatataagaactcattatgctatatttgggaaaaaagcagctgaaaaagttgtttcaggagaagcagatttagcagtagttctttgtggaacaggagttggaataacaacatcaacagctaaagtagttggtacaagaccagcattagtaagagatgtatcttcagctatatatgctaaaaaacatttaaatgcaaatgttataggatttggtggaagaattactggtgttggattaatggaaaatataattgatgcatttttagagactaaattcgaaccaactgaagaggataagaaaattattgaaaaaatagattcaatagcagaaagaaaagatgaccaattcaaaaatgatcatttctttgatgaatttctagaaaaatgggatagaggagaatatcacgactaattaatttattaggtagaattttaatattaaggagtgtatcaagaatgatattatcaacaagagagatgttattaaaagcacaaaaagaaggatatgcagttccagcttttaatattcataatttagaaacattacaagttgtcgcagaaacagcaatggaaatgagatcacctgtaattatagcaggaacaccatcaacaattgaagattatgcaggaccagattatattaaggctatggcagaagtagcatctaataaatacaatattccaatagccatacatttagatcactttgaaaatgttgaggcaattaaaaaggatatcgatataggatttagatcatgtatgattgatgcatcaaaatatgaatttgaaaaaaacatagaaatcgtaaaagatgtcgtagaatatgctcataaatttgatgcagttgtagaagctgaacttggaaaacttggtggaagagaagatgacatagaagttgatgctaaagatgcaatgtacacaaatccagacgatgcacttgaatttgtaaatagaacaggggtggattctttagcaattgctataggaacagctcatggattatataaaggagagcctaagcttgatttcgagagattaaaagaaattagagaaaaagttaatgttcctttagttttacacggggcatcagatgtaccagatgaacttgtagaaaaagcaatttcacttggaatatgtaaagtaaatattgcaactgatttaaaagttccattttctgatgcagtaaaagagtattttaaagaaaatccaaaatctaatgatccgagaaaatatatgacaccaggaaaagaggccatgaaaaaaattgttgaacataaaatcagagtatgtggaagtgaaaatagatattaatatattcatagatagagacaaaaaagtccactatgaaaaaaaatcttaggaatagaatgtcactaaacctaagaaaaaataaatttaaaataaatttaaaatgtaattactattatatcaaataaaataaaataataatagatggtaaattaaaaatataagagcgtgggaaataatatatcctacgcttttacaaaattaataaaaatcttaatgtttattatgattgaaaataatttttataaaatgtcacaacagattaaagtatagttttaaatacattattaaaaattatatttgaagattaaataattaatattaagtaaaaaataaaatttaagcataagaaataaataggaggaaggttaatgatattagttttaaatttaaatgcatctgtagataaaagatatgagttaaatgatataaaaaaagatacggtaatgagagctagaagtgtagagaatactccaggaggaaagggaatacatgttgcaaatgtatcaacaatattaaaagaagattgcatcgtaactgggtttgttggaggtaaaagtggtgaatttatagaggaaaaacttaaagattatggtataaatcaagattttgtaaaaataaaaggagaaactagagaatgtttagcatttataacagatgatcttgtacaaacagaaatacttgagccaggtccaatagttagtgaatatgaacaacaggaatttttgcaaaaatatatagaacttataaataattgcgatgtcattgttgcttcaggaagtttacctaaaaatgttccaagtactttttatagaaatttaatcgaactagctaatgcacaaaataagaaatttttattagatactagtggggaagcattaaaagaaggtatagaaggaaaaccttattttataaaacctaataaggatgagatagaagcgttaacaggaagaaagattagttcagtagaggatgcagtaagagaaataaaagaatttcataaaaagggtataaagtttgttataatttcattgggaaaagatggttctatagctggaataaacaatgaattatatagagttacatttccacaagtagaagcagttaatccagttggctcaggtgattcatatgttgcgggaattgcaattggaattcaaagaaaatatgatgtaaaggatatactaaaacttgcatcagcatgtggaacagctaatgcattagaaaaagaaactggggttgtttctgaaagtgtagttaaagaattatttgataaggttgaagtaaataaaattatggaaaaataaatattaaattattattgtagtttaaatataaagtttaaagtattggagaggtttcacatgatttattcattagaaaattcaaaaattaagataacagcaagtactcatggtgcagaattgcattcaataacacacaaagaagataatacagaatatttatggaacagagacgaaaaatattggaaatatagttcaccgcatttattccctatagttggtaaggttgtagattctaaatatagaattggcgataacgtatatcaattaccagcacatggaatcgctagggtatctgaatttaagttagtagaaaaaacagattcttctattagttttaaattagattactgtgatgaatcacttaaagtatacccatataaatttagttttgaagtaactcatacaattaaggataatagtgttatcacaacttataatgttagaaatttagataataaggaaatatatttctgtgtaggaggacatccagcatttatgtgtcctattgaagtaaaagataaactagaagattgttatcttgaatttaatgaaaaagaaacaatatcagcattaatggtcaatgatgaggcttattttttacataacagaaaagacatattaaatgaatctagtattattaatttatctaaagatttatttaaacaaggtgtattaacttttgataatcttaaatcaaataagatatcaataaaatcgaaaaataataataaagttttaactgtagattttggtgaatttgattatatagcaatatgggcgcctgaaaaaggagcaccatttgtttgtatagaaccttggtttggccatgctgattatgttgattttaatggtcaatttaaggataaagaaggaattgttaaattagaagaaggaaaagaattttcagcatcttataagatttatgtgaaataaaattaaattcttttattcaaaagctgcaaaattctaaaaggctagatattgtattcaaaaatatctagccttaaaattattttacttattcttcacagacatcaactgctttcatttcaccagtaatagaatccataacatatcctgaaacatgtatatcctttggaattaatggatgcatacgtaacatttctactgttttttcaacagatacttcaacagattcaaatcctcgtagccattggttaaaatcaattccgcaatatttaatcatatcaatttgctcttgtgagattcctctatcaagcatatgtttaatcatactttcgctattgatgttttgaacgccacaatcagtatgaccaattaccataatgttttctacaccaagttcaaatattgctatcaataaacttctaacaacactaccaaaaggatttgaaattattccaccagcatttttgattatttttatgtctccatttttaaatcctaaagatgctggaagtaactccattaatctagtatccatacatgttaatattgctatttttttttcgggatatttagttgttttgtatttttcatactcacgtttttcaacaaattctttgttgtattttagcatttcattcataattttaattctcctttatagcaaaaatgtagatttttttatataaatttaactaatttatataattttagtgtaaattttgagactacgtaaatttattaaacatattataccataattaatattaagtgtacttatattttgtataattaaattttgctcgtatttagtaaaattttttatttattcaaattttaatgatattttgcaatactttgattataattatataaggattagttaataagagtaacagggggattttcttaatgaataagaaacagattataggtcttatagtggcagcagtagcatttatctgtgtaagcggatcaagtgtacttataaattcatattcgagcaatattgcaaaggaatcagaagaatcactaaaagcagtagcgttatctagcgatgtaagtcttccatcagaagaatttgtaggagttgttaaggtagaaggtacaattcaaagttcatcagggagtgatagtatattctctacaccacaagggtacaatcataaaaaaactttaagttatattgattcaatgattaaatcaaatagcaataaaggaataattttatatgtaaatagcccaggtggtggagtttatgaatctgatgagctttatctaaaattaaaagagtataaagaaaagacaggaagaccagtttggacatatatgagcagccgtgcatgttcaggtggatattatatttctatggcttctgataagatttatgcaaatagaaattgctggacgggttctattggtgttattacttcacttgtaaatgtaaaaggattatatgataaacttggaatagaagaaatagatattacaagtggtcctaataaagctatgggatcatcaggtcgagaaatgacagatgaacaaagagccatacttcaaagtcttgtagatgaagcttatgaccagtttgctggaattgtagcagaaggaagacatatggatattgaaactgtaaaaccgattgcggacggtcgtgtctactcagcaaatcaagcacttcaattaggattaattgataatgttgatacttatgataatatgcaaaaggatatgcttgactatatcggaagtgacgttacggtatatacaccagaagttcaagaaaatgtattttcatcattattttcaaagatggaaggaataaagagtaaatctgatgcacaggtgatttcagattacttagaaaaagcaggtaatggaggcttgatgtattatgctgaacaataataatcaggaagttttatatgcaggtttttttgtaaggttatgggcatatattattgactgcgttattgtaggatgtgcaatgcttgtaataagaataccaatgtttataattgctttaatatatccagatgcttttttatttaaacatatattgtttagattttctataattgatatagctatttatttatttactgtttcgtattttatatttatgacttatagatatggtgctacatttggtaaaatggttatgaaaataagagtttataaagaaaatgaagaaagactttctattatagatgtaatatatagagaaacaattggaagatatttaagtagtctgattttatgtataggatatatttttattggcatagataatagaaaaagagcattacatgatatgttatgtgataccgtggtattatataattttaatataaaacaacaaaaacctgtttgtgatatagtttcaattccagaaaagaatgaagatgcgcaaggcagtgtataataaataaaaatttgtttatagcttattaaagtattgattacttataaatagcatgtgtacttaatttatgtaagaacacatgctatttttatttattatttaattttatcatatactattggatcaataaatccaaaagttattttatcatttttataaaaaacttcacttacagatagagtatttttagtaattgtttcttttaaaataaatttagtttctggtgtaaaaaagcttatactttctccagtaaaaactccattattttctgtataaatcataggagtaaacttttcagatttttgaagttgattataatccatagttaagtcatggttatcatttctaaaatcctcttttgaaattccagaaggaagttcatatgaagtcaaaactatatttttattttcattaagtgtaaaaaggaaaagatgtggaagtatatttttaaaagttccttgttcgtagtaactttcctcaataataaaatatccattgaaatctttaggaagattattaattttatgattgcaaattccatttatatgttttgctttgggatgaattattttaccttgtttttcctcttgaataatttgattgtcattgttaaattccccacataattgttctgtaaatttagataaaatatccatatatttagctcctttcatcactttataaaatttccacattacagaagaaattttaatatatcagtttatgtaaaattatatatacactatatcaatattttttttaaaagtacattaccatataacaattttattaaaataaaaaatacataatttatatacaaaaaaataaaaaatgtacaaatgtttatggaaattaattgataaaataaagttgaaattaaacgcaagcgttttcattaattagaaaaaaatagtatttaagatagaaaagtatagaagttaggagagattaattatggtagaaaagaatttagaaaaaatattaaatgagaaatttgataagaaattaagtacagcaactaatgaggaaatttactctgcattactacatttaacaaaagcagaatcaaaagaaaaaggtacaaataaaggtagtaaaaaattatactacatttcagcagaatttttaattggtaaattattatctaataatttaataaatttagggttatatgatgaagttaaaaaagtattatctgaaaatggtaaagatttaactgaaattgaagaaatggagttagaaccttcattaggtaatggtggtcttggaagacttgcagcttgttttttagattcaattgcaactttaggattaaatggtgatggtgttggactaaattatcattttggattatttcaacaagtatttgaagacaacaagcaaaaagcttttaagaacccatggttaacagatgaaagctggctaaataaaactgatattaaatttgaagttccatttggaggatttaaagtatcttcaactttatacgatattgatgtaactggatatgacaagccttgtaataaattaagattatttgatatagatacagttgatgaatctcttgtaggagaaggaattgattttgataagactgatatagaaaagaatctaactttattcttatatccagatgatagtgatgatgcaggtagaatattaagagtttatcaacaatactttatggtaagtaatgcagctcaattaatattacttgaagctgaagaaaatggatatgatcttcataaattacatgaacatgtagcagttcaaattaatgatacacatccatctatggtaattccagaattaataagattattaggtcaaaaaggaattggaatggatgaagctattgatatagttactaagacatgtgcttatactaaccatacaatacttgcagaagcattagaaaaatggccaatagattatttagaaaaagcagttccacaattaatgccaataataagagaattagataatagagtaaaagctaaatatgacgatgaaaaagtttatattatagatgatgaaaaaagagttcatatggctcatatggatatacattacggatatagtgtaaatggtgttgcagcacttcatacagaaatattaaaagatgaagaattaaagccattctttgatatatatccagaaagattcaacaataagacaaatggtattacatttagaagatggttattacactgtaataatgaattaacagatttcataactgagcttattggtgatgactataagaaaaatgctgataagttagaagaattatctaaattcattgatgataagaaggtattaactagacttgaacaaatcaaaaagaacaataaaattgctttaaagaaatatttaaaagaaactcaaaatttagaacttaatgaaaactctatatttgatattcaaattaagagacttcacgaatataagagacaacaaatgaatgttttatatataattaataaatatctagaaattaagagtggtaaaatacctacaactccaattactatgatatttggagctaaggctgcaccagcttatgtaattgcacaagatattattcatacaatcttatgtttacaagaaataattgataaagatccagaagttaataaatatttaaatgtatttatggttgaaaattataatgtaactaaagcttctaaattaatcccagcatgtgatgtttcagaacaaatttctcttgcatcaaaagaagcttcaggtactggtaacatgaagtttatgttaaatggtgcattaactcttggaacagaagatggtgcaaatgttgaaattcatcaattggttggagatgataatatctatatctttggtgaatcttcagaagaagttatagaacattataagaatgcagattatgtttcaaaagaatactatgaaaaagaaaatattaaagaattagttgatttcattataagtgatgaaatgcttgaagttggagataaggaaaacttaactagacttcataaagagttaataaacaaagattggtttatgacattattagatattgaagattatattaagactaaggatagagtatttaaggattatgaagacagagaagcttggaataagaaagtattaataaacataagtaaggcaggattcttctcttctgaccgtacaatagctcaatacaatgatgatatatggcatttataatttatagaatgcatattggaaaaagctaattaacatttgtaaagaactcaattcatggctacaattttaataacctataatataggttaaataataaatacctcattaagcttctcgcttaatgaggtattttttagccaaaattttcatttctatattttgaaggggatacacctgtgaattgtttgaatactctatagaaatgactctgatcatgaaaaccaagacgaagacttatatctaatacactatcattggtggtttttaaaagaacttctgcacgctctatgcgtattttttttgcataattcataattgttattcccatatgctttttaaagcagtctgatatataaccttcagaaagattcagttcacttgcaagtttttttaatgaaattttactttctatatttagatgaagatgttttagtattcgatttattacaaaactgttagtaacttcagtatcattaattaaaagattaagataagtatccaccatttcaagttcaatttcttgaagtttttttactgaattaatagatgtaatttgtttgtaaaatttattataggtaggatgtaggtattttgttgctatcccattttttattacttcttttgaaaaaatagcattccatataaaaagttctacttttttctcattagttgatatttcatcaatgagttcgtttttatgtttagtttttacgatatggataatttcaggcttatcatgaagttcaattaagaatgaaattttattactgaaaatattaagatctgataaaaaagtatcttccataagtctaacacctctttcaaaattttacctatttctataaaaacatattgtatatatacatattatatgagatatatacaataattagcaatagtatctgttataataatctcataaagaacagttaaggtttagtaactttcttacccggggatgttatagatactagccaaagttatattaattttggaggcgaataaaagatgaacaaatatgcagtatatcatgttacagaggcaccatattcatattcaaaggatataaatacattaactttaagagtaagagcggcaaaagatgatattaaaaaatgtattgtttattataaggataagtacctagataatagtccatatgaggaaaaggagatgattcttgctgctaaatgtgaactatttgaatattttcaaactgatataagtatttttagaaataggtatcaatattattttaaaatgatagattataatgaaaatacacattatttaactgaacgaggagtaaaggatgatgacagcttaatatatccttatatctttccatatatagcaactgaggatgtttatgaggatgtaaaatggatgcaggagtctgtggtctatcaaatttttccagaaaggttttgtaatggagatgaaagtataaatccagaaggtactcttccatggggaaaggaagaaaatttaaactattattcaagatatggtggagatataaagggaattacaaaaagattagattatttagaggaattaggaattgatacaatttatcttacaccaatatttaaatctaaaacagcacataaatatgatactagtgattatttcaatattgatccgcaatttggaactgttgatgatgtaagggaattagtagagaatgctcatgaaaaggggattaaaataatacttgatgctgtgtttaatcactctggtgaagatttctttgcatttaaagatttgcttgaaaatcagaagaattctaaatataaagattggtattttattgatagctatcctgtttcaatggaaaatgaaaactattacacatttggacacagacattttaatatgcctaaattaaatactaataatgaagaagttaaagagtatttattaaaagtaggtgaatattgggtaaaagagataggaatagatggatggcgtttagatgtatgtgatgaaataggacatgatttttggagagcatttagaaagcgaataaaacatgttaataaaaatgcagtgataattggagaaataatgcatgaagcaaattcttttttaaaggggatcagcttgatagtattatgaattatccatttaaaaatgcagttacagatttttttgcaaaaagatcaataagtagctgtgagttttcagatattttagcaagtaataggatgttatatatggattctgttacaaagcagatgtggaatttaatagatagtcatgatacaaaaagatttttatcagaatgtaatgataatgtgacatttatgaaattagcagttgctttccaatttacttatttaggggttccgtatatttattatggtgatgaaatagggatgaatggtggagatgatccatttaatagaagatgtatgatatgggaaaaagaaaatcaaaataaggatatgtttgaatattttaaaaagcttataaaaataagaaaagataataaagctcttgtttatggagagtataaagaactttgctgtgaagataatcttattgcatttgaaagaaattataatgatgagcatattgtagtagttattaataataataatgaagataaaaaatttataaatgcttatgagttaagtggaacagatattataaatggacaacaaattgaaaaatctttagaagttgatattgacaaaatgagtataaaaataataaaaataaataataaataatttaaaaataaatttgattttgaaaagagacattataaataaaaaatgtctctttttatttataatacaatactgttctattaaaaatatataaataatattgtgaaaaattaaagactattatttttaatttcttttaaaataaaagtgatgatataaacaacaatatattttaaaaatcgagcaatatttacaaatgataatgtgtttataaattagtaaatccttgattttcatattaaaaatatagtaagataataatgattgctttaaaaatagcacatatgttgctattttatattactaaagatttaagaaaaattaggtttttattaatataaaaggaatagaaaacagtacaaaagataaacatattattaagcaaaattttaataataaattagtttaataatataaatttacacacgataaaatggagggaaaaacatgtatagtagtgatattgatgttattactaaaatggctgaaaaaaaggccagaaatgcaaatgaaaagacaggaaaatatttaggaagagctgttgttactggattttatatattagtagcaattattctttcatatacaacaggagcgattctttatcctaaataccctgaagtttctaaagtaattattgcggcaacattctgttttgccatagcgttaatagtatttttaagtggagagctatttacaggtaataattttgtaatggcagtagggttatttaaagggaaagttagtgttagttctacattaaaggtatggatttacacatttttaggaaatgcagtaggtcttattatatttgcttatttgtttattaaaagtggagcttctttcactccgattcagcattatatagaatctgttgcgtatgctaaattagagttaccagcttatcaaatgtttttaagaggtttgttatgtaactttatagtttgcttagcttatttatcaggaattaagatgaagtcagaaagcggaaagttaataatgatgttcttctctgtatttgcatttattattgcaggatttgaacatagtattgctaacgttggtgtattttctatagcttattttgcattaggtggattaccaatggcgctagtattcaagaacttattctttgttgttttaggaaatataattggtggaggcctactattaggcggttcattagtatatataagtacagatgaagaacattaaaatttaattagaaataaaagtgatatgatgttagagttaattttcatattgcttttatttttttatagaaaaatatttttattataagacatttagacctagcattaaattttaaggctgggtctaaatttattgaatcaaatagtaatagaataattaatttatataagagaagataattttagacagttgatatatactaatgataaaatataataagaaattttatttatgatcgataaataatttagttaataaaagatggtgagctaatgattaaagtaaaattagaaataaataaaaatagaaaaataatttttaaagttaaagtagatgaaaaagatagaaataatgtttttttcaaaagagctataattgaaggaaaaccactaaaaaagggtgcaagatataattatgaaattcctcttagattttttatacctatatgtagtaatgtgggagaaaatcaattaattatagataaaaacagtatattatcatacttagagttttcggattattatgatgagaattactatacagaagtaatagctgatgcaaaatatatgaagaaatggagagaagagggatgcccagatatttataaaataacaattgatcctgaaactttgaaagtaaagaaagaaattgcatttaaaaagccacgtatgtctttaaacactatagatatttgataaatatggagatgagtatgtactatggaacaaatttatataaaaaagaaaaaccttagacaagatattcttaatataagaaataatatgaatgaaagtcaaaagaaagataaagataactttattagagaaaaatttttaaaaagtgagtattataaaaagtctaataaaatatttatttatatatcatacagttcggaaataaacacaatagaaatcattaataaagcattggatgatggtaaaaagatttttgttccaagaacgatttttgagaccaaagtaatggatgcagtaaaaattaattcattaaataatttgaaaaaagatagatatggtatacctgaaccggcattgcatgagccatatattgatccagatgaacttgatttaatagttgttcctggtgttgcctttgataaagaaggtggaagaatggggtacggtgcaggatattatgatagatactttaaaaagatttctgaggaaagaaaagaagaaataaaaaaagtagcattagcatatgattttcaagttattgaagaagtacctatggacaagcaagatgttaaaattgactgtattataacagaaaaacaaattattaaataatagtattattgaaggtgaaataaagctatgaaatacaatgaaagtaattttacttatttaaaattaactactttaaataaatattatcaatacttattaaaagcagagtgtgcgtgtgaagattttcctaagatgactaaaataatagcaaggagagtagttgatgcatttgtaagggagttatcaatttcttatggaatcaattctaatattgctacaggtcaaatggttaaaatgctgcgatacaatgaggaattttcaattcctgaagaaatatatgattatattcaaataataagagtgaatggaataggaataaccttgtatagaagcagagagaaaagaatagagaagcatccaattgaaattctggaattaatccataggattttttgttggtatttaagaataaaagaaactgaaaccataagtaaatttatagatttaagttttaaggcaccaaaaactattgaatttgaaaaaaatgaattaaaaaagataaagagagatattcaattaaaaaataatcagattaataatttaagagaaaagattattgaacttgcaatgaactcaaaaagtgtaggtgaacttaataggattataatagctattaaacaagaaaaagaagaattagaaaaacaagaatcattttttacagaagtaataaattctcataaatatgaaatagaagaagtacataagatatatgaaagagaaataagagaagttgatttagtaaaggacgaatgtgttgagaatcatagattacttgctaaaaaagaaagtcttttagtaagagcggagcttgataaacaacaaataaaatcaataattgataatcttgaggaagatgaagatattattaataaaagaaaagataatattgaaaaacagcttgaatctattagattatcatatgaaaagtctttaggtttaactaatagatatcaagatgaaagtgaaacaataatttttacttatgatgataatttaaaaaagttactaagtaatgacaagtcagaaataatttcagagttaaattttgaagatagtaaattttataataaaataacagaatataataaattaattgaagatacaaagaaaaaaatcactttattcaaaggaatacttgatgatagaattagacatttagtaaaatatgatgatttttacaatgcctttttaaatcttaatggtaataaattaagaattttgtatagtatggtaagcaattggaataagaataattcaaatatactatctaaatcgaaagagtggttattaaatcgaagcaatgaggaatcacttttagatatggtaaataaaacattagaagagataaaaagtctttcggatgatcaaattaaattatcattgtattataaagttttaaggatttctggtgttcagattaaaaatatatgtaatagaaaaaactttattaaagctgtagatagtatggttcaaagtgcatatgttactttattagaaaataaagattttaactactatttgtcaaagactcattctatcaaagtatgttatatgaaaaaagtaattgaaaagctaaaaagcagatataaaaatataaagataaaagacgaattagtatataggatatatgatgagattgttaaaataagttttaaaaatgaagtttattttacagaatcattaaagatcgatgttaaaaatgagcacgctttaaaaaattctataaagaaacagccttttgattttttatcaataattattgaagttggtgaagaagctgattacaagtttgtatatggaattatttttgaaatattaaaagatattacagttaataattataatactacaggagagcaactttctttagaaaaatttttgacaggttctttcagaattatgctatttatatctagtaatgatgtattaaatagtagggacttagaagaagtaattgtcttatttgttggtgaagttctgataagtgattcaataattaattacgataaaattgattttgatagctacaatagaatgattgaagtgtggaaaagtaaacagattttttataaagataagcttaatgagaaaaatgatattgataatgaattagaggctatagtggatgaaaagcttaatcttgaaagtaatatagaagccttaaatagtgaggaaaaaacattgaaacaaaattatgcaagttatgaagaagagtttaagcatatggtgttttcatcagaaaaaagtaatgttcttgagtcctatggaaaatacaaagaatttaagagtaaaatgcaagaatcaagaagttctaataatataagtagcgaaagttcaataatagaaacatgggttgaacaggcatcaaagatgataaatgaatcaaatttggcacaatcagaaataaagcttatagaagaagccaagaaaagtggattttttgaaagggagttaaaagtatttactgatcttgaagaatggctcaaagatattgaaaatgatctttataataatagaaaaatacttagagaaaaagaagaagaattttctttaatgaaatcaaaagcagagaagttaagtgaatatttagatacactcaaagaaatatatcccgatattgagtaatatttataattttaaattcactaattttcattattggagtataattatattaatttgattaaaatttttacaatgttaatatacattgtaaaaatatgaagtgaaaaattatatgattaacattttaagggggcttaaacatatgaaaattgaaactaaatgcttacatgagggttataagccaaaaaatggtgaacctgtagcactacctatttatcaaagtacaacgtacagatatgataatacagatgaaattggaaagttatttgatttaacagctgatggtcatatgtattcacgtatatcaaatccgacagtaggagctgttgaagaaaaaatagcttctttagaaggaggaattggtgcactttgtacaacatcaggtcaagcagcttcacttataagtgtattgaatattatgggggcaggagatcatattgtaagtgcagcgactatatatggtggaacaatcaatctttttgcagttacacttaaaaaatttggtatagagtgtacgtttgttgatgcagatgcaagtgaagaagaaattcaaaaagcattcagaccaaatacaaaagctgtatttggagaaacaattgcaaatcctgccatatgtatattcgatattgaaaagtttgcaaagattgcacataagaacaatgttcctcttattatagacaatacatttgcgactccggttttatgtagacctattgaatttggagcagatatagttgttcattcgactacaaagtatatggatggtcatgctgtacaaattggcggagtaattgttgatagtggtaattttgattggacaaatggaaaatttccagagtttacacaaccagatgaatcttatcacggaatagtgtatacagagaaatttggaaaagcagcatacataacaaaggcaagagttcagcttatgagagatttaggcatgtatccatcagctcaagcagcttttcttctaaaccttggcttagaaacacttccagtgagaatagaaaaacactgcagaaatgcagaaaaaattgcagaatatttaaattctcatgaaaagatagagtttgttaattatccaactctttcagataataaatattatgatatagctaaaaagtatctaccaaatggatgtagtggagtagtttctttttcaataaagggaagtagggaggatgcaataagatttatggatagcttaaagttatgcgaaaatgtagttcatgttgcagatatacgtacatgcgtgcttcatccagcaagtgctacacatcgtcaattaaatgatgaacaacttgttgcagcaggtataactccagggcttgtaagattatccgttggtcttgagaatattgatgatataattggagacgtaaaacaagcattagagcaagtttaatattagtataattaaaagaacttagtgtatatactaagttctttttaattatattattataaaaatttattatctttctttgttagcaacttcagatacgattctgtctacgaatgcatttaagtccatagcaccttcatcatcgttctttctgcttcttacagaaacctgattattttcagcttctttttcaccaacaactaagatatatggagttctttcaagtctagcttctctaattttgtaaccaattttttcagctctgtagtcagtctcaactcttatacctttatcttttaatgctttagttaccttttcagcataatcattatatttatctgaaagtggtaaaattttagcttgaactggagataaccatgttgggaatgcaccagcatattcttctataagcattgcaagtgttctttcataacatccgattgatgatctatgaatgatgtaaggacgtttcttttcaccattcttatcaatgtatgtcatatcaaatctttcagctaaagcaaagtcgatttgtactgtgaataaagtatcttcttttccgtgtacatttctgaattgtaagtcaagctttggaccatagaatgctgcttcatcatcagcttcaacatagtttatttttaagtggtctaatatatttctcatagtatcttgagtgtggttccaagcatcaggatcattaatatatttttctgtattgtttggatcccattttgagaatctataagttatcttttcagcaattcctagagttcccataaggtattgaattaattcaacaactcccttgaattcttcttctaattgttctggtgtaacaattaagtgtccgtcagctaatgtaaattgtctaactcttataagaccatgcatttctccagatgcttcatttctgaatagagtagaagtttctgcataacgtataggaagatctctatagctgtgttgttcagcattgtaaatagtatattggaaaggacaagtcattggtcttaatgcgaaaacttcatcatccttttcttcatcacctaatacaaacataccatctttataatgatcccagtgtcctgaaaccttgtataaatcactcttagccataagtggagttttagttaaaacataacctcttttttcttcttcatcttcaacccatctttgaagagtttgaacgattttagctccttttggcattaatagtggaagaccttgaccaaccttctcgtcagtagtgaataattttaattctcttcctaatttgttatgatctcttttcttagcttcttctaaagcttctaagaattcatcaagttcagctttctttaagaatgcagttccatagattcttgtaagcattttgttcttttcgttacctttccagtaagcaccagcacttctagtaagctttatagctttgatgttctttaacgacataacgtgaggtccagcacataaatcagtgaaatcaccaattttgtagaatgaaataatttcatcttcaggaagatcattaattaactctaccttgtatggttcatctttcattaattctaaagcttcgtctcttggaagttcaaatttttcaattgaaggattttcttttattatttttttcatttctgcttctaatttttctaaatcagcagatgtgaaagcagtatctctatcgaaatcatagtaaaatccagtagcaatagaaggcccaattgctaatttagtttcagggaatagtctttttacagcataagctaaaacgtgagatatactatgtcttacagcatcctttccttcttgtgaatcgaatgtacaaatacttaattctacatcttcattaactattgttctaaggtcgcaaacctttccgtttattgttccacaaaaagcatttctagcaaggccttcgctgattgatttagcaatgtctaaaactgatacaccagcttcaaattctttaacagatccatcttttaaagtaactttaatcattttaaatctcctctcaatatgtaagtgaattatttttatatttattaatttaagtttgtttaaacttaaatattgttacaaaatgaaaataaaaaaactccatctctaaaactatagagacgaagtaatatccgtggttccactctaattacctgaagaaagatataaacttaatataaattataaaaatataatttatatagttaaataccttaaaataggtcacttgaaattatcgtaacgtgataataacgggtcttattaggaccactcagaggtggttttcagtctaaagttatttaagaatactcacaccagtgtattctctctctgaaaaataagattttagcttactgtcctcatcaacgtgttatcttataataaatacaattataatgattgattttttctatgtcaacaatataatacaaaaaagtaattggatatatttattatatttataaattcattacaatatgtgtagactaaaaaaataaaaaatataaattatataggcaaaaactgttgaaaaagtaaaaacgaaaatcattgattttaaagattagagttgtataataatgttatgcagatgtggcggaattggcagacgcactagacttaggatctagcgccaattggtgtaagggttcgactcccttcatctgcaccattgttaaaaattaaaagtgctctgatacaaaatacttataattttgttgtacgatttttttataaataaagcatcattctttttgaaaattaagaatgatgctttttatattatacttccatatttcgtattaaattgtctaaggttaaattaacgatcatttcttctgtataaaatttctcgcccattattttgaatattatgtctgtttttttatagccttctttatataatttaagatttttagttattctttttaaagtattattaggtatttttaattctgaagccagctctttaaagtagtaataatcctttggaagcatttcaaaaagtttattttgaagatctagcttgtacctaagatctacttctttacagtgatgaggaccatatttaccacgatgatggtaagggcataaatatttgtaatttaattctatatcaaaaccgccttcgcttctatgaacaatatgatgtatatcagcttgggcattgcatatttcacataaagccaattattaatcctccttaaatgctgtactaaattaatataagtctgcttaaaatataatataagactaatatgggttgtcttaatcaaaattacgacaaacaacagaatttgttgatgttattattataatttaatagtaataaaatagcaatttttagacttacattataaattaacaaaatagtaataaaatagaaagaaagtgggcaatatattaaaatgataaacaataaagtgaaattataaggtaaactaaacttgtaaataaagtacaatataccttataataaaagtaaggaaattttatagtacattatattaaaattatgtagggaaggtgaagaaaaaatgagagaaaactataattcttttgattactgggaaaacgttatccgagagaataaaaccattagaggacatatgtttatgcagaaaccacctacagaaaaaagtttatatttccatacattaatatttagtaagggaaatgggatgaataatatatggggatattttcctaatgtgaaaagcttaataggatatttacaatactcatttcttcaagaatctttttacaaatggatacatggaaaagataaattaataactagaatacctagcatttctgttgaaaaagtaatagaagatggtgaaagagcaaaaaaaataacaaaagagatagctgataaaatgaaaaaggattatcaatttcttagcaagttatgggatatgccatctagagatgcagaaagagaactaaagaaatttttaagagagttcaataaaaaatggattggagataatagagagttcttatatataaaattatttaaatctccaaaagaagttggtgattttgtagtatcatcagcaactataactaattcagaaggtgaattagaaagtaaaataggtatgaaaatagatgagtggttaaacctatgtgaaaatacattaaaagataaaaaatgtgcagaaaaatttagacagattttattaaagcgattaagtgaagtattataataaaaaacatctccttgactaatgtcaaagaggtgttttttttactttactgttttattattttattagttaacagaagctatgctttgagcagaaatcccaagcatttctccagtaaatccaagaccttcttctgttgtagctttaatattaatttggttaagatcaatattaagtgctttagctatgttttttctcatagtctcaatatgtggactcatttttggcttttgtgcaattattgtagcatcgatattgttaatagaatatccattttcaaaaataattcgtcctgtttcttcaagtaaatttatgcttgatattcctttgtattttatatctgtatctggaaaatgtcttccaatatcgcctaaagcgcatgcaccaagcagtgaatccattatagcatgaagaaggacatcggcatcagaatgacctaaaagacctttttcaaaagggatttcaactcctccaattattagttttctatcttcaactaatttatgaacatcatatcccattccaattctcatgtttatcacctcaatatattatttctaaaatatattttagcataatatattgaataaaataagttgcaaagagtaggtaaacatttacatacctgtatatatgaattaagtctaattaataaattttattaactaaagctttgttatttgtattaattgtaggtatttcactattagaaatagttgttctattagtaaaatagttaatcattttattaaaagtaaagtgaaagaagttgattcgacgttttttagtaaaatctacgtatataattttctttttcatacaccaatctcctaaatattgattttatatttatattttaagtatataaaattttatagatgcataaatttctatgctataatatatagtatgagaaatttataaaattgatattaatgtttaaagaggggttaactatatggatagcttaagttttaataaaaataaatatatatttacttcaatgcctaatatttcattagtaagcaattctgtagatgatagtagaagtaaacaggtttctttatttttagaagaactgtcctcatataatattatacttaaagatctggttaattatccattaaatgaagaaaagagaaatatatctttaaatgtatcttattacattatggaaaatgaagaaataagtgaaaagttagagcgaaaaaaagaacttcctataaaagatttatgcaaagatatacgaataaatagagaacgaattgaagatatgaaggactacatagttgcatactatttgattcttagaaatccaaactataaaataatacaagatactttaaaaataaaacttaaagaagatagtgataaagtaaaaagcataggagtagctaaaaaaaatacaatatataaaggagttgttataaagtcttttaagaaaagtgcatatataataacttcaattggtgaatttgtaaagataaaaacaaatagaaaagtaataattggacaactagcagatggaaaagagtgtacaagactaggaaaatataaaatacatattgcaataggtttgatgatattaatgatgattggttgtgcaactgtaattgattatagaaagactgaaagtatagttatagtagaaacaacttcaaatattaaaatgcatgtaaataagtatggaaaagtaatatacgcttattcaccaacagaaaaaggaaagattttaatatcaagtataagtattgagagcgaaaatatagatgaggcaatagaagaaatatttgaatatgctttttcaaatgaaatgattgatacaagtaaaaaaactttaataacagtttcaggaaagagtttagattatggtgctttacctaaaacaaataaatttatatctgaaaataaaatacctatagttataaataattctggaaatgagcaaaaaatgcctgaatatatctcagaagaataaaacaaacacattatatgacaaaaataatatatgtcatataatgtgttttttattttaagactatagtctataggtcaataattttaattattaatctataaatacttatgttatttagctgtattttttaataggtttttgaacgtattcatatcataagaagaacttatatatattctatcaagtttatatatgtcatcagttctatcagaaagacctaattttgtagtaaagcccattttatatcctgcatctttagctgcttttattgtattatcattgtaatctccaaaaggatatgctaaggagagtacttctttaccagttattttttcaagaatattcttagaatttttcaattctagtaattgttcatcatagctcattgtatcaagatgtacatgatttacagtatggctctctatatcgataccgtaatcagacatttcttttattgcttcttcagaaagataataagatccatctaatgaattaccaacacagaatattgtagctgtcatatttaattcttttaacattggaaatgcttctgtatagttattcatatatccatcatcaaaagttataaggatacttttttctggaattggtttattattttcaatatgatcgtaaagttctgtcattgtaatggtgacataattattatcatttatataatcaagttgttcttttagcttttcaggagttatagtaacttcattggctgcattttcatcgactgaatgataatacaaaacaggaataccgatattgtcagatgttaaagaaacattttcaaatctatttttgttattattattttgtatattatcatcaatggattcaattaaatttgaatatacactattttcagatttattatctgaattgacagagctgttattatttttactagtaacaccattgataaagatataagcaagtattaaaaaagtaattgataacagaattattattatatatttaaggttcttatttttcgtggtcataaaattttaaacctcctatattttgatatatatattacatatgtaagtatagataagtattaaaattttatcaataaaataatatattttagagaaaaataaagtagattgacttgttatttttgataatacataaagaaaaataatgagagatatactataaattagaataataatagaaaagtatagcataataaataagtagtacaacttattcacattatccacaatagcatgtggataaactgttataaatttgtttataaacaaattattacatgtgaaaaatgtggatatatatactaatatatcagaaaaagaaaatatattgggagtggtgtaatgaagttatcaacaacgtttatgggaatgtttattataggtagtatgttatgcacaggttataaacaaaatttgtacacaacatgtgaattatattttaataatgttattactcttgtggaaaagtcaataaataaagatgtaaagtatttaaaagaagatttaagaattcctcaattcaacaatggaaaaaatccagataatataaaaataattaatataaaaataaataatgatatatttcctaaagttaatgaagctgaacaaacggcatctgagtattatggagatttgcatgtagaaaaaccacaatttccatttgaaatttattctagatacacagttacaataaacaataattctataataagtttatataatgattattatgagtttcttggaggggcccatgggtcaactataaggacgtcatatacagttgataaagaagctgaaaagttacttaatctaaaggaactatttacatctgattatgattataaatcaataatcaatgatgaaataaaaaagcagattgctgctgaacctgataaatattttgaatcggcagacaactttaagggtataggagatagtcagaatttttatataagagggaaaaatttaattatttattatcagcaatatgaaatagcaccttatgttgctggaatacctgaatttaatatacctttagagaaatttggatctgattataaatatgctaattcaaaaatataaataaaaaatttagtatgaaagatcttgttatgtttcatactaaattttaataatagaatctttattaagttaataaatacttaaatacattttaaattttttgagagttatgagaattagtatttttatttcctctaaaaccataaccatcagaaatagttcgtcctatacttgtaatttttcctgtaatacatccacggcaatgtgcaggggtatcaccagtacaaattttaccgggatataatgcatacaattttctgtattcaccttctgtaacattaggcataactacattagcaccagcttgaagtgcttgtattcttccatttggagctaaagattccatagcagttgtagcaggaatgtttatatcaggtagaagaagtctcgttattgccataacttttaatgctaatgtaagagtaccgccttcagcattttttaatggagtatcttcattgggtataaagggaccaatgccaatcatatcagcattgatttctttaaaaaatagtatatctcttgcaattgattctaaagtttgtcctggaagcccaataaggataccgctaccaacttcataacctaatttgtctaagtcttttaaacattgaattctctcattaaaactcattccaggatccatagtttcataaagttttttatcagtggtttctatgcggattaagtatctatcagcacctgcatttttaaatgctttatattgatcaaaagtcttttcgccaaggcttagagtaagtgcaacacctaatgattttattttttttatgatacttaccattttttcagtagtaaaataatcatcttcaccaccttgaagtactaatgttttatacccatattgaactgcttttttagcaaaatctattatttcttcttctgttaatctatatcgctttaaattggcattatctcttctaaggccacaatacatacaatttcttttacatatgttagtgaattctataagacctcttaaatgaaccatattaccaagatatttttcacgaatatcatcagcagctttaaaaagcagttcattaatagaatcattttgtaatagacttaaaatttcaaattcgcttaaatcatgagttgatttagctttttcaatgatactgttcattacttcctcctagagttaaatattaatacaattatataataaaattacaaataaggacaatattgatattaaagtgattattatagtaaaaaatgactaaaatattaaaataagttataatataatgatatacaataaggaggtttggttatgacaggtcttgtattagaaggtggagcatttagagggttatttacagcaggtgttttagatgcattattggatataggagctgattttaaatacgttgtaggggtatcagctggtgcaacaaatgcatattcatatatatcaaagcaaaaaggacgaaatttagagattatggaaaagttcttggaccataaaaggtatgttggatatgggaatttaataagatgtaaatcaattatggatttagattttgtttttgatgagataccaaataaacattgtatttttgattacgatactttctatagttatgatggaaaaatgcttgtaggagcttttaatattgaaacaggaaaagttgaatattttgataaggattcacttgatgataaaaatatgattttacgagcaagttgtgctataccattgatgtttccatttgcaaagataaatggtaaattatatgctgatggaggattaaaagattctataccaataaaaaaatccatagtagatggtaataagaaaaatgtaattgtattaactagaaatgaaggatatgtaaaaaaacagtcaaaagctaataaattaacatataaactttataaaaataaatatcctaagcttgcagatgtactaaataataggtattcagaatataatagtcagataaaattttgtgaagaattagaaaaaaagggcgatgctattataataagacctacagtaaaaatggatgtatctagatttgaaagagataagaataaacttaaagaaatatataataatggttataatttgataattaatgataaggagaaaattcgtagttttttgtaaaaaagatactataagttagaatgagggcattgaaatatgttagagcaagataaaaattcaaaagtatatgaacaagtaattgaagaaattaaaaatcaaataaaaactggtaagctaaaaaagggagataaattaccatcagaaagagatatggttgaattattttctgtttcacgtacatcagtaagggaagcaatgagagcattagaagttattggacttattgaaagaaaacaaggtgctggaaattacataaaaactaattttgatgattcactttttgaacctatttcagttatgtttatgcttcaaaaaaattctctagacgatatagttgaattgagagaaattttagaaagttattgtataaagcttgcagtaagaaatatatctgaaagcgagattgaaacaataagtgaaataatggaggaaatgtatcaagcaaaaaatgaagaagaaaatttagcattagatataaaacttcattatcttctaattaaggcatcaaaaaatatattactaattaatataatttcagtaatatctcaaattatggatgaatcaataaaggaattcagaaagaaaattctttatgaagaaaataatagagctaagctattatctatacatgagaaattagttaatgctatgaaagaacatgatactgttaaggctgttgatgcaatagaagaacatttcaaattaattagaaaatactataaataaaaataagctgaaatcaaattgatttcagcttattttatttatttaaaaaaagaaaagatacagttagtatagtttgttaattataaagcaaatttaattaagaaaataataaataggaaattttttgatttacataatataattttatttctttgtttaattataaaaaacttaggaaatagctatatttacaattattatatataaatgaacttgtaaacatttactgttaaaaaaataacaattatttacaatgtataattatggaattataattatacttgtaagtggtaataccaattatgttaagagcattttatattcagtataaaaattgtgcgtattttatattgtgataacagaaatagtttgcgtttctgtaatcatatattttagatattaaagtgtatgggaggaattgtgtatgaatattttagtatgtattaaacaagtgccaggaacttctaaggtcgaagtggatccagttacaggagttctaaaaagagatggtatagattcaaagatgaatccatacgatttgtatgcattagaaacagcattaagaataagggaagaaaaaggtgggactataaaagttttaagtatgggaccaccacaagctttaagtgtaattaaggaagcatactcaatgggggtagatgacggtgtgcttttatctgatagaaaatttggtggagcagatgtattggctacatcttatacattgtctcaaggtgtaagaaaaatgggtgattttgacttaataatatgtggaaagcagacaacagatggagatactgcacaagttggtgcagaaatagcagaatatcttggaataccacatgcggctaatattgaaaaaatatatagtattgatgaagaatctataacagtagatatggacatgcctgaaactacagagaaaataaaaatacaatatccttgtttaataaccgtagataaagggatttttgaaccaagattgccatcatataaaaagaaattaactacaaaggacagagaaattaaaattttaagtttaaatgattttaatgataaagaagaaaataattatggattaaacggttcagctactcaagttgaaagaatattcccacctacagttaatacagacagagaaatgtggacaggtaaatcggaagaattgacagataagatattaaacaaattaaaagaagtaaaatttatttaataaagattctagaattcattagattatatttgggaggagaaaaagtttatgggtaagttaatagttaatcaagagaaaattaaagatattgaagaaatgataaaaatatgcccatttggagcaattgaatatattgatggtaaaattcagatgaatgcagcatgtaaaatgtgtaagctttgtgtgaaaaaaggaccaaagggtgctatagaatatattgaagatcagataaaggaaatagataaagatgaatggaaggggattgctgtttatgttgatcatgtaaagggaaaaatacatcctgttacttatgagttaataggaaaagcaattgaattggcagaaaaaataaatcagcaggtttatgcagtatttattggaaataatatattaagtgaagcagaagaattattacattatggagttgataaagtatttgtatatgatgatgaagaactaaaagactttagaattgaatcgtatacatctgcatttgaagattttataaacaataataagccaacagccatactagttggtgcaacaacaataggaagatctttagcacctagggttgcagctagatttaaaactggtttgactgctgattgtactgttttagaaatgaaagaaaatacagatttagttcagataagaccagcatttggaggcaatataatggctcaaatagtaactccaaattcaagaccacagctagcaacagttagatataaagttatggaggcaccagaaagatcagagactgcaaaaggagaaatagtaacatgtaatgttgataaggaaaaattaaaatcaggaataagcgttattgaaataaaagaaaaaattatagaacgtggaataagtgatgcagaggttattgttgcagctggaagaggcgtaaaatcggaaaaggatttgaaaatagttaaggagttagcagaagcattagatgctgaatttgcatgtacaagaccacttattgaggctggatgggttgatgcaaaaagacagattggattaagtggaagaactgtaaggcctaaattaataataacttgtggaatatctggagctgttcaattttcagctggaatgaacaactctgactgtattatttctattaatactgattcaaaagcacctatatttaaaatttctcactatggaattgtaggggatatatatgatatcattccacaattaacagagaaaatcaaaatggtaaaggagagatagagatatgggcaataaatacaaaaacattgaaatagaagattatgaaagcatattagaattaataggcaatgataaagaaagagtattttttagagatgaagtaaatgaagattatagtcacgatgaacttggtggaataaagaagatgccagatatagtagttcaagtattatgtactgatgaagtatcaaaaataatgaaatatgcttacgataataatataccagtaactccaagaggatctggtacaggacttgttggggcagcagttccattagagggcggaatagttatagatttaagtaaaatgaataaaatattagagctagatgaagagaatcttacattaacattagaaccaggcgttttattaatggaaattggaaaatatgttgaagaagcagatttattttatccaccagatccaggtgaaaagtcagcaacaataggtggaaatataagtacaaatgcaggtggtatgagggcagtaaaatatggtgttacaagagattatgtgcgtggacttgaagtggttcttcctaatggtaatatagtaaatttaggtggaaaggttgttaaaaacagctctggatatgcattaaaggatttaatgattggatctgaaggaactttaggaatagttacaaaggcaatactaagactacttcctttaccaaaaaaatctttaagccttttaataccttttaatacccttgaaaatgcaataaaaacagttcctaaaataattaaatcaaaatctataccaacagctattgaatttatgcaaagagatgctattttagctgcagaggaatttttaggaaagagttttcctgataagtcatcagatgcgtatttgttattgacttttgatggtaattctactgaagaaatagaaaaggattatgaaaaagttgcagatatctgcttagaatctggtgctatagatgtatttatatctgatacagaagaaagacaagaagcaatatggtctgcaagaggatgttttcttgaagctattaaagcattaacaacagaaatggacgaagttgatgttgttgttccaagaaataagatagatcagtttgttacatttacacataatcttgaagctacaagtggcgtaaggataaagagttttggtcatgcaggtgatggaaatcttcatatttatatattaagagatgagttaaatgacaatgagtgggatgaaaaaatacattctataatgaagatgatgtatgataaagcacaatctttaagaggacaagtttctggtgaacatggaatagggtttgcaaagaaatcttatttacaatcatcattaccagatgattgtatagaaataatgaagggtataaaatctgcatttgaccctaaaaacattttaaatcctggaaaggtctgtgaataagcataaaatttatatttacaattttatattaatattataaaataaagaatatgttaaaaataagctctggaagccaaatggtccagagctttttgttgcaattaagaacagggtatgattaaatggttaatggttacattttagcaaaatgtttttttatttgatgattatagattaaaaaatagattaaaaaatagattaaaaaggagacatttacttgaaagaaaaagatataaaattaactgataataatattatagaaatggatataaataagaaagaaaagcacgaatgttataaatgcggtgaagaagcaattttttataatacagaagttgaaaaatggatatgtgaagattgcaaaaatattgaagatgagttagataaacttgcagcaaaaatggagaagaagcttagcaaaagggtatattcttttgatttaaaagaacttattgaatgtttatcaaaagatgagatatataatatagctagaaacttaggcgttgcaaaaatttctggtttaaataaagataaattagctgaaaagcttatagaagagtataaacctctaatagaaaagagaatagggttatttgaagaagaaagatataaaatattaaagagctatattgataataaaggtgtaaagaattttgatgatatagatgaagaagaagctgataagagtgcatattttatacaacaaggtataatataccctacagttaagaatgacgagtcaatgttcttgatgcctaaggttgttcaaaagattattaaagataagaatgatatagattatagacgaatattaaaaggtaatacagagttgattaatatatacagaggtatgaacaaagcatatggtatattaaaagttgaagatgccgtgaagatgcttgaaagatttaatgaaaatactgatgtaagcttactggaattacttagagaagcatcatattattataacgaatttagagaagaaaatagttacttcataaataatgaaatagataattatgaagaagttttaaatgatataaaaaaagaagatataaaggaatatgcagttatatcaaaagaagaattattgagtatgaacggagaaaactgggtttacaatagtaaagcaggaaagtcattctataaagaatttacatctatgtttagtgtagataaggatatgacaattgctatgatggatgatttggctcttgatgttcaagaattagaaccttcagaggctgttgataaaatgattgaacttattaatatagacaatgaagaagttagatttgtagcatcaaaaatgatgaataagtttgttaataagataagattatggaaattaaaaggtatttcaaccaattatgcaaaagcaaatgttataagcgaagtatcaaacaaggttgttggaagaaatgatccatgtacatgtggaagtggaaagaaatataagaagtgttgtggaagaaatggaaatgtagttgtacttcctataaaataacttttaaaaatataagaatatttaagtacataaaattaataagtgaatagttatattgacataaaagatataaaatgataaaattttaccaaagcgaagatgttttaaacatcttcgctttcttttttttgttttttgtaaaactgttattatttaaggaggcaattttatgattaagacagtagtatcggttggtcttccagttgatgaaaatatgattataagaaaaaacactttaattccagaagaaattaaaggagatgaaaagagaatttgtatcgttacaggaactcatggagatgagcttgaaggacaatatgtatgctatgaattaaatagaatcataaacagcaatattgataagttaaaaggaatagtagatatttatccagcattgaatccactcggtatagattcgattcaacgaggaataccaatgtttgatttagacatgaatagaatatttccaggtaatgaaaatggtgctatggctgagcatgtagcatctcagataatatctgatattaaaggtgcggatatgtgcattgatattcatgcaagtaatatttttttaagagaaataccgcaagtaaggataaacgaaaataataaagatacacttatgaattatgcaaaattattaaatacagattttatatgggttcacggttctgcaactgttttagaagcaacccttgcatatagtttaaattcaattaatgttcctacacttgttgttgaaatgggagtgggaatgaggataacagaaaaatattgcaatcagcttgttgagggtatttttagacttatgaaagaaattggaatttgggctggagaaacaaaagtaattaaagagcctattatttcaactgatagagaagttggatttgcaaatgcaaatagttcaggaatatttattcctaaagcaactcattggagtagcataaaaaaaggtgaacttataggagatatattaaatgctcttacaggggaaatcgaagaaaaaatttatgcgccttgtgatggattgatttttactttaagagagtatcctgtagtttatactggttcattaattgcaagagttatcggaggtgtaaaaaatgattaaagatattattttttctttaaaatcaccttatagagatgagttaaaagttacaggatatagatttggaaaaggtgaaaaagctgcatgtataataggcgcaataagaggtaatgaaattcagcagttgtatatatgttcacagcttgtagatgcactaagaaagttagaagaaaaaggtcatataagtaaaaataatgagattcttataataccttcagtaaataattatgccatgaatataggaaaaagattttgggctttagataatacagatataaatagaatgtttcccggttatactcaaggggaaacaacacagagaattgcagcaggtgtatttgagaaggttcaaggatatacatatggtattcaatttgcaagcttttatatgccaggagattttataccacacgtaaggatgatggagacaggatatcaaagtcctagtcttgcaaatttatttgggcttcaatatgttttaataagaaagccaaagccatttgatacgacaacacttaattataattggcagctttggaacacaaatgctttttcagtatatacgaattgtactgatgagatagatgaagtttctgctagacatgcggttactgctgttttaagatttttaacaagaatgggagtaataaaatataactgccatagtggatatatagcaagtataattgaagaagataatttaaagcctattatggctaagagtgcaggaatttttagaagaaaagtaaatccgggagactgtgttgaaagaggagatattctagctgaggtattagatccatatgaaggattagttttatcaaatgtggtatctactactaatggaatagtattttttgcacataatgcaccacttgttatagaaaactcagtagtatttaaaataataagaagaatacatgattaaaaaaagatttaaggaaaatttccttaaatctttttacattattagcattattcacaaatagagaattttcaacatataatttttttgaaatcctgataaccagaagaaatatttgtagagaataaaggttttgtgaaaaatttgaatagataacataaagttatagcaaattatataaaatttaaatttttattgtataattaaaaaaggtttagataaggtgggattattatgaaaatattagttgttgatgatgaaaaaagtatagttaatttgattagaatgaatttagaacttgaagggtaccaagttgttataagcatgaatggaatagatgcaattgagaaatttgaaactgaaaggccagaattagtaatacttgatattatgttgccagatataagtggtcatgaagtcattcaaaaatttcagaaaatagatagtgaaattcccgtaataatgcttactgcaaatagtcaaataaatgataagctattaggtcttcaactaggtgcagatgattatataacaaagccttttaacagtatagagcttatgttaagaataaaagcaataacaaaaagaattaataagaaatacaatgggaaaaaggaaaataataatgaatttaaaataaaggggataagagttttaaaagatgaacgaaaagtttttattgatggagaagaaattattgccacttataaagagtttgatacattagtattaatgatggaaaattgtaataaggtttttacaagagataaacttttgaaaagagtatggggatatgaatttgaaggtaatactagagctgttgatattttgatacaaagacttagaaaaaaattaggggtttattcggaatgtttaaaaacaatttatggagtaggctatagatttgaattgtaaataatcggataaaagaataaggatgtgcttttgtgaaaaaagtaaatttaaagataaaagataagattatgcttatgaatatggggatattaataccagtaataacttttatatatataataataatgaataacatatatagtaatgtaataaatagtagtgttgattttttaatcaaagaaagttataatacgcagctatatatagaaggttatcttgaaaaggatcagaacttaactaaggaagcaaattttattaataaaggaccacttatcaatacatatttatcaaataagcttaactttaggattcaaacttatgataaaacaggaaacataatatctgattctgatatgaacaatcttagtctttatgatgaagatataaagaattctataaatggaaataaagcttatgttgttaaaaaaattgatcgtaatatgtatatattattttcaagtcctatatatgatgataatgtaactattggtggtgtaagatatatatatccattgcatagggaacaagaaattataaataatatgtttataattatgggaatagtagcttgtgtagcaatatttatatcatggctgttaagtagattattttcggaaaaaatatctaatccaataaaggaactaaagattgcatctgaaaggattagtaaaggagattataataataatatagaaattgaaagtggagatgagatagaagatttagcaaaagcttttaacataacaacagagagtataaagatttacattgaaagtttaaaaaatgagaaacaaaaacagaaagatttcttggataatgttactcatgaatttaaaaccccattaaccgccataataggatattcagaattaatacctagattagaaaataagaatgatatagaggaaagttcagtttatataaaaaaagaaggggaaagattattaaagttagttgaagaacttcttgatttatcaaaacttgggaaatctgaatttaatgttaatagaagtaagaatgatttagctacaataatagaagaagctttaaatattatacaaccaagacttcaaaagtatgatatagatataataaaaaaattatgcaatgtaaatttatatatagacaaggataaaactaaacaggtaattctaaatgttttagataatgctataaagtatagcgaatgtacaagtattatattaaaaattaaagagactaataatgatatagaattaacaattatggatgatggtataggtatagaaaaaagtcatttaaataaactttttgaaccaatttatagagttaataaggcgaattctagaagtaaaaatggaaatggattaggtctttgtatatgtaaagaaataatgagaaaacaagatggagacatagagatatacagtgaagaaaataaatggactttagttaaaattatttttagtaaattatataaaaattcatgaaaacgttaaaatgttacaattatgaaacatttgcgaaatatttttgataaattaaggttttattatataggaggagtaggaagtgaaaaaaatcaatttaagagttaagatttcaggcatatatattgttatgcttcttatttgtattattataataaatcttaattatagctttttatacaataaggtaataataattaacgataaggatgaagtggtaaagaaaataaatatgtctatacctataaaagttgaaatttctaatgaaaggtggggggaatatttttttgaagatgagacttcaatacaacaaatatggaattcaataaatgaaattacaaaggactcttctgttgatgataattatgattcggaagttagtgatattaaaattaatggaactatttattatttaaatggaacaaaagataattttgaaataagcaataaattatctttaaataataatacttataatgataaatataaaataccattaataaatagtttaaaaaataaattgcttggatatttatattcaacatctaacatagtaaaaatcataaattccaataatgagataatcataattgataggaataaaaatattaaagagctagacaaatctcataaagaaaatatagaaaatacgataaatgattcattaaagcttgagaacaataaagagataataaatttattgaaaagtaaaacagaagcgttatatcatattaagatttatctggataatgataaagacaatctttcaaaagttaaatgctctaatttagtaaatattgatgtatatgagaatgattttttcgttgttcaatatatgggtgatgaaaatggacgacatatatattttagaggaaaactaaatgatgtgtgtaagaaaatatttataaatgaattataaataggtattaacttaggaggattgaattaatgaagataacaaaaactgtttattgcgtatttttaataattatgtgtttaaatatgttagcttgcaatgacaaaaaagagaatataacgtttaatgatggatatccaaatttaaaaggaaaacatattgttgtatatgttgcgtctagagatgaggtaggaagtgcaattttagaactttttaaagaaaaaacaggatgcacttatgaatatttaaaaatgtcaactcaggaatctttatcaagaatagaatctgagaggaaagatcctaaggcagatatatttttaggtggaacatgtgatgttcatgttttgatgaaaaaagaaaatctttcagaaaaatatatatctgaaaattatgatagtatcccagaaaaatataaagacagagagggatattggattggttttgaagttagtcccctatcaattgcaattaatagcgataggtgggaaaaggaattcgctaataaaggaatagcaatgcctaaaacttatgaggatctactaaatccaatatataagggagaaatcgtaatagcagatccgaatacttcaggaacagcttatacaatgttagcatcaattattcaaagtatgggagaagataaagcaaaagaatttttaaagaaaatgaaagataatgttggtgaatttacaactaatggatatacgccagcgcaaaaagttgcaaccggagaatatctaataggtattaattttttaagcgatcagcttttgattaaggattcaggttttaatattgtaactaatgtacccaaagatagtggatggaatatagatgcaatttccaagattaaaaatggacctaatggcgatatcggaaagtatttcatagacttttgtacaactaaagaagtagaggaaacattaaataatatatcctttgcaatgttaacacgtcaagatacaagagatataggtggaataaagcttaatcaattagatatatataatgattacaattttgtaaaggctagcaatgatagagaatggttgattaatatgtggaacaatttaaattaatatgtttttataataggcaatactcctacttcaattaaaaagttatttcattatatacttacaatggaggaagaaatatgaataatataataaaattttttgatataaataaaagagaagtatctgttcctattgaagaacaaagacaaagatggttaaaagaatttttaaaggcatttttagttgtattttcagtgtatgcatgtatgtactttgttagaaacaatcttaaagcagcacaaccattattgaaaaatcaacttggatttacaacatcagaacttggttatataggttttggattctctataacttatgctatggggaaaactattttaggatattttgttgatggtaaaaatgcaaagcgtataatatcaacattactaataatgtctgcaacaatggtatttataataggtattattttattgtcaggtaataaagcggttggaacaatattagtattttggggattaagtggattttttcaagcgccaggtggtccaagttcttattcaactatttcaagatggacacctactaataaaagaggaagatttttaggattttggaatatgtcacataatattggtggggcattagctggaatgatagcattgtttggagcaaatacattttttcatggtaatgtagcggggatgtttatagttccagctatagtaggaatttgtgtaggttttgttttactttttgttggaaaagatgagccacaagaattaggctggaattcagcagaagaaatatttgatgaacctagggttcaaagtgatgctgaaatagaagaaatgagtaagtttgaaatatttaaaaaatatgttttaactaatccttggatatgggttttatgtatagcaaacgtttttgtttatatagtacgtattggaatagataattgggctccattatatgttacagaacaattgcattttgcaatgaatgatgcagtaaatacaatattttattttgaaataggagctcttttaggaagtttaacttggggatatgtatctgatttactaaaaggaagaagagcaatagttgctgtattttgtttgattttaacaggatttgctgtgttaggatatagatatgctacaagcgttacaatggtaaatatttcattatttgctcttggtgcattaatatttggacctcaattattgattggggtatcacttattggatttgctcctaaaaaatcaattgcagttgccaatggattgagtggtacttttggatatttatttggagattctacagccaaggttgcattatcaaaaatagcagatcctaaatcatcaggtataactattggaagtgtaactcttcatggttggaatgatgtgtttgtagtgttttatggagcacttattattggaataactcttttattaattgtagcttatgcagaggaaaaaagaataagaaatatagagaaaaaagaatgtgaatatagagaattagcagcataacacaatactagtatagagttataagcgaaaatttaaaataatagaccatattaagttgaagttatttaatcaatttaatatggtctgtttttctgtattagtgattttgtattcacatttataattcacaaatagcaaattttcaacatataatgaactaatatcattacatggagttgaaagtgcgtgatatacgggctgattttagctggaggaaagggaagtaggctgtatcctttatcaagagcaggagcgccaaaacaatttctaaagctcataaatgataaaagttttttagtcaatacagttgataggataacccctataataaacaaagaaaatatctatgtggtaacaaatatggagtataaggataaggttaaaaatgaactttctgatattaatgaaaataatattttttgtagagcctgctaataaggagactgctacgtgtataggtttatctgcggtgaagcttttaaagcaggatgctgatgctgttatggtagttcttccttcagaccattatattcaaggtgagaaagtttatacagacaccttgtctcaagctattgagcttgctaatagaagaagatgtgttgtgacattaggaattgaaccaagcagacctgaaactggatatggttatattgaaatgggcgaaagaaccactggtaatataccaacttataaaatagctcggtttacagaaaaacctaatttagaagtggcaaaagactttatattgaagggaacttatttatggaattctggcatgtttatatttagagcagatgttatactacgagaaatagaaaagtatttgcctaaattgtataagccattaatggagatatataagaatttaggagaagaaaacgaagaagaggttatcaaagagcaataccaacttattgatgggatatcaattgactttggagtaatgcagaaaacaagaaaagcatttgtcataaagggtgattttcaatgggatgatatgggcagttttggggcattaagcaggctccttcaaaaagataaaaacaacagtatatcaaagaatgtgtatattgatgaatgtgaaaattgctcaatattcggaaataaaaatttaattatcggatttggaataaaagacctggtagttgttgacgctggggatgtaatacttgttatggataaaaacaaagatcaagaaattaaacatctattgaataaactgagtcaagaaaatgagtttaataagtttttataagagtaaaaataataatctatgtgaaattaaaaactaatttcgcatagattattgcatgtctagctcttcagatgtactcgatacttaaatttatcagctctagctatgcttatggtatactcaattacggtatcattatcataagtaattctctcgatttttagagctggatttccttgaggaatggacaaataaataccttcaagtttatttatcaatatactttctaaaatttcctcagcagaagatatttttattttaaaattattttttaatacttcatacataggattttcacctaaaagctctctagttaatccttcaaatctatcatagggaaggtaggatatttcatagatatgtggaatatcatcagcgagtctgagtctaataattttaaaaactagagagtctttttttagatttaatttattcattattttgtggtcaggttcaattatttcaaatgctaataatttagaagctggttttttaccaagtttcttcatttcgtctgtaaaagaagaaacttttattaaatcttgtgccactattttaggtgctataaagtttccctttccttgaactttataaatatatttctttttttctaattcatctaatgcctgtcttacggtagttctgcttacatcatatttttggcatatctctctttctgaatctaactgatcatcttcatgcatgaaatgttctattttataaataattatattcattaattgaatatacaatggaattttcgattctttatcgattgtgttcacaaaaggcacctctttcaaactaatctaattaattatagtattagattgcaaaaaaaatcaatttaaatagtaaatttagatacgttctaatgagcaccatatgtaaatttactataatcattctaaatttctttacgttaacatttaagttcatagttacactttatctgagtttagaagataaagtggtaattaccaaagagagtttatattcagcaaaaacataattagaaattttaatattaatagttagctgtcgtatattaatgtaatattagtaataaagcacactctgtgataattctaactaaataaatagtatacattattcaagtatctccaaattaaatttataaatacttgaaaagatatttataattaatatataatgaattatataagtggtaattaccagttgtgaaaagatattaattagggaaggtgaaaatatgattattaaaaattgtaaaattatatattgggatagaatagaagaaggaagtttattaatagaagaaggaaagataaaagaaattaaccctaaagaatgtgaagatatggatgtaatagacgctggtgggttatatgtttctccgggatttattgatgttcatatacatggtgcaggaaattgcgatactatggatgggacagttgaatctataaatactattgcagaaactatagtaaagcatggaacaacatcatttacaccaactacaatgactgcatcagtttctgatactagaaaagcattaaaggtaatacaattgtgtaaaaatactggaactagaggtgcaaatgttttgggagcacatttagaaggtccatttatcaataaggatgctatgggagcacaaaatggaaaatatattttagaaccaggtgttgacaaatataaagaaataacagatggatatgaagatgcaatagtttcaataacaatttcgccagaagttgatggagcagaagatttagtaaaatatatatcaaaaacaggagttgtatgttctactggacacacaaaagcaacatatgaacagactattgatcatataaaatggggagtatctcatgcaacacatttttataatgcaatgactccgtttaaccatagagaacctggtgttgttggtgcagtatttaatacagatattacagcagaattaattagtgatggaatacatgtatcttatccagcgctaaaagttgcatataaggaaaagggatcagataaattattattagtaacagatgcaatgagagcgtgctgtatgaaagaaggaatgtatactcttggaggacaggatgttgtagtaaaaggaagttcagcaagattaaaaaatggagttctagctggatctatacttacattagataaagctgttaaaaatatatataagaatttaaatgtacctttatttgaagttattaaaatggcatcatataatcctgcagtacattgcaatgtacaaaatagaaaaggtataataaaagaaggttatgatgcagatttaatattatttgatgatgatattaatataaaaaaggtttttgttttaggtagagaagtttaataatatttagaattaatttttatatagctatttttgaaataaatttatgaggatgtagtgtaaaaatatgaaaaaagaagagcagattatagaagttttgataaatcttgaacgaaaatataatagaggtgttagtgccttagaattaggttcatacatgaaaatggatagggctaatgtaagccgtcatctaaataatttgagtaaagcaggaaaaataattaaattaaatgggagacctgtattatataccactatcataagaaaaaatgaagaaaatcaaattatagcaaaagatattgattctgataactctacatttaaattagaaaaaagcaaagatagcttggaaaaactagtaggagcagaaatgtctttaaaaatgcctatacagcaagctaaagctgcaattttatatcctcctaggggacttcatacattaatacttggggaaacaggtgtaggaaaatcattgtttgcagaaatgatgtataatttcgcgaaagaatctaaatcaataaatgaagatgcaccttttgtaagatttaattgtgctgattatgcagataatccgcagctagttgttgctcagatatttggagttaaaaaaggagcttttactgggctgataaagataaggatggacttttgaaaaaagcagatggaggaatcttgtttttagatgaagtccataggctatcaccccaaggacaggagatgctatttacattcattgataatggcacatttagaaaactaggagatactgatactcaaattaaagcatcagtccagataatatcagctacaacagaagatatacaatctttcatgcttaaaacttttacgagaagaattccaatgacaataactttaccgcctcttagacaaagaactttggaagaacgatatttgttacttgaatcatttattcgagaggaatctgtaagattgcaaaaaaaaatatatatcagcaaaaattcaataatctcgtttttgatatatgactgtaataataatatcggagagcttagaagtgatgttcagctagcttgtgctaaggcatttttaaattataaagtaaataaaaatgactttatattaatagaccaagacgagttgcagcctagggtgcaaaaaggaatgatgaattttaaagcctatagaaatgaagttgagaaaatatcatctagtattagtgatattgtacagttttcatatgatgttgaaagtaattcagcattaaagatactccagaataattcaaaagaaatagctaaagtaagtttttattctatgatagaagataagatgaatgagctaaaagaacagaatatagatccagatgaaataaataatattttaaatgtagatttagaaaattattttaaaaagtatataaatagtctaagtgatgaagttggaaaaaatgaaatatcaaaaattgttgatataaagttaatagattcagtagagcaaatgctgaaaattgcatctgaaaaattagatagacagtttgatagaaaagtatattttggattatcattacatttacaaggtagtattgaaagaatgagtcgaggaatcaagatacaccatccaaagcttaatagtattagaatgcagtatagagatgaatttataacagcaatggagattattaagataatagaaactaactttaatgtacaggcgagcttagatgagataggttatataactatgtttttagcagctggaaaagatgaatttaatgagttattagaaataaaagttggcgttttagttataatgcatggaaaaaatactgcctctagtatggttgaagtggcaaataccttaattggagaagaatatgtaaaagcattagatatgccgttaacaatgaaagctgaagatatgcttgaacttgcaaagaagaaaattttaaatatggaaaatcgaaatggtattttaatgcttgtagatatggggtctttaagtaattttggaaaaataattgaaaatgagcttggaataaaaattaaaactattaatatggtaacaactcttactgttatagaagcggggcgaaaggctttaaatggtagaagtttagagtcaatatatacttcttgccaggagcttggaagattttcaatacaaatggaaaaggaagattatttaaaggaaaaagaattagccataataacaacttgctttacaggggaaggtgcagctgaaaaaataaaaaatagaatagaaaattcattaaaacacatagataaattagagataatacctttagatattttagataaagaagattttttcaaaaaagttaaaaaactaaaagaacgatatacaattttagctattgttggaacagtaaatatgtttattgatggagttccattcatatcagcacaagaaatttttattgataagggaattgtacgtttagaaaatttaataaatattgaagatgagtttttaaaagtaacagaatcattagaatcacagattaaaggtttaaattgcaggaagatggctattaatataagagatactatttcaaatattgaagaaagcttagagattaatatagatcaacaggctaaaataggtattttgattcatatggcatttttaatagagagattgaagaaaatgaagaaattaaattaaaaacttagataaatatagatatgaacatggaagagaatttattttagtgaaaaagagtttgagtaaaatagaaaacgaatacaagattattattaatgatcatgaattagcacacattgttaggatggttatagaaaataagataagcgtgtaaattataacaagtaagtgtgaaaaaatatagtgtgtaagtagaaaatacacactatatttttttcattacacagtagtttatagaacgtaaaacaagtgatagagccaattacataaaattaaaaaataagttttagacttggcataattattgcttatatataagtgtaataaaagtacaggaggaatgataatatgaaaaaaatattattagtatgttcagcggaatgtcaacaagtttattagtatcaaaaatgcaacaagcagctaaagataaaaacatcgaatgttcaattagtgccacaggggaatcagaattaaaagaaaatatggatggaacaaatgtaatattattaggaccacaagtaagatttttattatcaaaaattaaaaagcttgtagaaccaaatggaatagaagtagatgtaataaattcagttaattatggaacaatgaatggagaattagtattaaaacaagcattagatcttattaaataattaaatttgaaaaaattataacaacatacggagtatattaaggagaataaagatggaagaaataataatgaatctaatattacacagcggagaagtaagaagctattcaatggaagctattcaagaagcaaaacgaggaaatatagaagaagctagaaaattaattgaaaaggcagataaggaacttgcagaatctcataaggttcaaacttcattgattcaaaatgaagcagcagggaagaaaacagaagtttcattgttattagttcatgcacaagatcatttaatgacaagtatgactgtaaaggatttagctatagaaataatagacatacatgaaaaaattaaataatagtaattttaaataaagaaagcggggaactatgaaatatgttataggagtcgatgcaggtggtacaaagactgaagcaatagcatatgacggtaatggaaaaattattgcaagatctgtaaaggggtttggaaatttattaaatgataaagaagttgcattatctaatatagaaagtgctgtaatagaaataatgtctacatgtggaagagaaaatttacatggcatatatgtaggagcagctggatgcgaagttggagataatgcaaggcttatagaagaaagattgaaattgaagatcaatacttatataaaagttatgaatgatgcagaaattgcattgaaggctatgctgaaaggcagtgatggaattttaacaatagcaggaactggatcaattgtatttggaatgaacaaagggatttcttcaagatgtggtggatggggaaatctcttaggagatgaaggtagtggatatcagatagttatttctgctataaaaagaatgataaaagaagaggaagaagatttgccacaatcagatttaacaaaagctatcttaaaagaattgaaaattaattcagttaataaaattactgagtttgtttattcaggaacaaaagatgaaatagcctcattaacacctataattgctagggttgcaaaagatggagatataatagcagaggaaattttattagaacaaggaacagaattagctagaacagttgaaagattatataaaaaattaaaatttagtaattgttcaataggacttgttggtggggttattagaaacatagatttgcttaaaaatgcatttgaaggatatttaaaggacaacattaaagtggatgaatttatatatgaagaagtttcgccaacaaaaggagcatattatgagtatattaatgaacttaaaatagatgaggtgaattaagatgaaaagattgggaatttccgtatatccaaatcatatggacttagatgaaatagttaactatatacatttagcaggaaaatatggatttaaaagaatatttacatgtttaatatctgcaggagataaggatatagacagtgtaatagatgaatttaaaataatgcttaatgcagcaaaacaagaagacatggaagttattgcagatatagatccaactatatttaagaagttaggtgctacaatatatgatttgagcatatttaaaaaaattggtctagatggaatcagattagatttaggatttagcggacaagaagaagctataatgtcttttaacgattatggattaaaagttgagttaaatataagtaatggtacaaaatatattgataatattttatcttataaggctaatttgaataatatatatggttgtcataatttttatccacataaatatacaggattatcatatgagcattttataaagtgttcaaaacaatttaaagaattaggagtaaatgttgctgcttttgtaaactctcaagctgctcaatatggaccttggccagtatcagagggcttatgtacattggaaatgcacagaaacttaccaattgatgttcaagctaaacatttaattgctacaagctatgtagacgatattatagtagctaattgctttgcaacagaagaagaacttaaatcattaagtgaattaaataaagaaaaattaacatttacggttgaatttaatgaatttgcaagagacttagataagaagattgtattagaagaatatcattataatagggtgatgtttcggaatatatgataaggtctacacaaagtagagtaaaatataagaatgaaagtttt

SEQ ID NO: 9 - DNA, 715974 bp, Clostridium butyricum WBS-01
aatcaaatctttttggtgaaaaaatttcagaataatcattttcttttctctgatatcatatcagatatgagcatagcagataccatagaacttgtcattccccatttattaaatcctgttgctacatatatattaggtgtatcatcagaatatcttcctatataaggtattccatctatagtcatacaatcctgtgctgaccagtaatatacttcttttgactttgggtataattcttttgcagcttttcttaacttttcaaaacttccaccagtttcattttctcctgttctctgctttattccgcccaataataataaatcctattaatctataaatttacaacctctttgcattaaaacagctgtgtatccttctttttcaaattcatctccagttttataaaaagaatttttcagccagaatgcttcactttgagaatttccgtttgcataagccaagcgaatatatttaaatcctagtgcttttagatatgtagcacattcctcaatgatgttagaaccaattccctttccttgatactcttgctccatcataaataatccaataaaagcagtcttattgtctggaaaattaattattaaatccataacagccaccaaatatgatacaaaaatcctatataaaatttatcttctttacttttattaggtggtaacatattcatatcttcatgaatactctctttgtcacatacggtggacaatatttataaaactttggatttcctatggataaagtatatattaaatctatatctttatcatctaattttctaatttggtattttaaagaaagttcacttatattcattcttacctccacatatagattatcgatattttactattatcatttccgagttcatcctttatccaatccactattgtatcaatgtgttctggatgttattttaacattactatcttaataattatctcacctaccaattttggaatttttcgcttaaaccatcagattatacatcattatcataaatggcattgttataatacacaagataacagataatgcattaattacacttgccattcctggattattatcataaatctgtgcaaactgcgttacgcttgaagcacttggtgcacatgcggcaagaaaagaaataagcataatttcatcagcccctttaataagacgtgtcattccactaaatataaaaattaataatactatacctggtaaaaaaatcagcctgaaaaacgaaatcatatatgcccttttctgcatacaaacttcctttaaattcatatttgcaaggagcattcctataacaaacattgataatggtcccatcaaatttcccatactgttcattgcactttgaactggtattggtaaattaacctgacctataaaaataatgattcctacaaatatagctaatatattgatattaaaaagaatcttttaatatcaaagttacgatcttcactaattatgaacttacaatgtgtccatattaaaattgtctgtactataagatatgcacttgcataaaaaaccatttcttgtcctaaaaccagctgaactaatggaatgataagatttccacaattagaataaatcacagatgctttttcaattgtattaaacttgaatattttttcaagtatataacttataaatatgtaaacaatatgaacaataatagcagcaaatactgccaatacaaatcctttcactttgtcagctgttaattctatggtaaaagcattaattattgcacatggtccagaaacaaataagaccaatgttgataatatcttgctatctgaaatattacatattttctttctaatcaatatgtatccaacaattatcattaaaaacattgcagcaatttgcttcattaaactgatactaagttccataatctcccccttgttttatcaataaccactcttctcaattccaaataatacataaatcctaatttaatgttaataatttaaactaatcatgaaagaaaaaatataatctattatactaacaaatattttaccatatcttaatattaaatatatttaaatttactattcttaattgcaaattattttgttattttagcttagtttttctaatttctctcgtaataacaactacaccataaacaccacatattaacagtataatatcttcataaacattaaatattactgacttaattcctgttagcccccatatagttaatagaaaaagtaagaatttattttttctactataacccgaatacactgctatactaagacttataataggacaaggcattatataagtaaccatctttggataataatttcctaataaaattgaaacgccaggatatattgcatataataacaataatagaatttgccaaggattaggtctttgaagcttatcatctgtattacgtatgcattcatatagaaatattgctccgcaaataaaatataatggcaaagcaaatagcttttgaactggttcaattccatatatacaaaaaaatacaatacttatatagatattagcaatacctaatgccaattttgcaatccatttaattttcccataatatgataataataatgataaacctaaaaaaaacattagtataatttgaatagttacagtgtgtttattataattagctataacattccaaaatatttgtgaattcatataaacatctctttataaattacaattcattttagattaattataattcgtttggaaagcattacaaagttaaattttttaatagtattttatatttgtttatgcacaaaatctacagtgaatcactatatatgtattgtgccgtattttaaacaaaaaaatatcacactatccatttattatttttaataatgtgatatataaatattaaattttatacatatataaatttatataatttcaatgcctttttctttaaactcatcaatcaattcttctgaacacattgcaatatattctacttgccttaagtttggtaatttttcaaatccccctatacttttaacatcaaattcatcagattcaccatcatactctggcataatcataaagtatatctcttcaccaccatcaaaacaaagctctgtaacaagtgctaaatcttcttttgtaagatttaaattttcaaaaaactcaaccatctctggaatgcactcaaaaccatcaccttcatacacagcaacatatttttcattcatttcttcaagtttgtttgaaaaacttgtttctttttccaatagactattaattacaactagtttgaatccaaagtcttcaaatataccacttttatctttaaacatttttcttcccccataaatatttataatttatttaacataaatattataacataatttgtaaatatcacattattcaattttcaaagaaccaatatctatttattacgtcaaatctgcattttgcgcacaaaaaatatcacataattcatttacttctgaataatgtgatattaatctaatatctatcctaaaacactaaaaatccaatcagctatccatgtgtacttttgatacttaatataatcaggatctgttactgctgggtctgaaccatccagtgtattaaaagcatctatttcaaattgataacaaatatctttaagttcttcaatttggtcatcagtagcttcaatatcaatagtacacataatttcttttgaaaagcctaatttatataatggagtatctttaataataagatttacattaatgtctggcattagattcccaataccttttttaacctcaaataagtattaaattcagtttctattctcactgataccactcccaattaaataatttaacttaattatattttttcatatcactatgaaccagattatcctattaggtgtatgaaaataattaacctctcataaatacggtgttttccaattattattctataaaaagaatagtaattatattctaaccacatttctaattcactaattattttcataagaaaaactccttagtttaaaatatacatttcgatttgtctataaccacattataatatatttatatttatcatactttaactttatttgttatcccaattaagaggtatattcttaaccataccgaagcttttaagaataaaatcaccatttacatattgaaaaactacatcaaattctgtattttcattcattccatagtatcttagacttattatatccagaacatcaaagcatatataagcaacctcatacatatatgcaaatttactatctccactgtatttttgagcgatacagtccattgtacaaagacttttagcaataaatacaatatatggtcttaactcctcaaattttgatacttcttcctccaaatcaacagtaacttcattataccttttgtctccaaaatatatcagaacctgtgtttcatcaatcaattttaattcattggcatccacaactaattttaagttgtctgcataacgctcatgtatcaaattatcttcccccttgtataatctagttgtaacattgtatagaaaactatttataattcaaacgaacattacaagtctaattattattaatattcttatttattactctgcctacgcccagaaatggactctgcatttcatacaaaaaataattttttaattaaaaagatgctttgtctattgcaaacataggcaaatttcaaaatattaagttatatttcaaaattataatactgttttttcagaccctacatctattgagattttgaataattataccagtccaaaattaagaatagacactcttaaagaagatgtactcaaaattgccattgaaaagtctaaaaaaggatcaactttgtctgaaaaagtatattcaaaattaattactattgcaaaaaaagctagtattatcaccattctgctaggcggtttatccattaaaatatctagttctttggcattaattaaagcttttaaatcacaaatagataacttattaaacgaaatcaacacattacttgaatcatctgaatttcctaaatctataaaaaaattttgaattaatagattctattcctggtataggacgtctaacagctattcttttaatagcttatccaattatgttacttaaattcaaatttaattaatctactattattggttaattatataatatttactaatacttaaaattatcaaactatttttatattttccatcatgcatatctcttttctttatagctgccactggaataaatcaacgttttttatcttaatggctctccaaatcatatccatcgagttctataatttaatattaaatataaccaatagtcttatttcatttttaattgcactatgaaatttttacgaactatacttttctagagttttataattattaaattttatcttaagaatatttataagtattgtttacatatattccatataattctataatttaaaatagaaaacaatgtcaaaggggtggaaataataatgaataaaaatataattaaaagtttaagtactgcacttattagctgtagtttattttgtatccctgcaaatgcagaatggaaatacgattccacaggctggtggtatacagaaaataatagttattcaactggatggagactaataggtggtgaatggtattattttaaagaagatggttatatggcttcaagtacctattgtgaatttaataatgctactggttcttattcacctggcactcctatagaatgtaatggcaactactattactttgataaagatggtcatatgttacatgattgctttataatagaaggaagtggcagattccaaacttggttagatcataatggaaaatcaacagaaaaacagtacgggaataaatattctggtggatatgatttaagttattccaatttaacatatgtaccatatttaggtggatatactgaagcagaagctctagaattagcaaataaaatgggtttaaaattaaatattaaatatgaaaatatccctgattcaaatcttaataatgtaatcttaggtcaaaataatatttcatcacaaataacaaaaaatgaaacagaatgtacaataatagtaggaaaatattccgattcattaactggattcacaaatactgaaatacgaacttttatgatggagttgcaaaaaaaatataataattcctatagttggttatacttctatggtttatattagtaataatataaaccaagctatcaggcaagaatctaaagtctgcctgttagctcatcttctatcttcttcaattattccctaatccccacaattatttttttactgatataattttaatactcaaaagcataattgtttaaggttacttttataatttaagcagtaaaatataatcattatttctttttcctctttaaactcttatttcaccttagtatttttcaccatttacattaataacaacatattcacttttacatcccgtacggaatacaaacccccactcagaaattcctgaacttacaatacatgtagttctaccagtttcttttatgccatacaccatttcattcttgctaacaagtctgttcatatatgcaagaggaaatatctgaccgccatgagtatgacctgacaaaagaagatctgctccagccttgtcagcttcactatattcaagaggctgatgatctaataatacaatataatgagacttgtctaatgctgcaagcaattcttctgtactttttcgatcatgaaccgtagcatcctgtctccctgttatatagaatttatcacccaccataacagtttcatcctgcagtatatggacattgttctttttaagttcattaacaaactcgtcagttgaataataaggatttcctccatagttatgtaaatcatgatttccaaatatataatatacaccatatttagatattgcttttcctagtgacttacatgcatttaccatatcctcataagaagtgctgccatcaacaaaatcaccagtaaccacaaccacatcaggattctgctgtgaaattttgtctatataatctccaaaactttcaccactgaatgtagttcctatatgtgaatcagtaatctgtataatctttaacttttcatttttctccaatttatcactggtaatattataatctgtttcgactacattatgtgcatttacccatccatatgaaaaataacagcctgtaataattattgcagaaattcctgctacataagcttttatttttagtttaaaacatttctttactatgctccagattatgtcgcatacaaaaaacatcagtgcaagatgaagctcaatcactaacgaatacatgaaataccaaattccaattataataagaataattactggtatagatgctacacaccatgaaagcagtctgcttttcttttcaatatcttttataaactgaaacttgtgaaagctccttgttatgtaaagtccaagaagtgctgctaatactaatattattattaagaatattaccataaaatcctccaatcaatacatatacaccattaaatttgcactaagttaaataatatccccttgttttatcaaaaagaaatacacattagtttttctggtcgattgtttgaaaaaccagcatatagaaaaccaccaatctgatttttcaaattctcatcattaagtaaactttaaactcttatttaaaattttcttcaatatatttaatgtaatcttttttttcaacttcattatagttattcttaaaccatttataagattcctttagaccttcaaacaaatccttttcttccatcaataactctgattgttttgtcacatctaaactatattcataatcatagaaactaaagtaatctctttgattattatgcttagttacatataccttttctaaaggtgttcctacaactttatagcataattcaataaatgtattaatatctattgattcagtgtttccaacattatatatatgattagttggatgcttctccaatattttttcaataactttacataaatcatctacatggaaaaattgcaatttcattttaccatcattaggaatataaaactttctattttttaaagcacattcaaatacaaacggctctctatatacattttgcattggtccatataaataaggtggtcttaatatataagcattaggcactttagaaatcaagtattcttctgcttcaatcttatctgttccatacttaccccatatcttattaactccaatactttggttttctgaaaatggttgcatgttagtttctggataaacagcagatgaactaataaatatgtaatctttaaatcccccaactgcatctaagatatttttaatatcctgttgattgtatccacatacatctattattgaatcaaaataaaaatcctttaaacaatctttcaaattatttctatctgcacaaatcaaattaatattttctatttgttgcttactccccctatttaaaacataaacctcataattatttgattgaaagtattttgctacatatttactaacaaatactgttcctcctgtaactaatatacgcttcataaaatccctcccttaaatccccattatccttgattaaacaataattaaataaaataatctcacctacaaattcctatttatcaattagtttaatagccaattaactcgtacaataaataccattatgaatcaattatagcatattttttcaaaattctattattcaattttcaaagaacattttataatttgctacgcaaaatctgcagattgttcttcaaactctattcgctaaattggagtttatctgttttattttcctctttactttctatagactatataatctacatattattcactaaaaaacagcagataaagcctattatctgctgaaacttctaattatactacaaagtcaaacttgattaatctttttaaatttttgtcctattattaaatatgatgaactgtttctatttcaagatgttctgttcttacaaccttaagtcttatttttatacacatcttttctcttaattttggatattgatatagtggtggatcaaattcacttaattgacttgttttaattatcctatatccacttattgaaaatgggtctggaaccattatttctttttcttctttattgtaaattggttcaggatttaatagatcatcatgtgttccaacaatctctgcactcaaaacttcaaccttatcgctttctttgaatttttctccccttggaagatccatttcaagaaagtctccaaagtttattacttttgtcatatgatatagtggtccatatactgtagggtatccgtccttgtctgttatacctgttccaacaatatttctgctatagtcaggatattgtgggaagaaaccgccttcattattattgttgttatcacctaatccactatccaagcaacattttaatgattgtgctactactttatatgatatattttttgtaatccaagcattgaacataacagctctatctcttgttggataagcctttacttctatcttttcatctatattatttaccataaatattcttgcaccttggtttctcaatttccaaaattctgctggaatagaatcaaaatcaaattctacttccttaaaaaaaagtccttcattttcagctagaataacattagtctgtattctctttgtttctgacatgcctatcgttttctcctctcattttttatagttagaatgatatttattcagttattcatctattcacttttttcatcatttataattaaagcctcttttgaagatttaccataattatcaactttataaaaataaaaattatttattatggtaacattattactgttaactactgttggtacaacaacattaactgatccattattttctgctattgttggcacatctggtatatctgatccatttatagccttgattctactgctataaatcttccagctttcatcttctttaaatgaatcaaccatgctttctggtacataaataataagattatctgaagtgtttttgaaaacatttgctcctattttgggtacattatctgtttctgttgtaacagatattaaatttgaacacccttcaaaagcactgttagcaattgctttcatttcttttcccatatatactttttctaaactgtctatatttttaaatccatcaactgtaattccagctactggtttactgttatagtaggttggaattattatgcttgctggcattgtttctttattatctggatttgcataaacaactacataagttactgcatcattaaatttaaaatattttatgtcagttgatcctgcaaaaaaaactgcactttcaattttatcagcttctttaatattgttgtttacattattaagaatttcatctttatctataatattcatttttgcctcctacttttaagcattttaccacttaatttatctgtaaagtaaacataaaataattacatatttaaaattgaaaactacgtttaacaacaaacttctaaataacacaatctaaaatttttattatttaattattgaaatatgtcaataacgcaatttccttttaatctatattaatagactaaaattttataatatattatattcacaagttacataatatggaacaattatttttccgcaaaaaaatagaccgaattttatttctcagtctatttaataacattaagatatttctttttgtaataccattgttacccattcatttgtctttgttttcttaataagattatatcccattttgttgagctctttataaatctcatcgctactccactctacaagacctgatacaaataactttccatcatcttttataacatcattgataagatccatacatgatagtgtttcatcgccaccaatatttataaatacaacatcataattttctttcacattagattcctgtgatgtaacatcattaataacaatatctatattggttatattattaagagctgcattatacattacttcttctgttacatctcttatatctaaagcagtcacatgttctgcattttttaaagctgctgcaatacttagtattcctgaacccgtacctaaatcaagaacttttaatcccgaaaaatcttcatctaaaatatatcttaaaaaatcctgtgtagtttcgtgaagccctgttccaaaagacccctgtgattcaaagttaatcttacctttttcaaatgagatctctgcttctggctctgcaattatccaaccattgtttaaatcaactggttcaaaaggctgttgccagtcatcttctcttatttctgttaattttatttcgccttcaacattcacactatcttttatttcttcaatataattaagacactgttctttgttatcttctgatggataaacctttaattctgtaaaatcattttctttttcataaaaaccatatccattagaatctactgtcacttcatatggtgcatcataatacgtagaatcaagacctattgctataagcttgtttaatactgaatctatttctgaatgttttactggaaagcttatttcaaacattaatttcacctcatcaaatatttaatagttagtttttctgttaaatttatcaggtgatattatagcataaaaattagcattatactaattctatggttagtactcaatgccaattctagattgaatccccttatcaaaaggatgttttacttttttaacctctgaaacataatccgctttttctataagttcttctgatggatttcttcctgttaatattacctctaacttttcaggctttccatttaagaacttaagtactttttcttcagaaacaaatttacctgaaattgctgacattatttcatcaaatattatcatatcaacatcttttttaagagcctcctctacagcatcatcaaaaagctttgtatattcagatattgctattttctttgtctcatcatccatattccatgaaaaccccaagtgttttttacataccaatacgtcaatattgtctatgtcatttagaatttttaattcatttgatgttccatcttttaaaaattgaacgaaaattactttcataagattacctgcacctcttattgcaaggcctgtagctgcagtcgtctttccttttccgtcaccacaataaatatgtataagtcctctcattttattacttcctttcttgaacttaatagtaatcatcacataatcattattatcttacactaaaatattattcaaaatttcatcaatatctattattttttttgctaaaagctgattttcttttacgtgaatatatgtatgtcttccaggctttattgatggagctaaatctattgcttttttgaagtcgtcttttttcattttcaaagtttttacatattcaaaaaaacctgtttcttctaagatagttttaattcttttggctctgtgattttgaactttagccataatataagtagcaattcctacctgcactccatgaagctgtggattttcaagaaatttatctaatgcatgtgatataagatgttcagctcctgatgctggtgaactatctcctgcaatttccattgatatgccatttaaagtaagtgaatcaacaagttcttttaaaaacaagtcatctttaattcccttaaattctgttctcacaaaactattcactgcctttttagatatcattgttgcaaagtcatcgacaatggtctttccgttttcttcttcaaacttccaatcatgaagtgctgtaatatttgataccaagtctccaatccctgagtatataaacttttcgggtgctcctttaattacatctatatcaacaattattccataaggtgtttttgccggaagtgacatacgtttattatttaccaaaagtgatgctcctgagcttgcaaaaccatcattggaagttgaagttggtatacttataaaaggcatcttttttaagaaactcatatactttactgcatctattgcctttccgccacctataccaattaatgcatcaacatcatttggaagttcaaatgcctttttacttatttcatcaaaatttatattaacaatagtctctatattttgtatttcaatatttgcctctattaacgatttttttattgtctcaccaaaaagttcataaatcccgtcaccaaaacatactgatactttcttaaacattcccttcttaattaaatttcctacattattaatattatttttccccacctctaatatggaaggaatggctattttatgagttgaaacattcataataaaaatctccttaaatattatttcccaatatttattatactactaacattaaattacaaataatattttttctctatcatttaaaattaatcataagaaatattcgcaagtgacatccaatataaattaacatatatcttaaagatatttaaaactcatgtatcttgttcctttaaaagttaatactcctttatcgccttttgataaaatgttatattcactatggctcacagaaaattccatatactcatcactttcaaccataaatttaatataataagttacatctgttgtagtatgcatcccatgtgcaccagttatatctcctgcattatagtgggttgttgtattcttcgattctcttttatcaacaatggatgccttcactgaaatctctggagatttattatttttatcccattgtacaattccacggattacagaaaatacaataatccctacaattaataaaaagaatattgaaaaaatactcccatcaaatcctaagctatacatgttacacctctccttattattctaaattggggcttatttaattcaaactatattaaattatttattttcgtctctttcttcttctactatgtattcttcctttgaatacacttttagtcttttccttttttatctgttgaattgtatctctacattttctgcatgcatcatttggataatcccatgaaagctttcttccacatacagtgcatattctctcatggtctaaaagcttagttaaaagaagatcattaattttatttgctgcaccttctttttcactacatatatatctattatttatcattaaattaaagttctttccaaaggaataattaagatccaatgatttataataactttcaagatcatctaattctttttttgaacttacatttttatttagcataggcttccttaaatttactacacctttgctatacatcttacagtattcttcccatagagaatagacagtcttattattttcttcaaaaggtattgttgccatttttaatgcatcttcctttgatacatttaactccatctttttaattctatttaaaagataaattattctcgttacatctgtcttttcaaaatatccttttaaagacattgaactccaagtttttaatgcatctacaagatctatatcaatttcaagaagagaatcaggtattcctgcataacatttttcaataggtgcaggttctgctcttaatgctcctcttattaaatttatatcacatgaagcggcaacatatcctttattatatattcccttacgacctgctcttcctgcaatttgttttatttctgatgttttaagccttcttaaagatacaccatcatattttctagtttctaaaaatacaatacgttttattggcagatttacgcccattcctattgcatctgtacacactataacttctgtttccccatttaagaatctctcaaactgtttctttcttgttgaatatggaagtgaaccataaattatactagtctttatatttttattaagaagttctgctgaaacagccaacgcctttctttttccaaaaacaacaagagcatctccggccttcacatctttatccaaattaaatgttttatcttcaaatataagttccgtatccctcttatgatttataacttcatatgtatctccacagtcttctatgagttttataattatattaagcgcttctggtgccatacatatgtgaatctcaggtgaaagtgctgctgttatagcacgtgtccatgcccagccccgttgattatcatttatcatttgagcttcatctattacacatacatcataaaaagttcctgtttgaagtttttcaatagttgaagaaacatgtgttccataaggaataatatcttcctcttctcctgtaagaagtgaacatgaaacattttcactatttagcttatcctgaatttcaagagcaagaagtcgtagtggtgcaaggtaaactccactttcagcttccataagccttaaaatacttgaatatgtttttcctgtatttgtttcaccaacatgaagaataaaatgtctttccatcaatcttgaatcttcatattcatttattggattatcaagaattatatcttgaagctcatcttttgctttctttttaatatatatattttctgctgtccatgaaggccctttaaaacatatccatggaatacattccttaaaatcttccatttcatcaattgatggtgctttttcattttcacttatataatctaaataaagcacattttcaacaacagccattctttttattatttcaagaattttattttcttttgattttaagccatatcgtcctctacctattgtcattgttttgtagtatccaaaaacaagctttcttgcatcttctaaaaatgaattcatatgattgtctgttttatatatattcatgttaagaagattatctatccttttatctaaagcatttatgactttaattttaagcttcggaattccatccatatgagaaataacatttctacatgactttgtcattattcttataagttcttcttcacttttgctatagttctcatgtactgactgtgtaaagtattcattttctattcctagaagaatacatcccctctcatatgcatcaagcataagttcatcatgagcaaatgatatttttgaaattattgaagttccccatctacttttaaatgcattggcaaactcagttttaatgctttctataatgcttctttttttatcttgatttaattcatcagcttttatttcataatattctttgccatctcttgttcttttataaaaacgtacactttcaaataaaaattcttcattatattttttcttatattctttataaataagactttttttctgttccatattattttttactttttcataaataacatgacctacatcctttggctcatacttgataatctttctataatcattagaaccaggaacttcctcttcattctcaacataagaaccttcccatgatacttcatcaagaaaatctttaaaatacatatagtcatatacattaaaagtccctatatctttaaggataatttttgaattttcatcatattggttaaatgatgaatcatctatttcaacttttcctgtggtttgtatatattttacggcttcttttaatatttcattcataaactcattgtctatatattgtgaaatttcatttcttacttctcgcgttaacgtgaattttattgaacccatatgtttttgatcacatcctttgtaattttatttattataacatctaactctttttagtcacagaaaggcttgccactatttacagttaatatatatatacctttatatattaattctatcattgatatcttttaattaacaataaaatcacctttatataaaaattttatttattttactattagctccagataaatttctttattatgtacatgtaaacttcacaagaaaaatacatttatatatttttaaagataaaagtcatttgtaaagtaatatcttaaagtacatcctttactatttttatataatcatgaatatactgaggcatataaccattttttcgatatactgcaaaaagttttactgttagtttaggattgccaattgaaaaatagacaggtgcattttttaaattcatatgttttagatgtgtttctgaagcaaaagaaattccaaagccacttgctgctaagcgaactgcacattcaacacttcttgtcttaagtataacattaggctgtattttcatttcatcaaatactttctgtgctatctctccacttttttgtgttgaacaattaataacaaaattctcattcttaaattttgttatatctatccatggcaggttgtacccccttaactttatcccttcatttgcaagtggatgattactatttactgcaagcattatttcttcctcttttataagataagaatcaagaatattattattttcattataattgaaaatagcaatatcagcatcaccactaatcaataacttatctaaattatttgaattactttcttcaataaaattaacttttacatctggatacatctttttaaactttggaagagtttctgatattatatatggacttctaactatagaacatgctatattcagccttccttttgtattatttaatatatcaaaaagttcatgatccatgtcattctttatcttaagaatttcttttgcataacttatatatttctcaccagcatatgttaatataaaattatttccacatctttcaaaaagttttacatccatattcttctctaaattctgaagatatttactaagtgatggctgtgatatatacaattctttcgcagcctttgaaatactattattttttgcaatactcaaaacatattccaattctttaaaatccatctaactacctccaaaaatataattagtctccatattaatacatcaagcattttaattattgttttaaatatctcatttcaaaaattatagcttttacgcataaaaaaaatagattttatatattagcttcatattaattactagtatatactaaaaatgtattataataaaagttttatctatgataaattatagtttcaaaatttaacaccaattaataataaaaatcattataataaattaactacaataaaaactggaggccttaataatgaaaaaaggttatatgtatatagcattaactacacttattttcagtacaatggaaattgcacttaagcttgtatctgatgacttcaatcctatacagcttacttttacacgtttttttattggaggactatttcttcttccctttgcaattatttcacttcataaaaaacaagaatttctttcaaaaaaagatttattatactttgctttcttaggacttcttggcactgtaataagcatgtgcttatatcaacttgctgttttgacaacaaaagcatccgtagttgcagtattgtttagctgcaatcccgtatttgtaacaattcttgcatttattcttttaaaagaaaatattcacaaaaataatattttagcattaattttagaaattattggctcactaataatcattaatccctttaatacgaaactaaatatctttggagtattacttacaattgcttctacgctaatttttgctttatatggggtgtatggaaaaagaaaatgtttaaaatttggtggaatagtagttacatgttttggatttattttcggaagtcttgaaatgcttattcttattggactttctcatatttcctatatttcaaacatccttgctaataataatgtactagctatcttttcaagcataccgttatttacaggatactctatacagacacttccagtaattatctatatatgtattattaatacaggactaggttttgcattttactttaaagctatggaagaaacttcagctcagacaacttcccttgtatttttctttaaacctatacttgctccgattcttgcattaatacttcttcatgaagtaattccatttaacatgattattggaatagtttttatacttttaggatctctttcatcaattatacctgatttactcattaaaaaatctatgaaaaaaccactttctgaaaactctccacatatataaataattcaaatggaacttttaaataaatcttaaagaaacagttttaaatcctcacaaaatttttaaatagaattagatttaaaaattttatgaggatttattaaacattaattgtatataaatctagttttatgatttttttatcacttttgtaatattatccatattaattagtaatttaaaaatataaccacatgtaaaatagataattactaaaaacaaactgagtaaaattgcttttttatcattattttgagcatgacttttttaatgtaaaggtttatatttaaatcatagaaataaatatattcactcaatactggagggatttttatgatgtataaaactttcaataaatctaaacaagtttcatctcagtgctgttattgtgattttaataaaaaactttcaaaatttatttctaaggccagtaaaaatttaagtgattttttacgaagtttgttcacaagcaaaccatattcttttgacgaatacagtccagtaaaacaaagttataattctaaaaatataactgatttttatttaacagaatcacgaaggactttcttatagattattatatacctttataaatttttgagcctgccacataatgttattgcgtggcaggctctttataatattattgatttatgatatcaaaaatgctgcttaatagatttttctctattataaaactcatagaagcaggatttataactataccatcatattcattgacattatccattatatctttatatgaagctttgcaataacggaatttatctctagaataaatcttttctgcttctttttcatctgagaataatggaatatacgttttgtttgtatctttatttgctattgtgtaaaaatgcattgtttgtttttcaacagaatattcttttctgttttcattttcagaactcatttttatagcatcttctgtataatgaattgtcatatcatctattgatttcatatcatcttcattatcatatcgcataggcacaataaataaaccttgtttattttcactttcttttatttttagtgtaactcttctaaaatcaaaatcatacaacgaaatattttccatagaggaatcctcaaagaaaagttccataatctcttttttaatatctctctttgataaaatatcaaatataaatttgctcatcaaaacactatcatcttttcttgcaaaaagaactgtaccgttgctatctttaattacaggaacatttttatctttaagcatctttggtagtatctctttttcccattcatcttgtttttctgccatttctcttcttacaatttccgcctgtttttttataacctcaagtgattgttcattaatcttaaaatcaatacttccacagttaatgcatatttccgaaatattagcatcatttaataatttcataagttgtgaaaaatcatataaatatatatcccattcatcactaaaatcaaaatttttcttttttaatccatcaacttcaacttgatcagtaaacacataaagccctggatttacgcttttatcgttctcgttttctgatattatatatactggcaagtctgctttattaacatcagatttctttataggaattataaacttagtttttactatagaatttatcatttcaagttcaagattctgtcttattttatctgcaccttcataatttatgtttcttctcatttcctgaaaaaatgcagccattgaatattgtgtttctgggtttataaaatattttgaagaagaaacttcttcaaaatttataagactctccttactaagataataaggtctttgtattccatcactaaatcccattcccttatatccagttctatataattcgtttaattcattattgaaatcttcatttgtcatttcaataacttcaacatcataatatactttcttcaaattttctatcatcttatctttgtatgtatcacacactaatatatgttcgcatcccttgtccataaaaggtaatcctgttgtcttaagaataattttccatagcttctcacttttaattatcttctcctgaaatatttttctataaatactcataactgaataaaaccacatataatcctgttcttttccttgatcttttaatccaggcatgatgctagtttcaatgtatccaagaataaatatattctctgttaatgatgattctttcatcatgctttccccatgatcttcatctttaaaaatacgttgaagaagttcattacatctttcatgagttaatatataattatctttttctttctcaggctgtatttcaattttttcttcaatattagtcttattttcatcttcattaatatctctaactattttatttttgtctttcttaaatgcatcaaatatacccacttaaattcctccaaacatcccttttaataacgataatactaaaataattataaattgattaaagaatatcaaaaatagatatccaattataaattctcaatttaaatacatatatattataaatgaaatcctatacaattgctattaatatgttaatttactcattgatttataaattttattgtgaaaaatcacaataaaatttataaataaaatgtttcatagaaagaaaaacctgtaaaaatacactatataagccttaactatcaataataaacaataaatcatttccaagtgtctatccctagtgaagatagcttcggtataaacattatatttattgcttattttaagtttatatttatttctatattattttttcgtatattataaaattaacttcttttttcaagtatatacagtgcattttcaagcatttctcttgttatagcatatgggtaatgtttaacatcaggcattttaggaatcatatctataacttcataaaactgttcttttgtaatccctatatcctcaagatttactggaagtcccactcttttattaaattcatatatcttttcaaactcctttgtcctgttatcacataataaaagtataagtacaccaaatgagacaacttccccgtgaagatgatatttttctatctcttcaaactttgtaagtgcataaaagactgcatgtgcaagaccactattataatcaggtgtatgatcccgtgtaagaaatattgatacaattgcagtggttactataatagttaaaactgtctgttcaagctcatatgtgcatactttttcttcattatcctttaatgccttttctccatacaaaagaagaggctcaaggcacatatgactaaaaccaactccaagagccttaaaatgttcaagttcctctcctctagctgaaactgtactttcataatattttgaataagtgtcgccaattcctgcccacatataatttttaggtgctgctcctattatttctgtatctataaaagtatgtgcagctggatgaaggaagaaatatggttccttaaaagttccatcattattatacataatagatacattggtacatgctgcacagtttgatgcaatagttggaaatgcaaaaaccttcttctttgatttttctccaaggcatttacttgtatctattgcctttcctcctcctacagcaaatatataatctgcttctttaacaacattgtttttacttaacacctctacattttcatatgtacaacttccaccataccatacaaaatcaagaatttgtattcctgcttcattgcatgcataaataagctttttctttgctgcttcaatacctctatatcctcctattacaacagcttttattccatattccttgcatgtgtcctttacttttctataaacattattacctatgcaataacttggtaaaaataaatcataatttttcatatagtccccctagatttcgtatttcttattgctttttaatattaatttaattcattataacatattatgtaaaaaaaattgccatgcaaaagtacatgacaatttcctattataaaatagagttaattaaattttcctactaattcacttatttcagcttcaaatttttcagcatattcttcaaaaggaacattcttttcttcaacttttaaagctaattcatacataaactctgggatttctcttgcaagaagtacgccataaaccttagcaagctttgcattaccttctgaaaatcttccatttacgtgtaattcaaatgcatcttctaaaagatcattatattttttcttcttaccagtaagtccaattaatgcaccttgatggaatccacatgaatttgcacatcctgatatatggatacttggaagtatatctttagtataatttttttctttaaaataatccaaaatatttttgagcatactctgacttgccccaagacctatttgacatactggaacaccaatacatgatacactttgttcgagttttgtttctccaccacaacctgcagtaatatttaataattcttctgcttcttttccgttaagatttcttataaaaatcccttctgtcattgtaagccttaattcaatatcattcatgctttctatagcacttacaatatttcttagaatttttaaatctgcctgaccaccaactggatggaaatatacactatataatccattctgcttttgttctactaatcttatatcctcacgttcagtcttaattccttctttttcacattgtatttctttaatatttaaatttaacttgtcctctgacataactgcatttagatgcttcttgaagcaatttttaaattcttcttcacccattctttcaagtatgtatcttattcttgcttttgctctattttgataatctccttcttcaatgaataaccttaccattgcttcgacataatttaaaacttcatttggattacaatactcatcaagggcaactcctgttttaggattctgtccaagccctccaccaatatatactttaaataacttatttccattattatttatagctaaaaatcctaaatctgtcatactgcaatgagcaacatcttcatctttattcgaaaaagatacttttagctttcttggaagtttataatcccttattctttccataaagtatctgtttactaatagtgcatatggagatacatcaaaagcttcatctttttgtactcctgaaagtggagatattgcaacatttcttggaaaattcccacctgcacctcttgtatatatgttattttcaagagcttccttcattaaatcacatacagcatctattgacaatccatgaaattgtactgcctgccttgttgtaaaatgaatgttctgaagattattttcttctgccttatcaataaaccatttcatttcattaaaagaaataattcctgatggagttctgaatcttatcataaaggtatttctacttctttcagcataaactcccattccacctgacgcatgcttaaaatccataacagatagttccttatttaaaaacttatgtcccttttctctaaattcttcaatttcacctaaaagcttttcttttaattccttcataataattctcctcttcttttgcctattattttaaatataatactacctgtactaatgcttataacaaaagcagcaatgatgtgctgcttttaatctcactaagatataatataacttccatttatattttcttcaatataattatagtaatttacttatacttattttttatggttattattataatttacctataagactaaatagtaatgtttcttactatacacatattttactcacataatattcttgcatatcttcaagccttaagcatgcaagctgtccatctacattttccccaaaacagcatccacaatctatatatatagttccatgcctctttataatggtatttgatccatcttctatattttgtacaggtgtgtgtccacaaataatagtataatccctatattttttttcatttcctatattatctctactccaaacataaatatcctcactttgagttaaaaattcttcaagttcaaagctatcatcgtaatctttaaaacccgcgtgaacaaaaataaacttgtccacaactttgattaaaggtaaacctttaatatactctaaaactttaacaatttcagtttctcctctctcaagaagctgactatgagttacatatccaccattaacataccataacatatagtcatcatttattattgcatcttcaaacatcttttcatgatttcctttaatcatttgaatgttttttttatctagtatataatctagcacttttaaaggctgtggtcctctgtcaaatatatctcctaacacatataattcatcatcatcgccaaagtttatcttttgaagcatttcaataaactctgtataacatccatgtatatcagacattacatatctgctcatttaacttactcccctttcaattaatacataataatcaaaaatatttatcaatactatatattcatctttatcacttgctgacaatatgattactcttactaattaaattatatgatttctcatcttatatattacataatattttattaaattttttcttaaattacagaaaagaaaataaacaaatgcacgtaataagcttttatttttttttatatattatataatagtaacgtagtaatgataaataatatatgaaacgtgtacgatctcggggaggtactaaaatgcataatgtattaacacaggaaaatatgaaaaaattacaagatgaattagaatatagaatgacagttaaaagagctgaaattgctaaagaaaaattagtagctgctgctcatggtgatagatctgaaaatgctgaatataaagaagcatgcgcaaactatagagaaaatgataacagaattcagtatcttatgactatgatttcaacagcaacagtaattgatgatgaagatcaagacaaatctgtccttggaataaacagtaaagctaaagtaaagtttattgacgatgatgaagaggaaatcattactcttgttacaacaatggaccttgatcctgaaaacatgatgataagtatagaatctgatttaggaaaagccctaattggtaaaaaagctggagaaattgttgaagtagaagctcctggcgataaatattctgttgaaattttagaaattctataatttttattgttaaaaagcatagagcactaaatctgtttcaatttaagtttaaattgaaacgcaagatttagtgccctttaaatttaatctaaatgttagcccaaaaattacatatttcatctaacaaagtttctcttgttatttcattattaagatatcttcttaataaattaccaacaattgccgaattattagatggaaggtagcttgtcataaaatccatagtcttattatcatttctatacttaattatatctgaaactaaaggatctgtttgacttatatttatattattaaaacttggtataatgccacaatcttcaactataaactcattgcctttttcattatatacaagataatttaagaatctttttgctgcttcttgctgctctaatgagttattgctatcaataacaatatattttgtaacatctactactatttcattctgcccataagcactactatcattacttactggaacagaaataaaaccaaattcgttatttccattactattagctaaaatattcatcgatgcccagtttcccatataccagaaccctacatcaccttttcctaaaagttctgcacatttatcatatgatggtgacataggattatccgcatacatattatacttcttcatcagatcaaaagtatcaataagtccatttaaaatcccattgttcttaatagcttcaggggatttcttaagattttcaaaatacatttcagtatttattccagatttttcactatcaatagaataaaatgttgataggaaatgatcacctaaagaccattcttcatttgttacaataatagcatttttgcctatggcattgaccttattaaaagcctcttctaaagcagatattgaatttattccttttacatcaattccagcttcatctgtaacttttttattatatataaatcccataccttcagtcgtaaatggaaatcctataatattgccactatcatttttagcaatatcaggtatatccccagaaatatctttaatccattcttcagttgaaagatctacaaacttatctttaaaacttcttatatgcgcagaatccatgattatcattgtaggggcattgcctgcttcatacataaaattcactttttctatatatgagcttgattgactgtactttacaagttttatatttatatcttcattttcttccataaaatccttagcagcttcatgcagtgccactatgatttccggttttgaattcaaaattgatatattaacaacattactcttgtcagaagacttacatcctgtaaatgatgttaatattaaaatactcacaatcatcgagcatattatctttttcatcctatatctcctctattctgtcttgaacttgtctatattaacttttaattcatctacaacttttaaaatcttatctcctgctacttttactttttcaactacagaaatctgatcttcagaagatgctgtaacttcttctgatacagctgcactttcttctgaactactcgcaagagtttcaataagttctaaaagattttcactaaagtcctttatatagtcaataagattattaaatgactttatattatctgatatcttactatctgcatttgtaatttcatcaaatatagctagagtttcgtttactgttaaattttgaactttcataccttcatctatagaactcataagctttgtagtcaaatcagctttatttcttatagtatttaatatttctgcggtttcttgtgtagcttccttagactcatttgctaattttcctacttcttctgcaactactgcaaatccttttccactttcaccagctcgtgctgcttcaattgatgcatttaatgcaaggagacttgtctgatttgatatttcacttattgtttcaataattctatctatatttaaaacaaattgagataattcattaacttcatcaacagcttgatcaactagcttaaactgttcttcagtactattttttaattccttagtacctttatttccctttttcaaagcatcatctgatatttttaaagcactatttgtctctccaagtttttttgtaacttcactaatcttctcatctagatttctaacataacttaatatatcatctgtctttgatgcctgagcaacagaagtatctgcaatttcagtcatagccgaagaaatatctctactgttttcttcagcagaagatgccaattcctcaagttcaacagatgcatctttaagatcattacttttgctatctatgctaagcacaagatttctcaatgaatttaccatttcatttaagtcatttcctatgttcgtaatttctgatgcaccagttaaatcacactgaactgaaagatttccatttgccacttccttagtaagtgatgccatttcattaattggttttgtaaaaagctttaaaatgtaaagggcaacccctactattagtactatgataactattactataggaaatacagttataaatgcattcttaaagcccttatatatttctgaatttggagtcgttgtcattgttccccattttaatgacggtataaaattatatacagctactcccttttcaccattgtatgtataatttatgctgttgaaattaccatctaatgctttttctgcacctttacttaattcacttgaactttccaatatattctcattcattattttagtgtaatcactatgatatgttatatatccattattattgaatgtatatacttgtccatcttctgaataaaatatagtacctatactatcttcaatactttctgttttaaccttatttacaatatatccaacaactttattgttttgttttacaggagatgaaaaaattatatacgaaagattattttcatatactaaaacatcactaacatatgaataccctttgcttacatccttaaaatagggttcactgctaatattttcacctttagatccaagagaatccgcaattatatttccattagtatcaacatacattatatttaatattcctgtatcttgaccttgtttgtttcgtaattcttgctgtatactgtcaatatcagtactatatacagtttgggaagttgcaatatcttccactaaaattacattgtcatcagcccaattatccaagttatctgttatcattctggatatttgttttaatgatagtatttcgctgctatacatagaagatttaattataacgccacatataagtgcaaatataattaatggcagtataccaacgcttagaaaactaaataataattttgtcttaagagttttttcattatttttatcctttgttttcgttttcatcatccattccacctttctctacaatagatagtatataccaaatttactattttgaaaatattttttattatatttaatttttccttgaaaatacctttattttttcttaaaatactcatatattacattttttgtagattaaacgtgtattatagactattttttaactataaacttccttattatacatagaaaaagaaaatctccctaaacaaagagagattttttcataatattaaatttataagaaaaatctattttagtctttcttataagttttcttgcaatgtttattgctgcaattatttgctttcttttctttttcttgttgagaactacatgaacaatcgtgtttttcactcattttaaactcctcctaaaatcatagtttaaatttatcaatcttaaatttatcaatcttaaatttaaatctaaaattaataaaaatatctcaacaatagtttgtacatcattttaatagttattcactatttctaaaaatatcttttttataaaatccaaacttttatttcttcatatggattagtctttgctaatccaattttagttacttgtccactaaacatcttaaaattattttgtaaagttttaaatgcaataatcatctcttcttcacttagtttttttcctattgttgtatgaggtacccactgcattggcatataaaatttatttaaagttatatcactaacagataataaggagtcatttattaaaaatgataaattatgcagatactcatttaaaaccggcattaaaaatataacctgttttttgaaaactccaatagaaacccaattcaaagtaccacgtttactttctctcataactttatcaattacatttataactttactttcttcttctgtttcaaaagctgaaattgtaatatgaggaggtactctaccttcaatcatatatttattaccacttttttcagctactttatctattaattgctgtatagttttttctattttttcatcaaaatataaagatattaagtacatctagcacctctttcacatgtaatttgtagtaaaagctaatatagaattcattattaagatatatcctagatatcctagatatgctacattgtctatttaaatgcaaattttaatggatacatttataaattaaaaatgtatccatataataaacaaaatcatttttattatattttattttaaattatacaattaagcaaatatatcttttatctccgcatcaagtttatccaaaattctaacactttctttttcccattgatcaatggatgaaatattgttagatatctctctgtatatatcttcaacttcatcatttatatcataaatattataatcatatactatatcaattttatcaacatcaattaaagattcaactgtctgtaaagttatagcattttctatttctatatatctttctttaaatttttctttaagaacttccttttgtttacttatatattttgattctataaaatttactctaagaaattctaaaaatttttcaaaatctcctgcgttatttaatggttctaaagtaaatagaattctaaagaatagattccatgaaaactcattatttattacactctgaaaatactctcctaatctttttgtaaattcatcttcaaatttaatttttctttcaaacattatatctgaattaaaatctatactttcattggttatttcacttagtcttgttaaagctttaataagaacttcagtatacttatcttctgattcataatcttctgatacaaatgcataccttattattgtttcacaggattttttaaaatcaacggtcattccaatagaatttttcattttatttgcaaataaatcatatataattttagaaactatattttcgaggtgtttctttcttgaatcactatctgttttttcttagtttcaaaatgattaaaaactgttacaagctgtttatcaatcattgataaattgttttttattgatcccattatatcctttaagaaattattttcaataatataattagagttcttataaattatttcatgttctatttctccccagaacatatttactaaagacttaatttgaagttcaaaaggaatatcatttccattaaaaacatacttaccatcaattctatatatagtaaatccatttttctgcttttgaggctgttttccttctaattttaaataaaagttatcatcattttcattataataataattaccatcactatttttattgaaatacttcttaaaaaatctatagatgttcctttcatcgtctgcaaatctacattcaattcttacacctattaaatcacttaaattataaataagcttgtttccatctggatatcgtttatagtacttattcctaagtatcttttcctttaaactttctggtgattttactcttgcagagatatttaaaaattcaattgaattttctttaagaatttcaaaaaaattgtcttgtattacaacagataattcttctaaatcatcatacttatcttcaagtttagctattgctacatccaaatattcaaattcctttatactcaaaactttccctcatttcttttcttaagttccatttattcaaatcaaaaaacatttactctcatttgaaaatgaagaaacatatttatatttccatatctcatttatattcttatatttttacataagatatatgtattttcataaatatatcttataatacaatccaataacgctgtattatatcctgccattttttcacttctctttctaaaacagcaccattattcaccattgtcttggctgatcctaaattagttttactacatgtaagcaaaaccttatcaagtccaatcttcttacattcttctaaagcaagctttaacatttctgttgcatatccttttcgtctttcacctttgcgtatactatatccaatatttcctccaaaatcaaataaaaattcattcaactcatgccttatatcaatcattccaaccaattcattatcttcttgccttattgctaaaaaagtagttgctggaacaaaaccttccttaactgtttctttattactattttcctttatatgtttcatccattgttcatatgattcagtactctctaatccagcagtaccatccatactctcacaattttttctaaattcctctttatatgaaataactttatctttatgagtaatatctggcaaaactaattttaacattctttatcctccacaaataaaatatatataaattttttttaatatataacttttataattttaagttattatacttattttaaattataatttattatcgcctttaaatatacttaaatttcaataattcctactatatataacatttatgtataaaattttaatataaaacctaaactattcttgagtatgaaaggagatttaagtaaatgaaattaaagaaacaatttaaacaaatattatgtgttttagctgtacttatagtttttagcaatattattggtgcttcatcagattcatttccaaaagaattaaaaataaatgtaagtaaaaatgatatttaccaagttgaatatgtagattttgatataagttctcgtaaaatgaatatcaaaggaagagatgaagttgcatactgtcttgaaattgataaagattatcctggaaatcaagtatttaaacttaatggatcacctgataaaaaaatatctaatataatagcagcaggatatccaaatagatctgcaaaggatttaaatgtatctaatgatgatgaggcatattttgcaacacaagtggctatatggagttatattgaaggttacaatttaaataaaatcaaaggagataaaaaagtagttaatgctattaaaaaagtttataacgatggagtaaataatgcttatactagtgataatgaatataaagtatatacaccatcaaataaatccatacaagaagcagtagtaatttttactaataaaactacacctgaagaacctacaactcctgaaccaaaacctgaagaacctactgttccagaagagcctactacaccagagataccaactgttccagaagtaccgacagttccggaagtaccaacagttcctgaaaaaccagtagtgcctgaaacaccaactacacctgaaataaaacctgaaattccaactacacctccaagtatcacagaagatattgatggtggagaaaataaagttgaaagtaccgaacctcattacccaccacaagaaggttaatacacatagctttggctttatcaaaataatcttataataatcgataaaaagagaattcattaattaaactgcctaattttcaggttcagtttaaaatttcgaattctctttttttcataataatagtattttaaaatttcatttaacctttattttttatttttaaagctataaatgttattataaataaaataactaaaaatttaattacagttatatttaaaaaaagtatattataatccactaattcactctcctaaataattattcactcagaaatcgttctaccacttctggatcataatgagaaaaaaatagactttttcctttgtccaaatctctaattatctttttatccttattggatagttcaaaattaaatatatcaaaattttctatcattctagatttttgaattgatttaggtataacaacgatatcattttctattaaaaatcttaaaattatctgtggtacggactttctatacttatttgcaattttcaaaagtattttatttgaaaacattttatttgcaccttctgcaaaaggagcccaaccttcatgctgaactccatatttattcatgatttcacgttctttaatctgctgataatatatatgagtttctacttggtttatagctggtattacttcttgaaatttacatatgtcaattaatctatctggataaaaattgctgactccaatagctcgtaccttttcacatttataagcctctaccatagctctatatactccgtaatagtccccaaaaggttcatgtataagaaccaaatcaatataatctgtttttaatttcttcaatgattcatcaattgatactttggctttttcatatccactattagaaatccatatcttagttgttataaataactcttctcttttaactccacatttttttatagcattacctacaccatcttcattagaataaacttgtgcagtatcaattaatctatatccaacagaaatagcatctaatacacatctttcagtttcatcattgttaatctgataaactccatatcctaaaattggcatttcaattccattatttaaagttacatacttcattttaagcacctccatatataaacatatgcttaaaatcaaaattaaactctttctatatattaatgttacccatttaactctactaattttttctctaattcctgaaaaaattctttatttttttccttaatctctatattactattaatataatcatttattttctcatcagaatttatattttcatttaaattatcaacccattttccttcatcatcatttaagttatcatagttagttatataccacttattatcattttctctcaatatatatttttcacaaacattaatttttccttctatatccttcatacaatatgagtattgaacaactacaaatgccaaatcatccctaatatctgattcatatatatttatgtcatttatttcagtaattttgtatatttctataaaactctgagatttatccacatcataattaaaattataaaattttttcaatgaaatttcgtctaaatctaatatactgtttaaatattcagttattgtactttcaggagaatccattttaaaatcttgtatctcctccatttcccctaatggttctgctattgtttttccactttcccttaaataattacatccagtaaaagtgcagagtatcaaaatactcataacaatatttattatttttttcattaatacctacctctttattgtttaaacattataatttattaaaaatatctttttcccctattttgatatttactaattaaagttgctaaaaatatgttttattttatcatgtcagtgctttcttgtcagtacttttcttttatgttcatatttatgtgttggttatacactatatagattatattctaactaatttcttcgtatattatttaatgtaattataactattgtttatgataataaaaccagataacattcacaataaaaatcagtactctatggtaattttttaaagaaatgctctctggtttattattaattaatattctttttattataaggctattatcctcaaacatttccaagtttattttcaaactcgttaatcattgtctgagtaagacttataagcaaatctctttctggaagctcatcatatctaaaccatgttccctcagcaagttcctcttcttcaagagttattttttcatcaccatcaagatctgcaaaaaatcccataagaagagtgttagaaaatccccatggctgacttccaaagtatcttaaatttttcaccttaagtccaacctcttccataacttcacgctttacagtatcctctacagattctcctacttctacatatccagcaactaacgcatattttctgtaatttcctcttgaatatcttgtaagaagaatcttgtccttgtttattactccaacaattacagctggagctattgatggatataatatattgtcgcaacttttacaacatagtgctctttccttattataaatctccatctcatttccacatacactacaatatctattttttgaataccagtcatacaaatgctttccagtaactcctccaaacgctgcccattgtggcttaagagttctaaatattgacgtattctctctagttaaaaagctatactctttttcattaaaatctttcaacataaaaaagttcatattatctattttaaaaagataaataagtttatcatgtgaaattacaactgcgttttttaaatctttatatttaggtatatatatttcattgttatcctttttcataaaaacttggttttttataaatattaatatataatcttcatccttaacgactgtttccttattatatatattatcatatctgtatggtgctatttcatgaatcatttgttaacgcctccaatccaatatacctataattataaactactttaatataaaaatatatatcaataacacattactatcttatctctgaacctataaaaagcatcctctttaatataagaaaatgcttttttaatatagactttattaggatttaaaaactacacaaaggatttttaattattataatattcttttagataattatatattattaattattttaacttttaaaatacattctaatgtcctttgtgtttttctcttcttttatactttttaagttcatataatttctgtttttcactctctttttcttctttagatttcttctttctttctattttgttttcctcatgctgagcttttaaagctgcctgtgccttagtacaaattcctttgttctgtacttctttttttataagtttttgaatccttttgggattaattttttcaaaatcacttgtaattatgccatcttttttatcatcttcaatgattttaaattttaacttataatagttttgtaatataaaatcataaacttctgcatctttaggttcagcaccaaaagtaactttgcaaactttgtaatcctcccctttagattcttcaaatactcctatccaaaatggattattaaatagaatagtaagtttcactgcatttgccatgatttttttcctcctgaaaataaaaaattccagagaacggacaacccaggagggcaggttactgctattaaaataatagattctgactaccaacagaatagtgtttttatctccttttattattataaacattttttcttagtttataaagtatataaaaaatctaaattgttatactatatctctatcaagataaataccttcttctttcttgttcttttctctttttaaaaatcttaaaagttcagaattagctatatcattactctttatactatttaacttgtccaaagtataggagcattcaccgcatatgtcaataccaattacattttcccttattattatattatgaagtatagtttcaagttcattaagattcatttctccttgattccaatttgtatctacaactttttcactaagaacatccttatctattgaaatataaattggattattttcaaatttatacttattatcatcccacatataagctgaatctttatcaatacatattacattctctttatattgtgaatctattaattgtttctctttttttccaagtcctatgagtataacattctttaggtatctgttggtttcaagtgagttaattacccatgatccacagcttaatatatttccaagtgctggtttttgcatatcagagtgataatcaaaaaccacaagattaaaattttcttgtattttttccatccaaaattgagatacataatgataatttccagaatcaatgaaatgtatcccactaggctctaaatcggctatttcttcttttattcttatttcagcgttaggattacaataacagtttgtccctaaaatattactacaatctctccaatttatacattcacttttataaaaattttctttcttataaatatcactgaaattcataaccgtaatatatggattttcatctttcctcaaattcatcaaacttcctccatttatactgatatattttattaatcatacatactttttcctattatcaataataaggcttatttaattatatgtagaataatatatattaataattataaccttaattacatcatttgttaatttatctaataaatgaatccactttaaaagtgaactaagttcaattttaaagtcataattctaactaaaaaagaaactatattcaataattaattgaatatagcttcctcctcttaatgtaagatcttgtaaacacaaactatctttcttcattcatttctctaacaaattcccatgtctctccataatccttagattcatataatccaacaactccattattataatctcccatacttccttgacctacagtaagatatagtactccattttcctcataaggtattttaggaaaaacaaatggattataacattttccgttgataagagaaatattccttgtgggtatttcaacttttgtatatgaatttcctccatcccctgttttataaagaactccatactcgcctccgctttttgacaaagataaaaaaccaagtttttcatttataaatgtcattgcatctgcagttcccatgtcaccattaaaaggatcttcattgataatattccaagtttctcctccattataagtaccatataatgaataacttctacttcctaaagctgaaccagttattaaaagttcatatccttcattatctgataaaaaatatttttctaatccttcatcactttgataatttacatttaaaccttctgagatattttctaaatctcttaccatattataacgtataggacaatattcgctttcctttcctggtatataaagagaaacaatatatccagtcatgttactggatacatatttatcatttttcatattaccattgctatcaatatattctattccctcttgactatattcaaaatttctttttccagaatagctaacttcatatttatcttctccaggccatttatttacatcattttttaaattaacaactttcatggtctctataaatggatccaaactcttgtctttgctataatcatcattaacatccccatttaaataaatagtaatattattagatttttcataatcataacttattagaaaactttttagttgctttttttcatcatttccatataaaaaggtgtcaaatgaagttattgtaccatcttccttaaaatttacaacaaagtttttcgacatatataaatcttctggcatgtctaccttttctcttatatctgaaagtataccttcaactccatcatcatatatattattgtgggtaaaatcaactgttttcttattaaacaattcttcaagaaaccacgacagcttcccattatatttaacagcactactatatatttctgcaccataaaatagtgttgttcctacaagaataaaaattgctaagtaagaccaaacagattttagaatgctttctttttttgttttttcatttatcatatgaacatcatacttcaatattttgttttctaattcatacttctgctctttctcttttactaatatttcaacttcatttttatcctttaatactttatataaatatattataaaccacacaattaaaaatataatacatagtgataatatcattatatttacattgcttttcccatacatacacaatttatataggttataccatgtaataaaatatataagtaaaaatagtggattaataatcatacttataagtattttagcttttttattgatattcatttttcatataaatgaaagccttacataaatgtactttcatctaatctcctttctttattagtcatgaatataacaatattttatcaaataaaaatataaatgaaataaatttaagaaaaatttaagttttataaattatatatcacaaaaataacatatgaataatatattaactaataatgtattgtttaaattgcaagttatattaatttttcatatataaaaagattttataaaactcaaggaggtaatgaaatggattcttgtaactgttacaataatattcaacctacattaacaaatgaagaaaatgctggctttaggcaagctcgatgtggaattcgatattctgcaacagttaataatcatgactgtaaaggaaataattcatttttcattctttataaccctttgcattccatgaaagatatatatttagtaagtgttgttcatacaaatacatcaacttcttcagtagtagtaaatgcttactgcaactgcaatgatacacttcctccaaatattgcgcgattgaacagcataagtaacaataatacaagttattgtgatgatccatgtgcagctcagctttatagtggccataatataggatttgtaaaaaacactcccttgctaatttacgcagttaagtcaaatgagaactttgttaacacaatcaatggaggaataatcctctgtcctggttcttattatcttgaagtaacaaaaggatttgcagattctggagatggtcgtcagtattcaagtataagctggtgggaacaaccaatctgctgtagacaataataaaagattaagtgtttatatcttcttaatataaacattaaaaaggtgagtagaatttatttttttgttaattcactcaccttttaatatacggttattttaatttatataatttaagacaaaatatatataataacaggacatatacgatttacttacaatatctctctttgtaaagtgtatatgtcctgatttgatgtattatataatttatttttttgcttattgctaaatgttattatgaagccagtaatgttattatatgcatttttttatcttatatgcattttttcataaatttattattaaatttttctattcttatactgtttaatatatgaattcctataaaaagaataaacaagttgaatacacataaaacaccatataactggttcacatattattactccaaaatacttaagtgttggaataaggaaaattacaaaaagtacttttcctattaattctataatactggatataagaggaacaactttttttcctataccttggagtgcatttcttaaatttagcaaaactcctaaaacgcagaaaaaaggtgcatttatcataagatattttgctccattttcaattactattaattcatttgatccagaaagcaccttaaccattgtttctgctccaaaaaacagaattatagatataataatactccataaaagagccaatatatttccatatcggacagcttttcttattctatagccttgatctgcccctttattctgagatacaaatgtagctaaagataatgatattgtagatacaggcatcatacaaaatgcaaaaagttttcttgcggctgtatgtcctgctattattaaatatcctaaactattaatagcagtttgaagtattactgttccagttgatacaattgaaagcataaatcccatagaaagaccttgtccaagtaattctttatatagttccttatcaaaaacaaaatgatcttttgatggtaccagtattggattctttttataaatatatatgatacataaaattgatgatactccctgagcaattactgtggcaactgccgctccaaaaatccccatattaaattgtgtaataaaaataatatctaaaattacatttaaaatagatgataccattaaaaatataagaggcattatgctgttccctatggcccttagaagacctgcaaataaattatatgcaaacattactcctacacatagtgtaagtgttgatatatatgaatatgattcatatattatttcctcaggtgtatttaaaaactttaaaagtggaaataaaaatagtactgatattatcataattattattgtaacaagaattcctataattattgaacctgcaactgattttttaagcagtgtttcatcattcgatccataactccttgcagttactatgcttaatccattacctattccaagtgcaaaacctacaagtaaatcataaactgcagtacatgctcctatagctgcaagcgatgtatctccaaggaaattacctacaatcattgtgtccatcgtattatacaactgttgaaatatattagaaactaagagaggtatggcaaaaattattaaagatttcaatatacttcctttaagtaaatctgtttttaaactaatcatatgatgttctcctatcttatgcactaaagctttaaatcataattggaaatgtttactcgaaataatataatcactccaaatcatcacataaataaacatatactccaaatatagactcatataatatatactgtcaagcatttgttaaattttagtatcaaaataactcaatgcaccaaaactgctgaatttataaaaatcctccaatgtaaaaattcttctctctccccatgttgaaaaatccaaatatgtcttgtccccattttcaaaaagctttgttacagtcatccaatgccagtcaaattccttaagaacattattttcaagcataagcaatgctactggtttattattggttaaagctatctttataaaattctttagttctttaaaattatattttgttgtaattgcatgagattctgcttttacatctttatccttaaaaaactcaatcactctatcattaaaataattaatagatattactccttttgatggatctggatgaatatattctgcaatactctccatgtgattaagaaaattacttttactcatatcttcataattgtatatatttttattttttattgtaattgcatagtatgctgttatatttgcggctgcaactatactgcatccagccttttttaaatcatcacaattaaaccatttctgtgctcctccataataaggtctttttccatcatatattttcaaaaagttattttttaagattataggcatgtccatatattaaacctccaaataaactattcttataaaatagtttatttgtgctagttaacatatatactactatttttttggatattaatacctttttaacatataaataacctcattttaataatactgtgtttatatttataaaaattatgagaaaatttaagtataagttatttagttaaggaggattaaatatatgactgttaaagaacttactacaaagacaataaatgatattcaaaaaagaaggtcaaaaaaggaaaatgaatataacgcatacgtaaatgaacgatattgcaaaaaaataagaaattggagtgtccgagtaggaggttgtcgttggtaaataattaattttaatatattattagactttacacattatattttttcattctaacttatttaaggcagttctttaaaaattctaaagaactgcctttttataaatataatttatattcatattttatgtttattcatctatactccttactaaaactcattctcttctttactaaattaattattagtggtaatatgaacattcccattgcccctaaaattataacatcaaaattttctctaattattcttatgtttccaaaaaagtatccaagtaagcatatagtaataacccataacattcctccaaatgcattgaaagaaataaaccttccaaaattcatattttctattccagctacaaatggagctagcgatctaactattggcacgaattttgcaaatatcatcatcttataaccatacttactataaaatccctcggttttttctacatactctttcttaatataattattatccagcatcttccttcccagattagttcctataccataatttaaactatctcctaatactgctgctataataagtgtaattattaatatgtatatattaagcatctttaaagctgcaaatgttgatgctgcgaatatcaatgaatcacctggcaaaaatgtcattatgactaatcctgtctcaagaaaaatcacaataaataatattgcatatgttccaacaccacagtgccgtatcatcatccccaaatacttatcaagatgtaaaaatacatcaggcatacaacttaacaatctcatactttcctcccatttctatatgaaaatatagaactctgactttaaatttaattatatgcaattttccttaaatttacacgatttataaattaatattttcttaattatttacttacaatccattttaatacattttcacaaaattactagatacataaaaaaacttttacagaaataatattttaagtctgtaaaagttctttatctacaatctattaatcatactaaaacttctattcaatatggttacttattcttgaattgattttaacaattaaattttaagctctttatataaactttaatttacaggtttaaaatcaacaaactctttaactatatcatctacattttctattcctatgttataataatatatttcaaagaaataatacatattatcttctttccactgatatactatcttattatcgcctttgtcagcatatctgtaaacatccattccatctatagataatttatccgcttttactgtagtagtttcaccattttctcgggcatatccagtacgtgaaatctcttcatactcataattatcattatcctttgtctgaataaatactatagttcctttatcatatgaataataactaaataaacttttacccatatgatcaatattagtaaaagaatcggatattttaatataatcattaatctttataggtaatttaggagtgtatccaagagcttctgttgccttatttaaatcgtctttatcataaatatttattaatgatttaggaactccattagcttctttatcaattgaataatttacattaacaatttcctttggattctttaatgaattcgaaatttttccaatctctccctcaccaatacttccatcttcattattgtcataattcatacaataccatacgtcaccgtctttccaagcaaaatatttacaggattcaggtttagcgaatgtatactttgttgagtcggtcaaagtaatgtataacccttgaataccatctatagtctttgagttagttgaaacaatagcatcttcaaaactctctttaaattcattagtaagtgtatccacaggatcacctctaaaagcctctattgaataccactttgcactatttttatcactaaactctagttccaatttattattaccatcatctgaattaaaaactcttattgaatgaacttcattacctggtatcacataatcaggcactttgtaatcaaatccaatatactttctcactttatctagattataaaattccttaagttttgaatcaattaaaatattattatttaagcttagttctgaaatattacatacagtttgatcatttgaacttaaaactgaattatccttctcaactataacattatcatttaaatcatatgcataaactggtatagcactatatagtatggagcatgctgctaaagaacttatgatttttaaactatacttttcataaaacttctttcttaccataataacttcccccttatcttatatggtatcttttcattgtacaatacttatatcttatatttaaatttcttcattagattatatacttttatattcttgttaaataaatatataaaatcttagattaaagaacaaacttttctacgtaatatttattgtaataaaaatcattttttactaagtttaccattcgaaaatgataatttccacaaagttatcttaagtatttattacatttttaatcaatatatactttttaataaatataaagttaatataacatagatatttattaaaactttgaatacaatattttattatcttaattattgtaatttatgaacttcttcttcgatgattgttaaaatcatcttttttccaaattcaaagtaggcatctaaatcaattcttttttcatctacaagatattgaattgtagcaccttctaaatatgaaacaatttgatatggcaaacattcattagccttatcagacaattctggttcatacttttgaagcataccacgtatttcctttctccatccttcaaatgattctgcaaaacaatctttcatttctttattaatacgcccctgtacccaaaaatcaacctctgcataatcatattccctatattttaaaatgaatgctttcttttgagctataaacacatcaagctcttcttctaatgtatattccttaatatttttcctataattttttctcagttctaaacatttttcaagaactgttctttgaagtgctgacataagatcaccttttgttttaaaatagtagtgaatatttgattgaaccatccctgctttttctgcaataagatgcattcgtgttccacttattgtatgctcttttacaactgccaatgcagcttttaatatcttatcctcattcttcatactaatttcctcttttaaataattataaacttattttctttgaataaatatgaaagaggctgtacacttaaagcgttcaacctctttgctgaaatcaatttaaataactattttacatattaacgttcttctctaaaatatggtttacctaatgactctggtggttgattttccttcttactctttatacttgtaagaattaaaactacaatagtaactacataaggaagcatttttactaattcctgagtacttctgcttaatccaggaatatatagatagaaaatatatagcgcaccaaatacaaatgaccctaagattgagtttataggcttccataatgcaaagataacaagtgcaatagctagccatcctctatcaccaaacccattatttgtccacgttccacctaaatattccattacaaaatataatccaccaagaccacttatagctcctcccagaatcgttgcaccatacttatatctagatacattaattcccactgaatcagccgttgccgggtcttctcctacagcacgtaagttgagacctatcctgctcttttttaaaaagattgataatagtattgctatcataatagaaagatatgttaaaaaaccataagaaaataacaaatctcctattataggaattgtagataaaaatggaatctttgcttgatatgcacttgcagtcacagaaacagatatttgtccaacaccacctgcaaggctgcttatagatcctccaaaaaaattaccaaaaccaattccaaaagttgtaagtgcaagaccaactacattttgatttgctcttaatgtaattgtgagaaagctgtaaataagtcctcctaatgctgcacatccaagtgcacatgcaaaggatattagaaatccaattattacacttggattactgttcccattttcatagaaaaaagctcccataagtcctgcaattccacccatatacatcattccaggaatacccaaatttaaattcccagatttttcagttaaaagttctcctaaagcaccaaacaaaataccaacagcttgtgcaatagccttttgaataaaaattaaaaccacactcataaagctatgcctccttcttattttttctaatttctagtttatagtttataaaaaattcacaaccaataaggaaaaataatattattcctgttataatatcagaagcattttcgttaaggttaaactgcgttgcaatctgaattgaaccctgttgcatgaaaattaaaattcctgaaacaagtatcattgcaaatggattgaacttagccatccatgcaacaattatggctgtaaaaccaaatcctcctcctgtgcttgtagaaattgtatggcttgaaccacttactataagacttcctgcaaaaccacatattgcccctgaaaaagccattgttttcattattaccttttttacatttatacctgcataatgtgccgtatcaacactttcaccaactacagatatttcatatcccattttgcttgattttaagaaaacaaaaataaaaactgtaagtatagcaacaagaatgacatttaatccataagtcattccaaacacctttggaaaccatcctgcctttgttgccttatttattattcctacggtattagaacctgccggattctcccatataacaatacagcagtttacaatttgtattgcaacataatttaacatcaaagtaaataatgtttcattagtattaaaacgtgccttgaaaactgcaggaataagtccccatatcattcctgcaatagcacttacaatacatatacacattataagaagccagtttggaagcgcatcaccagcataaatcatcaaagcagccgctgctgtagctcccattaatatctgtccttctcctcctatattccaaaacttcattttaaaagcaggcgtaagtccgattgcaacacataaaagcacggatagttcacgaattgtaacccatagtcttctattgtttcctacagctccatctattaatcctgaatacacttctaatgggtttaagtgagtaattggtacaataaatgctgcacatacaataagtgctaaaattaatgctgctacacgaatcatccatgctttctttgtagaaattccatctctttttaccatgtgaaataatggttctttatgcatcctttaattcctccattctatgtcttgtcattaaaagaccaacttcttccttatttgtttttctagcatctaatatacctgatacttctccagagtttaagactacaattttatcacaaagttcaataagcacatcaagatcttcaataacacagataactgcaacgccttttttcttctgttcattcataagattataaatagtgtatgaagaatttatatcaagaccacgaacaggatatgcaagaataagaatttctggattatttgctatttcacggcctacaagtactttctgtacatttccccctgaaagtcttccaactggcgtttctgttccgggtgttacaactgataacttttcaattatagaacgtgcaagctctcttggtttcttacggtctacaaaaaatctattttctttgttgtaacttctaagcattatattatctgtcattcccatagaagctacaagacccattccaagacgatcttctggtacaaatgatatttttattccacttttttcaatatcagatgcttttattcctaaaagctcaatatccattccttctgtggacttatatataatcgatccaccctctaaatcctgaagtcctgttatagcctctaaaagctctttctggccacttcctgctattcctgcaattcccagtatttcaccactatttgcagtaagtgaaacattattaagtgtttttattccatccgaatttatgcaagttagatttttgatttctagtttctcaactgggttttcaggtttatttctttcaatattaaggctcactctttctccaaccatcatttctgtaagtgaagaaacagttgctttatttgtatctactgtacctatatattttccttttctcaatacagaaactctgtctgaaagttctaatacttcattaagtttatgtgttattataataattgactttccagcagcacgcatattacgcagtactgaaaataatttttctgtttcctgtggtgtaagtactgctgtaggctcatcaagaattaatatatcagcacctctatataatactttaattatttcaactgtctgtttttctgatacggacatatcatatattttctgatatggtttcaattcaaaaccatatctatcgcttaaatccttaatctccttttctacttgttccatatttagccttccactacctggcataccaaggattatattttctgcagcacttaaaacattaattaatttaaaatgctgatgtaccatacctattcctaaagaaaaggcatctttaggtgaacgtattgtaacttccctaccatctataaaaatttccccttcatctggaaaatagattccagaaatcatattcataagtgttgtttttccacttccattctctcctaatatagaaagaatctctccttttttaacactaagatttatattatcatttgcaatcacctttccaaaacgctttgttacattttttaattgaattgcattttttccttccatgaattatcctcctaaaaaatcatagaactgcacaaagcagttcttatgatatttcttataaaattgtcctaattatttgttaattcttttattccatcaattttaatatcaaatgacggagctgatgttttttctgattcatgataatatccatttgatactaaatcagcatattttttataatcatcattactctttattaaatcttcaagagaagagccattcactgtaaacttacttgtatcaaatacatgaatagaaccatctttaattcctgattctacttccttaactttctcttcagtcccttttgcaacaacatctttgtttaattcagttatgcaatctgccccttctttatatccttgacaccaatcagtatcaattgcttttccatcaattacagattttactgcataagtataataaggtccccagtttatagatgctgaagttaaagctgtttttggtgctgttgctatcatgcttacattatatcctacaattggaactcctgccgcttcacaagcagttgctgcacctgttgtatcagcatgttgacttatcaatacacatccgtcagcaattaaagcttcagctgtagatttttctaaatctatacttgcccagctatttgtgtatttaacttccattgttgctgcatcacaaacgctctttacccctggaagaaagctgtatatccagaaattacttctgcatatgggtaagctcctacataacctatcttacaattttccttagttatttttccactttcaatcatttcatttaattttaaacccgcaactactccagatacataacgcgactcataaactgctgtaaaatagttatgcatattgcttaattttgaagttgccgctttgaaacctgttgcatgacagaattgaacatctggatattcttcagctgcctgtatcatataatcttcatgtccaaaactatttgcaaaaataatattacatccctgctctgctaaatctgctgctgcatcataacacttatcatcttccggaattccagtcttttcaataatctgactgtcttttaaaccaagttcctttttcatttccttgattccagtcatatgagcttctgtgtaaccttcattttcatctccaacataaataacccctaccttaatgttagatgcatctactttagtagcagatttatcttctacagaactagatgatttttcatcagcgcttcctcctcctgatgaaccacaacctacaagcattattgctgacattgataatgctaaaattaagcttattgcttttttcataaatattttcctcctaaataatactaacagccaaaagctgttttttgagaaatatttaaaacttcaaaagtatctattttattattaacagatagtttgtccaaaaaataaagacgccaaacatacatccctatatgttcaacgtctttgttgtatataatattcctctatttacttttattataatgtcttaataatttttgtcaataaaattttatcaactaatcaatttaattttcttcataaaatcacatgacataattacaataaattataatatatatagccttgaaaagttacctgtgacaaatacaattaatgttgaaatcaccatatagtttctagattataattgtaaatttcatagcacaacatatatatgatataattaaacaaaaatattaatacaggagatataatggattctagatttaaagttaaacaaattacaaaattatatgaaagttgtgacaaatgtggattacccataataaactgtatctgcaatatagtaccaaaaattaaaactaagtcaaagatatggatattatcaacagaaagggaatttcgtagaccttcaaatactgcaagactcctaaagcttgtaaatcctgattctactgaatttttcttgtgggagaggacaaaatctccagaaaaattaattgaacatattaataataatttttttcaaacatatatcctctttcctatagatgatgatttacaagaaaaagactttataaatatgaatttatctaacaattggaatatagatcataaacagtctaaatatgaaatttcatataagactccggcatttatccttcttgatggaacctggaaggaagctgcaaaaatgttcagaagaagtgaatatttaaagaatataactaaaatttcactaaaaccatcttacaattctgaatacacccttagaaaaggggcatccaacggagagctttgcactgtagaagctgccattgaaattcttaaactaaatggagaacttgaaaatgcaaaaatcataaaagatgtttttgatttatttatgaaaagttttaaagctggatctaatggagttagggtaagtcctaaatctataaagtcctaaatattaaaatttatacagatattttaaataataaaaaacacctgctatgtaattctacgctatctattttaagtaacgtttctgaaaacatgcaggtgattttaatttataatttttattttagtattatctgctactaattttatttatcatttttagcataaaaatagcttgcaacaattggtactatggcagctatcatgatagctataaaaaatacaactgcttttatattaccatttaaaagaaaactagataatatacaaacaattcctgctactacaaagagcctgccacccaaacgatgtgtcttcctccatgaaacttcacttgaaagagtccaaggagttttgattccataaaaaaagttactttttgactttggaagataatttccaataacaatgaataatactccaactattaaaggaattatcttttctattgaaatactgtatcctaaagctactaataaagtaactgtatgaattactaaaaagaaagtaagtagcatacttacaattactgaataactcttatcaaatttttcatagtttttctttctagggtctatcttgggtagaaacttcattccagaccatgtaaatatcattattacaggtgccataaatgctccaaaggcctttggagaatatttatcaatttcccccattgtattccagtgtattggaactaaatctggcaatttattgtatactattattgttaatagtatactacacactataactatcacattataaatatcacttttctttttatacataactaattctcctcattgtcttcctttttatcagataaatctataaaccatcctataacttcttcaaagatagaagtatttaaagagtaataaataaactgtccctctctttcatcagtaactaaatttgcctgtttgagtatactgagatgatgggaaatgcttgctttagtaatattaaaataatcagctatttctccagctgttttatcctcttcttttagcagctctaaaatttttcttcttgttttatcggatagagctttaaaaacctcattaaatgccaaagtatgtcctccctaacttattatttagatatttagataatattctaaatatctaaataaatcttatcacacaaattaatagttttcaacatctttaaatattatatttagtttatccatatacattaaaagcaaataaaaaaagaaaactacctgctgaaaaattctgcaggtagttttcttatcttatttcttctacacaccctatccctaaagattctggtccaatgtgacaactgacactaagtgaaaggggatataattcaatttcatatccaggaaattcttcttctaattcacttttccaaagttttccaagttctatattactcgtataagctgcatagattttcattgtatcaatatctgaaaatctatcctcaagatccttacgtattgcctgtttcattattcttcttgcttgcttcattcctcttactttcttgaaaacatcaagtttcttaccttgaatttctaaaacaggttttatgtttaacacttttgcaactgaagcaactgctggtgttattcttcccctttttttagataatctaaatcatctggagtaacataaatacttgattgatattgtctgtcttctaaaatctttttaatttcttcaccagacatccctttttttgcaaggttaactgcatctttcacagactgtagctgcgttacagaaatccttctattgtcgacaacatgcactttgttatcataatcctgtgataacacttcggcagtttgacaacttccactaagtgaacttgacattggaatatatattatttcttctttttcttttaaaagttcatcccatattttcataacatctccaggagctggctgtgatgtatttacttctgagttatctgctaaatgtttataaaatccatctgcatccaaatttactccctcaaaataaagctctccgtttatataaaaaggcataggaataatagtaactcctaagttttcagcctgttctagtgtcattccgctattagtgtctgttacaattgcaatactattacacatataaattcctctcttaattacgtattctagtacatattttatatatatatatagtattattcaacttacaataatattcaaagtgtagtttatcgtacatattaatttaaaatgtacattttcttttgacattagtatatattaactgacaaatatcacatactaattattgcttgaatatatactaattttatttttagttatataatattaactatactatataaatcgaggttaactaatgaaatcaaaagatatacgtgttcaaaaaactaataaaagtattgaagatgcctttttaaatcttataaaagaaaaatctttttcagaaattacaataaaggatatctgcagtaaagctatgataagccgttctactttctatgctcattataaagataaatatgatttactggaacacttttttgaaaaaataatatctaattttacagctcttggtactaattacttctgcgataaatcaatgactttaaaaatagaaacggcaactgaactccttaattatgtttatgaaaattctcatatatttaaaatttttcttcagctcaatgagcaaaatcttgacttatttaatagattaacaagcattataacaaaaggctgctttgattattttgaaagaactaataaagttgataaatataatcttggaaatgagtatatatcacacatttatacatcaattatcatgaactctataagatggatttctgtaaatcaaaataaggatgatattactggtatattaaaattatcatcagacataaataaatattttttactttaaaatgttctttcgattattttttatatattacagttatatttattgaggctatttttcattctccttccactgtgaccatgatgtttgaaatccgttttgattttctttgcaataattataaaacatattcataaaatctaatctatcttgggttccgtcttcatcttcaccgcttaacaaatctgatcctcctattaaattttgacgtttcattatatcgttaaaactaacattctttgaatttttcatcatatcgtacattgccataaaagtagtagttcttcctgctcctcctctacaatgaaaatgtaaccaagttccctgtgataaatttcttactgtctctacaaataaatctacttgatcatctaatggtttttcatgatctgttacagtaattctcaaataattcatccctaaacttttagctaattcttcttctgtttgtacacttttaggattattaatctcactgattgtgtttatagattttcctttaggtagtttatcaaacgatacgtaattattttttattatttcattcaatttacttttctcatcagatataattgtgtctctaggaatccccttattcgcttggtcattttctccaaaccaacttattcccataccattcacaaatccatgatcttcttgacgcaaatcaatatccataatatcttctacacctattttttcctttacccttcttaaacctttttctgaaagtgcaccactaccagatatatttaagtctgcaagtccttgaatactaatatctcctaattttttgctatctattttatcttttgtagtcctgaaattttttggtaatacatctttattttctgtgtctattacaagctttactttgttattttgaatattctctttttgcgtatatatatttctattattattataatgttgcacgtaatatccaacgattaataatcctataaggactgaactcaataaaatatatactatctttttctgtttcataaaacttcctcacttcactatattacttaatattaacttttttacattatatcaccttttttatattttatttcaattattaaatttatgtaataatctactataacaccaataaaacccactaaataacatgctatttagcgagttccattaaaattatttatgcaattttacaaaaatattaatttagatgtaataaacttaatattttttactatcaacaatatatatttataataagtataatattaccaattacttattaaacagaataatgaaaaattaacctttaaaatttcataataagattaaaatactctcttccttttgaatacttacttaattctaaacatttattaattccatcagtacctaaaatcacaaatacccagcatataatatatccatatctgcattgattttctaacataagataagcacccatgtatccaagtaagattaatttaaataagtttattgatagatttccattattatctttatttctcaatcctataataactaatattagtattgcaacatagataagttgaaaaggtaacgatccaaagcttcctattttaaatatcattttattatcctctaaatctttctgagtccaaaacgccccagcaaaatcaccaatgcaccattgagatgagagttttgctatataaaacaacgaaagttttataggagatgtagttgtaagtctttcatatattatcctcttacattctgattctattttattataatcaccaacatatttttcagctatatcagcatcttctgaattccacataccaaggctatttatatttgtaccttttaatatacttgttatcttaggttctgctcctctccataatggattttctattaaattcatcctttgaaggcttgtacttataattaataatactaaaaaatatggtactataatgcatactatgttttttaatttagttaatatgttttcttttaaatacattattgaataaataacatatgctatcaaaataactattgcaatcattctaaatatatttcctataccaaggactatactgctaacaatgaatatatatcctttagtccttgatttattaatattttttataaaaatcagtacacttaataaataaaaaggcatagctaaattttcactgcaaaataccgatgtatacgttatagatggtgaaaaaacacttccaatacctaaagcacacattgcatatttttcatctttaattatctctgatgctactaaatatataaataataatcctaataatcccaaaattagatttactattttcattgcaattatattatagtatggaaagatatattgcattattgccatatataaaatttctccgattatatgaggaaaccttgctccataatttataccttttaatattttctcattcccatttaaaagttcttgtgctgaataatacattgttgcaaaatctgaagttggaacattatttgcgttaagtaaccataatactcttaatattaaagcaattaatactatataaaaaattttctgactcaatttcaaatttgaatttataattttgtattctaatagtatagaaattattaatactaatgtaattactatagtaccaaatagattaaaaccaataaatgtagcgccgcacattataatactcgttattaaaattataaacagtaatactctaagcattataattataactttattaaaccgcgtacttaacatattcatttttatacacttccttaaaaattatcttattaaccttttatttgtaatttaataaatataattttgtggcgccacacttatccttacataacttttcaattattattgcagagttttactgcatatatgaatttcattaatttaatttattatttatatatttttcaaattgaacctttatttctaaaatattattttctaatgatgcttctactttccccccatatcttctattaacaatttcactattgataaacctagtcctgtagttgatttatttcttgatttatctgctacatagaagcgatcaaataaattttctacctctatatcaatacattccgatactggatttctaaaggataaaattattttttccttttttaaaatatctatctttacatttccatttgaatggcaaagacaatttttaataagattatttataattcttttcgtattttctatatctgcataaataaatacaggatcttctcctgtgtagataacttcaatgttatgttcttcaaattgatatactgaatctgcaatcatatttgatactatattagtcaagttaagctttttattgttaatatctgatttcgaaatttctaaatatgatagttcaaagaaactatttatgagatgctcaagttcatttatatgatttaaacatacagatatcattttcatttgtttttcatcttctacatattttttcaaaagttgaatatacccttttacagatgtaagtggagtccttaaatcatgtgctatgttagctatcatgtctttcatttgtttttcatgaccaattatcttaagtcttatattttcttctctagaaaatatattattaatattggctccaagtatagttaaatttttatttaacaattgtagttttataggttgccttaaattgtcctttacttttctttctatctgtatatttattttttttatttgcatctgtaaatttacaatatatataactaatagtgatattataattaacaaaattatatctaatatgatataaattcccccttctagttaccttcatttaaacaggtacaaaaaatatttttatcttaattcagtttttctaaatattatataggttatagaaaatgctactataatacgtaccatacacactaaaattatatatgatatatcactatatgacatgtccaattgaagtttattataaagtaaaaaaatcgaattatttgatatatattttattgtatatgaatttttaataacatcttgaagtacttttaaggacatcaccggtaaaaatagtccaatagcccacactgaaattgaaattgatatgtgtctaaatatatatgcaataataaatgcagtagaagatattgtacacattattaatagagataataaatacattgtaactattttaaaaatcaataaacttgtaatgttctgacctataccatacaatattgttattcctgctgtgcttataatagtaaaacaaagcatatatactccatttgcaataaaacatataataattttacacatcaatatttgaaacctgctatatcctgctaaatattcactatgtataatcctgcattcaaaatcacgacatataaaagcgattataaatatactatgaagaactataatgtaaatttttccacttatcatatcagtaaaacattctaatccatttatagcatatgattctcccatttttttcaaaaacacttccatctcataaatttgctgtaacataagtatgaatgagattgcacatattcctaagaatatatactgaaattctttgcttttttttacttttaaaaattcagttttcaataagttatacatgatttccccctatagttctcatgaaataatcttctagagaatcacattcacatgataaatttgttactaaaactttttcatccatgaatactcgagctacatattccttatcatcaatataattatataattgaatagatttatctgacataaccctataatttctggttttcaacgaattttctattacatatgccatcttttcaggtgtactagaacttagaagaagatattttttgcatttttcatctatctcttcatgtgtaatatgctcttttatctcccctttgtgcaaaataatataatgtgatgcaagcatatagagttcccttaaaatatgacttgatataaaaatagtaatatgcttttcttcatttaattttttaataatttctctaaattcgataattgccttaggatctagtccatttattggctcatctaaaattaaaagttcgggatttcccataagagttattgcaatctcaagtttctgcttcattccaagtgaataagtagatacccttttatccttaacttcttttaggtttactatttctaaaagttcttctataatttctttattaggtattccttttaatattctatgaaattcaagattttcttctgcagtcatattttttaatatgccagtcgattgaattaaacatccaatacgttttctctcatctttaagatttttttcaccatcttgtccaaataatacaatccttccttcttctggttttacaaagcctgctatagctttcattaatgtagtttttccagctccattaagacctataagtccatatattttaccttcctctaaagcaatattaatattatttagtacatgtgtacctttataaattttagaaagatttttaacatccaaaatgaatttattcgccattgtttccccctcttataacattataaacataaaaagtaaaaatatagataacatatttataaaaagagtcaagaaaaagataagttttcttactagcttaaatttttcttaacctatatcctaatccccacacagtttcaatatattgttcattttcattaccttctcttaatttatttctaagattgcttatatgggtttttattgttttttcatcgcctagatattcacttttccatacggattcatataagacaggttttgaaaaaacttttcctatattattcatgagcacctccaatatcatatattcagtaactgtaaatgaaattatttttccactaacttctactacctttgattcataatctaaaatgatgtctttataaatcagcttatgacttttttgcatagttttcttatatcttctaatgtttgtctctatccttgctataacttcatcaatatcaaatggctttgttatgtaatcatctgcaccaattcttaagatatctactttaattccaactatatctttcgcagaaattacaattacaggtatatctgaaaatttacgaatttcttttaatatttcatcaccacttttataagggagcataatatcaagtaatatgatatcatatctattttctttaatttcttttataacttccaatccattatataaggattttgtactatatcctgcttcacgtataaactgtgataagagaatatttacatctttgctatcttcaacaatcaatatattttccattaattttctcctaatctaaacttaatagtttcataataaatttcaacctatattccaatgatttctttgatattaatactctattagtacaatagaaattctagcataagttaattactcttatatttctaaatcagataaatactagtctaacaataaaattttataataaaaaagaacaccgccatttacagtgttcctaaatttatttaaaccctagtagccaactactctattgtattcatttaataacttgtccaaatcttgactgaccttaattacttttgaatgtaataaattaccctctttaataattaaataatgcattagttcccttaatctttctatctttactattaaatttatttttttactcatacaattctcctctcttcatctcgttttatacgattatatactttaatggataatatgtatatttcttgtaatctaatgttttatacaaaacaaatgttttcatattgcgtttttgttaaatatatatattttttttaactatttattaataaatagttgttttctagattaatatcatattttttataactaataataattattaattatatatactataatttgacagttatatataatatttttatttgttattacaatggtaatatttaatataaaattatttttttcactttacaataattttcaaccaataaaaattaagtacactcaaaatcattaaatatatttacatatatccaacttttgaatgtacttaaatctttcattttctcctattaaagagaaaaaaattattaatttattttaagattatagcttttcttattttgttatacctaaagctcctcttatgtaagaatgtacaacttctgtataatttaattcacgtaatttaaacacaactagtccaaaaatttcataagaagacgtttcttccttttccattgccttcattgtattttctatcattctacatacgtttaaaagatcagattctgttagcataatattgcaatcacttcctgcatttgcaattgatcttcttactttacttatatcaaattcttcttttttcccagtttttttacttactaccataataatccccctcaatctttaaaaacatactaaatagtcaataaaaatgtgaattctttattattttaagtataacacatattacatattattcaatattttaattaaacttatattattgataaaatataatattaactctctatatttcttcaaataaataatttaaatgcattttcaaaatatactattacttagcattatccttacatttatgtatactttgttaaccttattaaaaataactaccctatgaatatataactaaatataaacagatggcagttaactactcatattaatttacacttcaaatccaatactttttaaaagctctatatcatcacatgtttttatacctgaagtcgtaagcatgtctcctgatattgctgcattaactccactttttaacgcccttaatcctttatcatttaacaaagagcgccctcctgcaagtcttatttgggttgttggaagaataaatctatataatgcaaaagttctaagaacttcttcataagaaataatttcctgattttcaaggggagtcccctttattggatttaatatatttactggaacactgtctactccaagttctcttaaggtaaatgccatatctatcctatcctccattgactctcccatgcctattatacctccactacacacttgaagacctgctttcattgcatccttaattgttttaattttttcatcataagtatgagttgtgcatatctttgaaaaataattttctgatgtttcaaggttattatggtatcttgtaactcctgcttctttaagctttattaaatcatcataagataacagtccatgagatgcacaaagttcaattgggcattcatcttttatagccttatatgtttcagcaattaaatcaacttgattctttgtaagcttcttcccagaagttacaattgaaaatttatgaactccttgatcataatttgacttagcactgtttcctattatttttgtatcaagaagatcatattcatttacattagtattgaaatgaattgactgtgcacagtatttacaattctcactacatctcccactctttccattaatgattgtgcaaagattaaaagtatttccacaaaatttcttacgtatttcatccgcagattgtgtaagttcatcaagattttcatctataatgctcataatttcttctttaccaagaagccctccttttagcacttttttcttcaattgtttaatactaatcaaataaatctctcccttaaatttttataaattaaaatatagtatactcaaattattaataatcaaacttttcacccttaccattatcataaccctttatttttccataattatctcctttttctattttgtttattactattttatctgtaaccacaagcattgtcaacttaatatttaattacggtttacaatatgttttttatataaactataaaattcattaacttaaactaatattttttcgtttgtaaacaacaataaaggtcatctgctctcataatattaagcagatgaccttttggaattttcaatagctttatttaattattatattcttaaattgtaaatttattcatctcgtctttgattttatcagaatatttaattgattctttagcatttgacagaactaattcagatttttcttgaatatcaatagctctttgagatatctcagtagtaccttgagccccctcacttgcagtctttgcaacttcatctattgcagttaaaacattatctaatgaagcagttagttcttcagccgtagcactaaaatctgtaattagaccttctacaaatgctgcatcattttcatatttttcagcaacctctataaaactatcgtaatccttagaaacgtcttctttaacaaaatttaaaagcatatttgaattgtcagataaagatgctactgaatttgtaacatcctttgttacattttgaatattttctacagcttctttagactgttctgcaagacttcttatctcttctgctaccacagaaaatccttttcctgcttcaccagctcttgcagcttcaattgcagcattcaatgctagtaaattagtctgctctgttatacttaaaattgtatcagctaaaacattaattttatcaactattttagcaccttcaagtgctacttctaactttttctgtatttcaagacttactgattctgctttaactttagattcttcagattttttctttgttatttttgctctcttacttatttctatagcttctgcagaaccctcctcagatttttttgcaattgcttcagatgctgcatttatttcatgtgctgatgctgccatttcttctgaagatgctgcacactcttccattcctgctgctaattcttctgctactgctgatatattctctatatcttcatttaagacatttatattttctccaattttaacagccatttcattgtttccatcagatgcattcttagcttcatatattaagttctgcactgtatcatgcatatgttttaatgattttgctattatgccaaaatcatccttcctattaataagcttttctggtatatcttctttaaaatcaccagtggacattatttctaaacttttactgacagctttaaatccttttaaaatttccctacttaaaataatgctaaatatagcacatagtgcaattgaacttattactataattgcaaaatccctagtattagctgcaactatagattttaattgactctgcttttgagctacttctttgtctatatcatctgtataattacctgttccaatgacccagttaaatggttcaaaagccttactataagctcttttaggagatgcttctgattcaccttcttttgggaaataataatctgtatatcctccaccattttttccttttgctattatttcctgaatcatcttatatccatttacatctgttgaattcattcgatttgttccttctgtactatctcctaaaagtaccacattgtttccatcataagtatcaatccaaaaatatccgttttctccatatctcatttgacgaactaaattagcagctaaaagcttggcttcttcttctgtatacttgccattttcataatcacggtaaactcctttaataacagttattgcaccatcaacctgatttttaatttgattatcataatcatacctcataacattttctaatgaatttaaagattcattacttaattttgattgctggtgtacacttattaacgacgtcataattattactccgattaaaatacctatgattccattaatctttgttctaatttttaaattttgtaacatataaatccccccacaacttgataacgtttactattatagtatacaccttttttatacttttttctacattctatagcataaaatgtagaaaaaagaatctacatctattaaaatatatttgtgtagattctttaaaaactatcttctatataaaatttatttttataattactgattatttaataactccaccttcaactacaaggctctcttcaaattcatcaccatatactgattttaacgtttcttcataagctttgtgtacaaagttttctttacctaaagtttcaagttcagtattaatccattcttgaagttctgtatttccttttgctactgctggtgcaattgtatcctggcttccaagagttgaaactccaactgtaaatcctggattatcttttgcccatgcaataacttctgtattatcacttaatattccatcaccacgaccatcctttaatgcttggaatatttccgaatactgttcgtattttacaagttctacatcaggataattttctgtcataaatgtttcagcagttgtaccttttgctacaattattttctttcctttaagttcatctgctgatttaattggagcactttctggcgaaactattccaagagaaaccttcatataaggatttgcaaaatcaactttttcttttctatcatcagtaacagtaaagtttgccattatcatatctactttatttgattcaaggtatgcaactctacttgctgcatcaacaagtacaaattctgcttttgattcatctcctaaaagatcttttgcaaatctctttgcaatataaacatcaaatccttgattttcaccatttgaatcaacatatccaaatggagctttatcactaaatacaccgattttaatagttcctctttgtttaattgcttcaatagaacttttattttcttgtccagacttatctgctacagttccacatccagttaaagatgtaagcgctaaacttcctacaactaaaattgccgctaattttcttaattttttcataattattcatcctttcaattacttaaactaaattaaccctaaatttaaatattatttttaaattttgattcattgctttataaaatcttataatattttttcatttaaaatatccttattataaaagttaataattaaatatatttaaaaattgttttgcacgttctgtttttggatttgtaaaaaattcatcaggctttgcttcttcgcatatctttccttcatccataaatattatcctgtctgcaaccgcctgggcaaaccccatctcatgtgttacaatagccattgtcattccctgctttgcaagtcctagtataacatctaatacttctcgtaccatttctggatctaaagatgcagttacttcatcaaataagattacttctggattcatacataatgcccttactatggcaattctctgtttctgtcctcctgaaagttgcctaggaaaggaatcttttctatcaagaagtccaactttttctaaaagctgttctgcttgagatgtaacctcacttttatctcttttttgaactttcaatggtccaagcattatattttccatgaccgtcatatgagggaaaagctcataattctgaaataccattcctattttctcatgaatttcctgccaattaatatttttatcgctgaacgctctatctttaaatttaatatctcctccctgaatcttttcaagtccattaagacatcttaagaatgtacttttaccacatccagatggtcctaaaataaccaaaacttctcctttatgcagatttaaatctattccttttaatacttctctatcatcatacttcttatgtacatcctctacctgtaataaaacaggattattttccttatccataattccctccctttaaatttttgaatcaattctaattttcatatatttctatcattatttaactatttctaaattaatgtcttaatcacatcataaaaaacaatatatctattttcttaacactatttaattactagtaatattttaagaaatcattttttaactattccacttttgctctagatttttagatatttttgataatggataacaaataataaaatatagaaaaaatataaatccatatatccagaatgatgcggtaggaaattcaaatcttgaagtttctataatctgttgtcctattttaactacatctattactcctatcaatactacaagagatgttgtctttaccatccttgttgcaagatttattgttccaggaagcattcttcttacagcctgtggaatcattatatatctatagagctgaaaattattaagtcccaaagcctttccagattcaatctgatgttttggaagtgactgtagcgcacctctaactatatcacccatttcagctgctccccataatgtaaatacaattattgaaactgcttctccacttaaatttacattcaatgcagttgttactccaaaatagaatataaacaaccatacaagtgtaggaattattctaaaagcttctagatacactctatttagaaaaagcactattttatattttgatgttctgctaagacctaaaataattcccaaaagtgaacctattattattgatataaatgcaatttctgctgttgtcagtaaaccttcaaaaatacgctgaagattcttaccttgaaaaataacactaattgccgaattctgcatatcttaacttcctttctaataatgataaaacaaacgatataggtaaaattataattagatacactatgacaagcattgctagtgattcaaatgttctataatacattcctataagatcctttgttaaatttgtcacttctattattgatatagctccaagtatggaagtctcctttaaaaggaatataaaatttgcacttattgaaggcatacttattgaaaatgcctgaggaataataacatatcttataagctgagttttagaaagcccaatacttattccagattctatctgtgatttagaaactgcctcaagaccgcttctaaatgcttccgccatataacttccacctaaaaatgcaagtcctattacagcacaagttgtttcactcatttttagacccaattttggaagtccaaaatataagaaaaatatctgaactaataacggagtgtttcttgaaagttctatataagcttgtactattttttccaatatttttactttaaaatacaaaattatgctacaaaccaaaccaattataattgataatattattcctataaatccaagcttcaacgtaagacctgctgcttctgcatacgaaggcatattgtcaataataaaattccaatcgatgctcatatttctatcacctttccattttatgtattaattcttactaaatctgtaggattacttgtatcttatcaaatactaccaattttgtcaacattaaatacttaatgatatttttgtaaagcaagaaagcattcgtacttgtacgaatgctttaaagctttataaaatctatattctacaccagtgtttttttgtaagtatccttgttcaacttgacaattaatatctcctataaaaattcttatattatttctttaataatatgtttaatatctattcaataatatatggacttattgcatctaaatatacaataagtccatatattatttaaattattaagctacgtaatctgagtattttttctcatccagttcatcttcactctttgcaactattactgagcatacacaatcacccattacattaactgttgttctcatcatatcaagtattctatcgaatcctattataagagcaatacctgcaagaggtaaatttgctgactgaagcaccattgcaagtgtaatcatgccaactccaggaacacctgctgttccaactgaagcaagtacagcagtaagtataactgaaagaagtactccaacacttaaatctatattataaacctgtgcaataaatattactgcaactccctgcattattgctgttccatccatatttatagtagctccaagaggaagtgaaaaagaatatatcgatctgttcacacctaaatcttccattgcttccatacttaatggaagtgctgcattactagatgatgttgaaaatgtaacacctgcaacctttgtatatgctttataaaattgtgctagtggaagtcttgtaagtactttaaataatccaccataaattataaacgaatgtataaccattcctattgctacaaccatgatgaattttgcaatgctaaataatgaatcaaatccaacggaaaatacagtcttagatattaatgcacatacaccaattggtgctaaaatcattacaagatcaacaactttcattatacaatcatttgctgaattaaataatctaataagtggatctcccttttcacctataagatttaatgcaaatcctattataaccgcaaaaactattacctgaagcatgtttccttctgccatggcttttataggatttgttggaatcatatctaaaaatacttgaacaagggactgtgattcgggaatagtataatcccttgaataatacttgataagtcaagtccacttcccggcttaaataaaagtccaagccctagtgcaattgtaactgcaatccctgttgtaatcatataaaaacttataaccttactacctacacgtcctaattttttagcatctccaaaagtagacattccacatacaagtgagataaatacaagaggtactactgtcatctttattaaattaataaatcctgttccaagaaattcaataatacctccaacaataaaggtatccctaaatgagccctctggaatcaatttaattaataatcctaaaacaattcctaaaataagaccgatcattatctgacctgttttatcttttaataaacttttcatcttttttctcctttgtactgtttcctttaatttaactcttatacatttttacaaaaaatacttttataacttttaaacaatttaatttttgcaaaaatgatattttttaaaagaaaaaatttcattttttctttttttcataacaaatcccaatctatatgtatataatccaagtagaattttactaaaacacataagttttatcagagtcaataaagaaatagcgaatatttatcacgcatattaatatatcatcctttattattttttgcaagaaatctatttaaaaaattgcatttttatcttaaaccttattaaattcaacaaaaaagaatttctcctcttttaacaagtttatacactgtattttttgttattttcagcaattcaacagcttctactgcactcaataattctttacaatccatacaatacctcctataaactttgatttattgactgaaaaatatacaggtgataaaatttactgtaattataattgttgtaaatatggcaaaacatattaatacttatacattttcaggaggaaaatatgaaaagaattagaactattttatctactttagtaatatgcatattaggattatctattataggatgtatgaattctaaaaacaatggtgaaaaccctgcatcagaaactaatcaaacaaatgataagtctaatgttgaacttacaatttctgctgctgcaagtttaaaggaagcaatggcagatattgaaactgaatataattcatccaatccagaagtaaaattaacatttaatttcggttcttcaggatcacttcaaaaacaaatagaacaaggcgctccatgtgatttatttatttcagcaggacagtctcaaatgaaatcactagatgaagaaaatttactacttgaaggtacaaataaaaaccttgtaaaaaactcccttgtattaatcgggcctaaggataccagtttatcaagtgtaaacgaccttacatcaaatgatgtgaaacatattgctatgggagaacctacaagtgtaccagcaggtaaatatgctgacgaagcacttacaaatatgaatcttaaagattcagtatctaaaaaactgacttttgcaaaagacgtaaaagaagtacttgcatggacagtttcaggaaatgcagaagctggatttgtttataaaagtgatgctttaagttcaaatgatgcaaaaataattgaaacagttccagaagataaacattcacctataacatatcctgtagctgtacttaaggaaagtaaaaatccagatgcatcaaaagaatttgaagattttttattcagcgataaatgcaaatctatttttgaaaagtatggttatgaaatagcataaaaattcttgcttgataggaggccttaattgaatatgactaatgatttttcacctctttggatttccataaagactgccctattatcaactttaataactttctttataggaattgcagtttcatattttatggctaattacagaggaaaacttaaaggagttattgatggaatccttacacttccattaatcctgcctccaactgtagtaggtttttttcttcttcttatatgtggtaaaaatggtcctattggaaagcttatgattttatttgataaatctataattttttcatggagtgcaactgtaatagctgctatagttgtatcatttccaatgatgtatagaagcggtcgctcagcttttgaacagattgatacaaacttgatttttgctgcaaggactcttggtttaagtgaattcaagatattttataaaattgctctccccttgcatggcctgggattataggcggtcttgtcctttcatttgcaagagcaatgggagaattcggagcaacattaatgcttgctggaaacatacctggaagaactcagacaatgcctcttgcaattttctttgctgtagaaggcggtgatatgcagaaagcgttattatgggttctaattataacaatgctttcactaatacttatccttgcactaaattactggtcagaagcacaacttaaaatcattggaaggagaataaaatagtgtctttatatgttgatatagaaaaacaattttcatcatttaagcttaaagttaattttgaaagcaaaaatgaagtcttaggtctgttaggcgaatccggctctggaaaaagcataaccttaaaatgtatatctggtttaatcactccagataaggggcaaataatcttaaatgataaagtattttttgacagtgagaaaaaaataaacttatcgcctcaattgagaaatacaggatatttatttcaaaattacgcactttttcctacaatgaaaattaaagataatataaaaataggtattgcagatatgcaaaaagaaaaacagaatcttcttatgaaagaatacataaaaaaatttggtctttcaggtcttgaagatcgttatccatggcagctttcagggggacaaatgcaaagagtagcacttgcaagagcattaataacatcaccagacatattgctccttgatgaacccttttctgctttagatatgcatcttagaaacaatatggaaaaagaacttctttcaattataaaggattttaataaaaatgttgtttttgtaactcatgatataagtgaagcatatagagtctgtgacgaaataatagtgtatgaaaatggaaattctctaaaaaaaagaaataaatatgaacttttcactcatcccaaaactctttcagaagcaaaactaacgggatgtaaaaatatatcaaaagcatctaaaataagtgataatagtattatggctgaagactttggatacaaattcatatttagtgaaaaagtacctgatgatatacattatttatgtataagatctcataatatcaatatttctcaaaatataaattcaaggaacacacatccttatacaataactaatattatagaaaatccttttgactatactttatatataagaaaagatttaaattcaaacaataaacctatagaatttactatgtcaaaagataactttaattataaaattggggattttttatatgttaaatttatggaagataaattattctatttttagataatctttttcattaatacttagaaattaattgtctacttaaatatatactaaaaaagctgatctatatttgatataaggaccagcttttacttatatatttttttcaaataatccttgaaagagaaaggcttttttgatcaacaaaaacatcttataaatctacttttttacaactttctctttttatcatatttactggtataacataattagcagaaaattgaacatcattttctaatgatgtaataatagactttgttgctatttctgccatttctgataattccattttcatggtagtaagaggcggattaaaatactgcgcagcttctatgtcatcaaatcctataactgaaacgtcttctggaactctgattccttcttctttcaatgcttttatagctccaaaggcaattttatcattacttgcaaaaatagcagtaaatttattatttttgctcagcaatttttttgtagaattatatccaccttcttctataaattcactgtgtataatcaagttcctttttataggtatatttgcgtcctttaaggctcttttatatccctttattctatcatttgatgaaaatttgcctgtacctcctgtaatatgagcaatctcagtatgattcatatctataagatatttcgtagcattatatgctcctctataattatcaacatttacaatcatacatttattatatgtattatcatctgttttaatagtttgatcaataagtacaactttatatccaccattaatcaatttttttattacaccatcattatcattctgcccaatgaatattccacctgaaattgttttgttgtagaaacactctttgattttctcatatccatctgcattatgtattatatgcacaagaactgtataacccatttcacttgcattttctataacagagcttgtaaattctaaatagtaaggactttttgtaattctattttttaatccataagctctctcaaccatatcaacaataaataacccaattaccctatttttactcccagcaagcattcttgctgatgcatgtggtacatagtcatattcttctattattcttaaaactttttctcttgtttcttctggaacatttggataattatttataacccttgacactgtacttcttgatacgccagcaatctttgcaatatcactactattcataaaaatactatctcctttttatataaactcgcgtttataatatattttataatatttagtataatctttcaactttttgcctattatacttttaaaaatatataaaaagaatgtattgtggataatccaaatacattctttattttaatcaattatttctttaattccttatacatgtcaatcatttcttcaactaaagattttatagtttcagccgcaatcatctgatcttctgcatgcattataatcaatgaaaattcaatcttttcaccagatgcttctttttgtataagtgatgtatgcgcgtgatgacctttaataagatattctgatgcttcttctaattttttattacattcatcataatttcctgatcgaacagctctcaatgcttctacagatagtgatttagccattcctacattacttattatttcgaatgctatcaattccattccttccattgttaaatctcctcacttagtctctttattttatgctacttcaatttctttctctatttctttttgagcagctttgttagctgcgattacaaatggcgagtatattaatatactaactccaagacatataaaccctataactaaagcaaggatgtttccaccagttcccaagaaaggcattaatggtcctggggttgtccatggaataccataagcaactggtggtattattttcaaaatacaaatagatgtatagcctatcataatattcactataggagttaatacgaatggtattatataaattggattcaatacgataggtaatccaaaaataaccatctcatttatattaaataaaccaggtgccaaagaaagcttagcaatactcttttgatcttttgttttactaaatattaaaattgctattataagacctagtgtacatcccgatcctccatattcagtgaaagcacttgcaagtccactatatgttactggataaggtgctccccatgcagtagaatgtgcagatacatataaaagatttgcatttcctgcttctgaaaacatagtatcacggattgctgctatagtatttggtccatgtatacccataacccataatgcttgagataagaaggataatacaagtaccgaacctacactctgacttaattttgttaatggtgtttgaagtaaattataaactaattcatgtaatccacctggtgcaaattttttaacaataaagtttaaaattgaaaacgttatagttgttattataataggtaatagcactttaaatgttcttgctactgctggtggtacttgttctggcatcttaatttctaacttttctgattttgataaaatagacattaattcaccaacaagtaaccctactattattgctacaaataacccttgagcccctgtaaatcttgttgttatataattagtcccttctactgataaataatcaggataaactataaaataaactgaaatagctgtaagtcctgtcaataaatcatcgctttttagctgctttgcaagatttctagcaataaggaatactactagtattgcaaatatatcagctgatccttttaatactggactgaatatcgcctggcattgtcctatgtttggaaatactttatctaacttaagcatttttataataaatccatctggtgataataatacattattaagtaataccattaatgatcctgccatagttaatggaaacgataagataaatgcatctcttactgcacatatatgcctctgtgaatttattttagaagctatcggtactaataatctttcaattgcactttgaaacttgtccataatactcatattaattttctccttactataattaatttcttattttattttgttaagtgtatcttctaaaatagccttcccattcatcgtaccatataatctcatatcgattacatcaacaggtattctaccatttacaagcttttcaacttgtggtttctgaaaacgtacttgtggtcctagaagaactatatcaacagtatctataacagaagaacattctgctactggaagagcacttatttcaatttctattcccttttcctttgctgctgattgcatttttgtaactaataaactggttgacattcctgcggaacatactaataatatttttttcataaataatcactcctaaaataatttttataatttatattaatttgaattatgaggcaactttatatttcttctccatttgagcctataacattcttataccaataaaagcttttcttttttattcttcttaaatccttttcatcattctcatctctatctatataaacaaatccataacgcttttgatatccattaagccaacttaataaatctgtaaatgaccatgtgcagtatccaataagatctacaccatccgttattgcttctttgcaggcattaacgtgatttttaaggaacttaattctatattcatcgtttacaacatcgttttcttctagtttatcaaactctccaagaccattttctgttattaatataggaagattgtatctgcttgttaatcttctaagacctactctaagtcctgtaggatcaattgcccaatcccaattagtagtttctaaatttggatttgtaacatttttaaatactcctggtattccactttcttttgttgttccttttttaccagtattattaattccttctgctacgccaactccatctaatggattcattgctacagtagcagtctggtaataatttatacctatgaagtcaggttttgcttttgctaatagttcaagatcaccctcttcaattactggtgctattcctaatctttcataatatttcattgcaaatgctggatatacacctttacagtaaacatcaagccaccagttgctgtttaaatcttctgcattttctgctgaaagaacatcatctggattacagctgtatggataaacaggtccatatgcaaaactcggtccaatcattccatcttttacataagttctgaatgattctattacttttgcattagctaaattagcgatatggtttacattaagcattctcttatgatctttaacacctggtggatgtaaagctgtaagatatcctaaggtaacgaatacattctgctcatttaatgacacccagtactttactttgtcaccaaatcttttgaaaagagttatacagtattcattgaaatcatttattatttctcttgattcccatccaccatataaatcttgtaaatgttgtggaagatcccagtgatataatgtaataactggctctatattattctttataagttcatcaattaaatcttcatagaacttaatccctgcttcgtttatttctcctcttccattaggatatatacggctccatgcaatagaaaatctatatgccttaagtcccatttcagccattaatgctacatcttccttatatctgttataatgatcgactgcaacatctccattcgtatctttaaaagttgttccaggtattttagtatatacatcccatatactcttaccttttccatctttatcccatgcaccttcaacttgataagctgctgatgctgatccccaaaggaaaccatctttaaatttttctagtttttcatatatcatctaatcatatcctttataaatttattaattatgcctatttacctaaatatttttatttttttatttctgaatttattattgctccaagtatatttgcatcgttattatacttgcatttttctattttagttgtaataaagtttgcttcaaggtaatcaatacaagtactttgatacttttctctgagtttctcaataaaccatttttcttcagatatgcctccacctatgcatatgatttctggattataaaatacagttatagttataagttgaattactatattatctatccattcttctaccgcacttatggcaatttcatctccatctaaatatctttcacatattttagtaccatatttagttttaatatcgttttcaactttgccattataaatttctattaatcctgtaatagaagcaccatcacccattttgtttatttctttagtttgaaagtttataaatgggatattatgaaattcaccagcaaatgcatcttttccatatataactccatttttatcacataagcatcctccagttcctgttcccaatattaaaaatcctgaagatttgcttccttttgcatttcctattgtaaactcacataaacctgcagactttgcatcattaattgatgcaactttcttgtttgttcttttagaaatttcatcatttatatttgttccatacattattgaaacattaggtgctgcatatgattttacgttagactgttcatctataagtcctggtgcacttacaccgattacatcaatttcatcattatacttaacgtttgagcataaataatcatagaattcatctttgctatcaaattttaaagattcaactttccatttatccttaatattatactgcttgtctactaatgcaaatttgataaaagttcctcctatatctattcccaaattatatctttccaagttatcactcctttcaaataataaattttatcttcctaattaagacaattgatcttttatgatttttataactttttactactattaaaattattgtaaacgcgcgtttatgagttgtaaaaaaaatttttatttttaatttaaaataaacaataaacgctttatttatagtatattcatcatataaaataatataattcttatatcacttttgtaaacacgcgtttatttgatatttatatattaccttatttcttactatatttcaatatattttataaataatataaaatttttattttttaacaacaatctagattaattatttttagacttattttcactagaattaagtatagtgttgttatttaataaatcttcttctttaaaactttgatcaactttgttaaaactattcttatctactaaagcttctgtttttaattcattcccataagaaataatattttcgttgccagcatttaattgatcattggaagtcaattcattactaactacatttgtttcattattagaaactaattcatgagaatttgcaatatcctcagtttgattttgtatctgttgagaatctgatgttacatcttcaatctttacattatctattgtaatagtatgattttcaataatatttccttctcccattgatattgttaacgcagctttatcatcgctttcatcattcattgtgaactcaatagagtaattttgtaactctccattaagtgatattttctttacttcacaatatggtttccagtctccaccatttttttgtacagtaaatttaatatctctagcaagtgtgctcttagcatcaagactcactttatattttttacccttttctaattttatattttcttgctttagttgaactttatagtcttgatctccactattagttatatttatattagcttgattattatctgaattaaatgttgctccatttttaatagactcatctacatattgagaccatccttcaaatcctttaccaaaatcaccattatttacaatagaactcccagaagtattatcgtttgtgtcatcattagaattattttcatcattatctatagaatctacttctttaagttgtacattatctattgtaatagtatgcttatcagtaatttgagtcccacctactgcccccattgatattgagaatattgcatctgaatcagtatcttttttcatttcaaatcctaatttataatttttagaatcacttgttaaattaattatattagatcctgtatatgcatcccaattgttatcgcttgatccatctctttgaatagcatacattatctttctgtctactgtactcttcgcatcaaagcttagttcatatttctttcctttttccaacttaacgttattttgctttaattgaattttccaatcagcatctccagtatcaacaatattaatttgagcagcattatcttcttttaagctatcaacaccatatgttggtttgcttgaaagtccaccatcagcaaatatttgccatccagtaaatccaccactgaaatctccatttcttataagtgcattttcttcaattcttatattatcgatataagtagtaccctttgcacctaataaaaattctaaatctctactgtcttcaacattttctgtgttaaattcaaatttgaaagttttcttacctttagaaagattagcatcaaaagcttttccattaatcattgctttaatagtcttatcttcatttgcatatgcatcaaaatataatacatattgtttattatcttttaatgcaagtttactttgttttatttttaaatcttccaatgatgaaggagattttttaacgtttattttcaattgtcttacattgttattattagttacagaaacacttgcatctttttttagagaagattcaatttcccaatatttcatacgatcttcgcctacatcaaatgttccattattaacatagtttccatctggcattacttttttagaaccatcatcatctttaataacttggcctattttttcaattcttacattacttatttcaacattagctttagaattttgatttccaagattaaattccagtcttgcatttgcatcatcttctttattcatagtaaattcatatgaataattttctttattagatgttaaatttaattttgtatcatcaaaatatcttacataagatttatctggacctgaaatatccacaatcatagttctctcatcatctgcctttgcatcaaaagaaactttatattttccaccttctttaagaggtactcctggttgtactaattgtatagaataatctgctgtaccttcattttcagttttaatcaaaattttattatcagctatttcagtacttcccacaccattaagagcagttttaaattcccaatttttatcatcttgttttgagaaatctccattaacaacataatttcctgttttatctggttctctaaaaacaacattcttttctggttttttaacgttttcatcataactatctttttggtatactttaacataatcaactttaagttctgcattgttaaagtctgtattttcatcaggatttcctggccaacttcctccaactgctaaattgcattgaatatagaatggttgatcaaatggtgctggataagtaacttcatctccaccttctacttttgtaaaccaatcattaactttgtgatataaattgccatcgatatagaatcttatttctcctggttcccattcaacagaatatgtgtgataatcatctgcaaatgttccattttctaatgtgtatgttccttgttgctctgcatgaggctctccataatgtattgttccatatgctttttctggttcatgtcctaatacttccattatgtctatttcaccacattttggccattgtccatataaactttcatcatttggcatcatccacaatgctggccatagccccttaccttttggagtttttgctctaatttcaaacttaccatatttaaatgtcttcttatcttgtgttgtaatttttcctgaagtataataatcttttccatctttttctgttttaatagccttaataacaagatttccatcctttacagatatattatctgttgagtctgtatattcttgtaattcactattaacccatcctggtgcatgtttttcataattccagtcatttgtatttaatgtgtctccgttaaaatcatcttgccaaacaagattccattttttattttgaattgcgctaccactgttgctactatgatgtttattgctattacttgtttgactatctttattctcatctttgttttgattattattttgtgaacccgcgtttattgtagcgccaaatattttatcattttttacaactggcttttctccaatagcttcaccactagttccaaattcgtattcttttccatctatagtgatttttccaatgtgcatagccccattttcatttaaataatatactttatctgaaacactaattacacctgtttgcattgatccactttcgcttaagtaataccatgaatctttatctttgatccaacctgttttcatatctccagcttctgaaagataataccagtcatttccgtgttttacccaacctgtttgcattgatccactttcacttagataataccatgaatctttatcttttatccaacctgtttgcatatctccagcttctgaaagatagtaccaattatccctatcttttacccagcctgtttgcattattccatcattattaaaataataccattttgaatcataataattccaagatactgaatgtttattattctctatatatttccaaaagttattttcttttctccattctgcattggttttcatcggtgatgaaataaaagccactccaataattgatgcacttaatagatatttaaaaatccttttcttattcatacatattctccttctttatttttttaattagtttttaagaaaacttactaaaccggtttcagaaaatactatgagcaacttatataaattttacacaaaacataattcctattaggcatatactattttattcttttacatgattctctaacaataagttccactggaataattttgttaactacgaccttttcttttttatcaatttgatgaattaaaatagtagcagcttcgctacctatcatatcacatgactgttttactgtagttagtttaggcgtaacatattgagatacatcactatcatcaaatcctattattgatatatcatctggtacattaaaaccttcatcttttactgcctgcattgcaccaagtgcacatttatcaccagcagcaaaaacagctgtaggtctttcttcaagtttcataagatttttcattgcaacatatccaccatcaaaatcaaaatttcgccctttttgtatatatccattcctaattggtaacttcaatctattcatttcatgtatatatgattcctgtcttatattgcttacccagttatcattttcttccatgcctgttatatgagctatttttctgtgtcctaaatcatataaatattgtattgccattttacatccttgtttattatctgatgtaactgttgcagtattttcattatacatatctataactacagttggaaaatcactttctataatttcactggtttccttgtcattaggtatactacatataatagctattccatcaacacttctatattggaaatattgtaaaaatgaatcaatctttaatctatcatttttagaaccaagtaacaaggagtagcctttcttttcagcttcctttttgaaagattcaattactgctgcaaaaaaaggatgttttaatcctatttcagaattttcaaaatataccagacctaatgtccatgttcttttggtagataagcattgtgcttcataattaggttgaaaattttgctcttctaaaattttttttactttcttccttgttttatcacttatatctgaataattatttataaccttagaaacggttgccggagatacccctgcaatttttgctatttcatatattgtactaatttttatcaatccctttttagtttttatttatccatatattttctgagtaataaattctattttatacaataatttttcagatttgctcttacttatgctttatatatgaattctatttttattaatttccaaattataatattatgtttccaattaataatttttctacctatttacaatgaaattctcattatatatacatataattatattattttaatatattcaccaattatcagaaaccggtttcaaaaatatttcacctccttaagtaattgtttacagttatattatattatttttttaacgttgtcaatatctttaatattaaccactattttcataaatgtaattttactttttaaaatagtaataaatatattagatagtgctataataatatcaactacttaattgttatattatcccaatggagaggagcaaatttttatgggaaaattttttagaaaggcctttgatattcagttagaggactcattgacgtatccatctacaaaaacaatatgcgagacaattttaaagaaagaaagtgatattcagtttataaatacagatattccagtatcttttaagcaacgaaatacaacctttgaagtaaaagttgaaatggctcgaggtggatatatattaatttgtaaggaagtaaaataaaacactctacttaaaattaaaaatcaaccacaagttggtaattttaatataatactaataaaaagtatgcctgtcttaaacaattgaactgctctctatcatatatacatggagcagttcaatttgtataaccctacttttttcttattaaaattatatataatacaagcattatattaaacataacctaaattattaattttctaccccttcaaaactccaagtactttttctcttagtttgtcccaagcaggcataataatatttgatttattttttaattcattaaagcttttatcaagagcactcatttcttcaactgcatgactgcaatgattgcttattacaaatttcccaatacatgttttatacatgaaataaagtctattaacctttttttcaaattcatctgtatattgtttttcttcaccttcagggcatattggataccctaaactcttaagcatattatatgcttcacttgttgcttttattgccatagctgcatcttttttctttgccattttcaaattacagtttaaagcataacataaatagcaccctggcagaatttgtgcagcatgtgataagagccacccttccatattctgctgaaattctaacttatatgatgactttaaaaaggctgttttaattgttttttcaaattcatcacttaatttgcatcttagccctcccaatgtcattccaatcctcaatgaatgcatacctacgaccttattatcttttctatatccaccactaccttgaaaaccaaaaccaatttctttcttactatgagatatttttaaaatttctttctcacaatattctggattcatattgtttccaactaatattatatatggacttacattttcccctaacgacttcaatatattaagagtattattatactgcatcaccacgaaaatcaagtcgtatctgtcactattttcaagtttatcaattgttcttactttatctcttgttttataaaaataaccataatgatcaattgtgagtccttgttcatctataatctgtttccaatttccccttgcaagtatcgtcacatcatttcctgctctaaataatttatgtgcaagcacacatcctattactcctgctccatacaccaaaattttcatataaaaacttcctactctataattaatttgttattatatactcctaagttattagtatagtatattcttctttttaatctaatgtatgctgttaatttaaaagtaaaaagattatttgtttttgctcctaattattataatttaattttataactaaaaaactttcttcaaatcacttttatacatttataaaaatcttcatctaataatcaactttttcagtttccttacttttaatagcctcaagaaccttatcttttttcattggaagttcctgaattctaacacctactgcatcatacactgcattacttatggcagatacaactggattaagtccaacttctcccattccttttgctccaaatggtccttcgggttcatttacttctattgtaaatgtctcaatttcaggcattgactttattttaggaatacctattttaaacaaattatcagtaattactttttcatcagtttctatgaattcttcacttagtgccatacccattcccattaaaacagaaccttctatttgccctattacatttttagggtttatggcttttcctacatcttgtgctgcaagaacctttaaaactttaacttcaccagtttcagtatcaacttccactacagcacctgctgaaacaaaacaatatgcataatgaatcttaaattcctcttctttcattccaggaatcaaatcaccacatatcttgtgaggatatgttttaggtggaatatagtccttttcatctaaaatactgtcattattatctttacataaatcatatgctttctttaataatgactttgttataataatatccccttcattgtttgtatgatttttatgaaatttcatttcttcactttcagctgccattttcaaataaaatgaaagtttcggctttactgactcacctgttatttttacagcatttcctgtaacataagtctgtcttgaagctgttgtcattcctccatctggacatatttttgtatcatttgcaacaatttcaatacattcatatggcacttttaatactgttgctgctatctgtgcacatattgtatcacaaccttgtcccatatctgctgcacctattctcacttgaatatgtccatcttccataagctctattgctgcttttgcatcatccagaattcctgtaccaattcctacatttttatatgaacttgctattccaaagccaatctttttcctcaattcagatggtttgaagttattacgtattcttttcattccatcacttactgcttcaagagtcttaagatatcctgttccaccagtaagcttttgacctgtgcctgttttctttccatcatcaataccatttattcttctaatctctgctggatccatattgagttttttagctaatttatctatctgaatttcacatgcaaagcttggctgagtacttccaaagcctctaaaagctcctttagggttattgtgagttgcaactccataagaatctgcttgaaaattttcaacaacatatggcccacttgctgttactgctgatctaaaaattactggctttgttgccgattcatatgctcctgagtctccaattacctttgattttacagccacaatttttccatcctttgttgcaccatgtttcatccatatatgcatgggatgtctttttgtacttattcttatggattcttcacgactcaatgtcatctttacaggacgttttaaaattactgctgcaaggcatgcatgtatttgtactgtagtttcttcctttccaccaaaacctcctccacatggagtatatattacccttaccttttccataggcatattcaaattaactgcaatattctcttgaaagcttattgaaccttggcttcctgtgtaaacttccacaccaccttcatctgtaggaagtgcaagacacgattctgtttcaagatatgcatgttcaactgctggagtataataattaccttcaacaattacatctgcttttttgaacccttcttcaacatttcccttttttgcatgaacttcatgaacaatattattttccttatttttgtttactaattgtgaaccttttttaaaagcttcaagaggatctaaaagtgcaggaagcacttcatattcaacttctataagctttgttgcctttatagcagtcttttcattttctgcaaagactgctgcaactgctgctccaagatatttaacttcctcattttcttttatcaaaaccggctgttcttttgtaaatacaccaaatgcatttattccaggtatatcatttcctgttaaaacaagaactacgccttctaatgcttctgcctttgaagtattaattttctttacaagtccatgagcatatttactaaaaacaagcttcccataaaccataccctctgcagtatagtcatccgcataaattggtgctccagtaactttcttaattccatcaatccttggaactccaactcccacataattataattttttattgaacatccatcatcttcatagtgcttcttatattttgctgctctttttaccgctcttataatacctgcatatcctgtacatctgcacacattatcctttaaagcttctttaatctgttcatcatcaggattatgaaccttatcaagaagagcttttgttgacattatcattccaggtgtacaaaaaccacactgaacggctccttcatcaaggtaagcctgctgaatataatgaagtttttctccatgagacagtccttcaattgtttcaattattgcaccatcaagtctcgataattttacgatacatgaacgctttgcatcaccatcaataataactgtacaggctccacagtgacctttttcacatccattttttgtacccataagaccaagttcatctcttaaatatctcaaaagaaaaatatcctctgtcagttcctttttcattgtgattttatttactgtcagcgtaataacttttcccataactaacaccccgttttttaagttaaaagttcataattatgataactataactttcccccataaattcctctctgtttctttctgcctaacctcttcctttactctcaattactacttaattcttcccttttacttctgtattaaaaaaatacttaataagattcataaccactatttttctatactgtgcagttgatctttgatcatcaattggatttatatttttatcataaatttcaatagcttcttttataaatttatctaaagtattaatttcttttccaataataagagtttcagcttcctttaatcttactactgttgcacctactgctccaaaagacattcttaaatcctgtactcttccattttccacattgcatagtccagcaaaagaaagtttggaaattgcagatgcttttcgtgctcccactttttcataatgtactatattaaaattttctttagatattgtaatactctttagaatttcattttttttcagtgcagttcttcttggaccatatatgaagtcctaaatatttatagttctctctaatccttcactaattacattacacctgctgtttaatgaatataaaacaggtaaagtatcacctgctggtgaagcattgcatatattcccaccaattgttcccatatttcttattgctggtgaagcaacacctcttatagacttttttaaaatttctggtacatattcatttcttaaaagtgaagctaaagtacatccagcacctattactatttcctcattattttcatatacttttttaagttcatctatctgccctatatacaatatatttttatcaaactttggcaaaagtgatgtttcatttttatatctcaccataagatccgtaccacctgcatatactattacattttcactatttagtatctgaagagcggcatttatacttttaggaagataaccctcaacatttcctaccataaactgtcacctctttctgctgccataagtattgcctttattatcatgttgtagccagtacacctacacagatttccagacactccttctcttatatcttcttcagttggatgtggtattaaacttaaaagtgcatgtgcagccattatcattcctggcgtgcaaaaaccacattgaactgctcctgcttctgcaaaacattcctctaaaatcttatactgctttgttcctttaagtccctcaattgttataattgatttaccttcaacagatccaaggcttacaaggcatgaatttacaagttttttatctattataactgcacaagctccacattctccttcaccgcatccttctttaggcccagtgatatttaaatcctcccttaaaaaatccaacaatcttttacttgtatttttatttgcacgaactaccttattattaattaaaaatgttattgatttattcatttgttatcgcctccattatatattcaggagttgctgggactttatttattttaacttcaacagcattttctacagcgtctacataagctggtgctgttccaacaagagtaagctcacctgcgccctttgctccaaaaggtccaagttcacatggattatctataaatacattttttatatttacaacatcctttgctgtcgggataatataatcagttatgctgtgctgctttaaaactccatcactacattccatattttcacatgatccatagccaagaccctgaataactcctccctgaacctgtccttccataatagtcttgtcaatttctttaccaacatcaaatgctgaatatattccctttacatctgttacccctgttaaagtgttaacttcaacttccacaacattaactccccatgaataacttggataagcatctccacagaagtttttttcatcccatggaataaggtctggatgtttatagctttctattatgatttgttcttttttatcaatccactgtaccttaagcttttttgcagctctttcaagaagctttccaacaaccattacagatcttgatgctgcagttggtcctgaatctggcactctgtctgtatctggattattatagattatttcatcataattaattccaagaacctgtgccacaatctttcttaaggttgtctgaagtccttgtcccatatctgtatttgctacaagtatctcaactttatcatccttatgttttaaaagctttaccacagcttttataaaatctctttcaccactgcctgtaaaaccacatccatgaaggaatatggacattcctattccttttttaataatttccttattatttttattatttatttcattttttatatatttctttgaaaaatcacacatattctcaattttgtttaccatttcttccagctttacatcatagaagaagtttccacctgttgccgtatcatcaccacgttttacaaaatgtttcttcttaaattcaagtggatttactttaatcttctttgcaatatgattcatgtgagtttctattgcaaatatgctctgtggaccaccaaaacccctaaacgctccatttggaactgtatttgtctttaccacttttccatgcacttttaaattaggaatgttatacactccagttgcacaaattagtgatctttgtaaaaccacgcttgaaagacttgaataagcaccaccatttaagatgatatcaatatctattcctataatattgttatccttatccaatgcagttttatattttaaaaaagcaggatgacgctttgttgtagatgacatatcttcaattctatttaaaattagtctgacaggacttttcgtcttcatgcatgcaactgctatctgtgaacctagaattgatggataatcttcctttcctccaaagcctccacctgttgttgtctggactattctcacttcatcatctttacaccccagtgcctgaattactgcgttctttacataataaggacattgcatggttccataaacagatactttattttcttcataaacacctacaactccctgtgtttcaagatatgcctgttcctgatatcctgttgtaaattcttcttcaattattacatgtgcttctttgaatgctttattaacatcacctcgtccataaccatactctgcaaatatatgattagaaattttcaaatccaatactggctcttcttcttcatattcaacttctatctcatttacaagtctaactacttcatctaaatctggtcctactacaagcaatattggttcacctatatagttaacctcttcatctgcaaatacaggcatatcattttgaattatcttcaccttgttcaatcctggaacatccttaccttcaattacaaaataaccatccttcatacttggcatgcttattttctttattttggctttagcttttaaagatcttaaggtcttagcatgaagacagtttttaaatttcatatctgcaatatatttagcacttccactcaccttaatttcgtgatctgacttagtaactgatctgcctatatcatttatgcatgattccatgattacacccctttacattaccattacaagtttcttagaatacattgtatattgccttagaaggacatcttgactcacataaaccacatccaaaacaattctttgtatctattttaatttgattatctataatagttattgcaaaatatgggcatgctttttcacataatctacagttgttgcatttgtctttatttataagtggatattctggctcatatttaacttgccctatagacaatttttcatttattacttcttcaacagaattgaatccatgcttttttaaggcttttggaagttcttcaattaatttttcatataaatcctttccctttaacatggcagcagataacatctgtacagcacttgcaccagcaagtaaaaactcaataatatcatctgcacttgaaattcctccaactcctataatttcacattcaggtactgctttttttattttatgaattaatgcaagtgccataggtttaattgcagggcctgatgtccatacttcaccttccttatttccaataagaacacttcttttatcaatatcaatattaattgttggacctaatgaatttattgcaactattccactacctttattttcaataaccatctttgcaaaccctattggatctggtatatgaggactcatcttcataaaaacaggcttttgcgtgaatcttcttattgtttttaaagtttcttttatattacttaaatcctttcctacataatgagttgatatttcaaaagcatctgcaaacacatctaatttgggaatgagaaattccatatcttcttttgtatatcctacacttattatcaaaggcttatcttttaattccttttttattgatggcagaaattcatctatccaaatttctggagcatattctgaccataactcagcattcattatgaaattttttcctccatatatacaaggtctcacaacttctgctttcttacttgaaattgtctttgtaaccattgcacctacaccaaattcattcagtgcacttattttatccttatctccaactaacggccctgatgcgggcattaatggattttctaattttatttttcctatagttgtgtttaaattcatactacatctcccatttcacaatattttaactttcctttatatgatcccataatctttgggctacactctcagcctcttcatatattttttctacattctgtacagtcttataatcctttatttttattactcctttgcaccatacattggaaggtttaaagttatccataattccataaaaataatgtccaaaagtattttcttcattaactggagtaaagctcttataatctacagtaataaaatcggcttcatatcctttttcaattctccccaatctgcatcctaaaatctttcctgcatattcataattagcttctattatttcttttaaattatttaaattaaaaacagttgtatttttatatttaagatgcataccatataataaatttacaatttctctactgaaattaaatcctaaaccatcattcccaagaatacatttaatttttctcttttgaaaatttatcacatctgcaagtccaactgcattgtttaaatttgaagttggatttaaagctatatatatttttttattctccagtatatccttatctttatcatttatataaatacagtgagataaaattgagttttcatttaataaatcatactcattcagtctctcaacaggagttttgttatattttttcatactgttaatattatcttcatcactctcacctacatgaatatgtataggcattttcttaattctatcttttatttttcttaaactatcattatctaatgtaagacatgcgtgcattccaaaaattccacgtgcattactatctttacattttttattaaagtctatattttcttcaatacactgatttaagtcaaatctgtcacttgtctcaaagcaaaatactcccctaattccaccttcatcacatactgacttttttaatacatcaaggcttccttttattatcctgccacttgcatgatggtcaattacagtagttactccatctttaagaaattccatactgcttataagtccactataataaatctcttcttcaccaagtgccctatcaagtttccaccacatgccttcaagaagctctacaaagcttttgggattgcattttgttacccagccccttgcaaaagttgaataaatatggctatgacaatttacaagtccaggcattaaagtttgtccatttaaattgattatttcatcaaatttattggcgttatgatgtttaaaatcttccattgaacctgtttcaaggattttttcattaaaaataatataagagttcttttttaaggtttcataatcaaatatatctacatttattaaagcttttatcaagttcaattctcctttcaatatatgaaccactagatgaattttttaaaaactcattattattcacaatcatatttccttttgcaaaaacagcctttatacttccctttagaacctgtccatcatatattgactctttatcattaactattgttgtattattaggatcaaaaactacaatatctccatcactacctaccataaggcttccttttttaggataaagaccatgaattatagctggattttcagtaaatttaggaattattttttccttgtataaagtgtacatatttaaaaatgaatattttacgccatcaactcccattgcaatatcacttgtatattttttatttttcatatgctctgaaaatggacagtgatctgttcctattatatctattccatcaatattatcctttaattttaacctctcactttctgctctaagtggaggagtcattgtatatctatatccattctcaccttcataaacagatgagttaaacttaaaataatgtggtgcactttcaagtattatgctagaatgaaggctatctttaaaattttctctcactctttctacagttgtaccgcaattagtatgaactatatataaaagtccatttctatatgctgccatttcacaaagttttaacacttcacttatttcagctattgctggtcttgccttttcatgatcttttacaagtatattcttctcttttataagatcattattttcagcatgaactacaactctgcactcatattcctttgaatattttaaaagttcatctattatattgtcttttgtcattcttccagtggattcataagtggtaaaaatttttatagttggcattccaagtgctctgccttttttgaaaagttcttttacatcttctttaaaacttcctaaggtaacatgaaatccataatcaataacgctatcttcagcctgtttctttctcttattaaattcaaagtccagttcagagatattgtttattggatcaagaaaatctatatatgttgtgattcctccaagtgctgcattaattgagcctgtgtgaaaatcctgtgccgatacatttttgcctacaccaagattaaaatgtacatggggatcaataaaacccggcataataatgcagcctttagcatcatacactttactacaatgcattattgacgatgttacagattctattacaccattttttatatagagattgctctttataaatcttccctctaaatatacatatccatttataattcctaaatccatatactcacaccctttacgatgctacttattgcatcttttttataattttctactataattattaatatgatataaataccaaatttaatattatctaagttgcattttaatccgatttataatacccataaaacacaaaaagagccctattcccttatgtgaaatatgactccattgtctttatttaaatcaagtatttctactaaattaattttttattaaactctgataaagcttcattataatcctgtgcagtatctacatcaagaataatacttttatcttctattatttcgtaagctacttttctattttttaaaaattcacgaagattataatcatcactttttacaagaatatcctgcacaatgctactatcagccaagataggatgtcccctttaccataaaagcttggaataataacctctttgttcttattctttacttttatgcttttagttaatatctcttcaataactttcttatttattaaaggataatctcctggtgttaaaaagaatttttcactttccacctgtgatattcccttttttatggaagtaaacatgccttttggatagttatcattatatactgttactaccttttcataatctttaacaagcttttctattttttcatatttaaatcctgtaacaacaataatttttctacagctgtcataaaaaccttcaatgcacctttgcagtattgtttttccttcaatgtcgaattccattttaaatccatgtgctcgtgttgagtatcctccagctaaaattacagcatctacagacatcctactctccctccatactatgtttttccttggatatttttataatttaacaattataccactgctaccaccaacataatccccatccctaataacagcatatccgtttataatcacatattttattccatctgcatactgtgttggttcaacataagttcccttatctattattttatttttatcaaaaatgactatatctgcttttgtgccaggagcaagatgcccctgtcttttattcccattgtcaaagcacttttatatgtcattttaaaaattgcttcttcaagtgacaaagcctttagttctctaacatatcttccaattccccttgcaaatgctccataaacccttggatgtggtttccctccaagaagtccatctgtacagaaattctgttcaggtcttttcataaactttattacaagttcttcagatccataataatcaatcatacctactgcattttcttcttcaatcaataaatctaatgctgcttctactggatctttaccttgaatatctcctatttctttcaaattttttcctataaacttttcatttctttgattttttactgatgttatataaattccatctgttcctgcaaactcaatgaagttatcccatttgcagtttttctcataaatttctttgataattttaggtcttaattcatatgaactaatcctttcaagcatcttctctgttcctccactttgaacccatggtggaataattacacttagcatcgtacttcctgcttcatatggatattgatcaaaagaaattcttattccctttctttttgcatcttcaagaagttcaattatttcctgacttttatcccagttattttttccacatattttgaaatgtgaaaaatgtaccttaacgccactttcacgtcctattcttattatttctttcattgaatcaattatttcattggcctcacttctctgatgaactacaaatatcttgtcatactccgcaacaaccttgcataactctattagttcttcagtattcccataagcacatggtatatatataagtcccgatgaaagtcctattgccccagattttagttcacgccttaaaatatctttcatcttttctaaatcatgccttgaagctataccatctgaaagtcccatggcttccattcttatgtttccatggggtaccaaataagctatattagaaataagctgtctttcttcaattgcttcaaaatattcttttgtagtttcatatttccatgatatcttatcactgtctccatcaagtccacttaaattttttctccagtctttaacatactttaaaggtgtaggagccatggatattccatcttgtccaagaacttctgttgttattccttgaaaaagctttggcattatatttttatcacttaaaatcatcaaatccgaatggctgtgtgtatcgataaagcctggtgaaacaataagtttttcagcatttattacataatccatagaatgtttcttgtcttttaagttcttgtcaatttcaataatttcatcattgtttacaataatatccccattgtatgatggtctttttgtaccatcaactattgttccattctctatcatccatttcatacccttcacccctaatcacaatattaaatgagttcaagtaaagaatccattattacataatatcctttacatgccttttcaagctgttctatttcaatatattcatcaatagtatgtgcaatattttcctttgatggtccaaaacctattgtttttattcctgcttctcctgcataatgacttccatttgtgcaaaatgaataatttgttattttaggcataatacctatagatttaagtttttcataagtattctttacaaagacttcattttggtcataacaccatgctgggaaaaatctttcgccttcaataaaggctccagtatgacatttttcctttcctcttgcatatgaaaccttgtaatcaacattcggtttattctttcttaattcttcaattaattctacaattggttttaatacactttcttttgtttctccaacaagaagtcttctgtcataagttgctttacagtaacttggaactactgatgctcctggatatggtgaagattttatatctgtaagttctaaaataccttttccaagaaattcatcttcctcataaggaatttcctgaagtttgtttattatttcagccatactgtaaaccgcattaatacctttttcaggattagctgaatgagcaggaactccaaaagtttcaactacaacttcagctctacctcgttgtcctatttttaaatttaaatgagaagcttcacctatgacaacataatctggctttacatattcacttatatttcttgatgcaacaccttcaaaacattcttcatgcacaacacctgaaatatatatttctccaggaaagtccttattattatcttttgcaaagtattttgctgcaattatcatggcagaaagtgaccccttcatatcagatgttcctcttccatatattctcccatcttctataactgctccaaatgggtcatgactccacttttctgaatcttcagctggaactgtatcaatatgtgcatcaaataatactttatttccgggtcttttaccctttatttttccgataatgcttccgtacttatcaacaatcacatcatcaaatccgcattccttcatttttttttcaagaaattcaacaagctttccttcatttcctgagtaactctgtatttttataatatcctgacatagctttataagctcttcttttttattattttccatttataactcctccatacttaactttactatataaagttattaactctacatttacaccataagatttatatacatttcactatgaactttacaattacactttagaaatcaaatagttatttctacttcaattgctgacaaaaaatacacacaagaagcatcaaatatcaactatcaactacactatataacaggcattattatattatatgcaacattacttctcattaaaatcatattattcttcaataatggatttataaacatctggatctgtatttccctctgtagatattataagaacatttgatttttcatttaattcaagatatgtttttaatttatcatattcaggatttgtcattatttcatcaaggactcccattccaacagcacctgactctccagaaataatcttaggatcatcttttaatggtttatttaacattttcattcctcttttagtcatttcatcacttacacttaggaaaacatcacaatatctgcttaatatctcataaccaagtggattaggctcaccacatgcaagtccacacataattgtatttaaatctccacctactgctgtacatttattgttaagagctgatttaaagaaacatgctgcattagaaggttcaactaggattattttaggaggattttttatatattcttctgtaaatacacttgccataacccctgcaaatgctcctactcctgcctgaagaaatatatgagttggaatattctctttaagctcctttataacttcttttgcaagagttgaataccccttcattatccattttggaatatcttcatacccttcccaggctgtatcctgtattattgtccaaccgtttttcttggcaagttcatttacaagtcttactgtttcatcatagttatattctgttatttctccatatgcacctaaatctgttatatttttaagacgattttctgtacttccctttggcatataaatcctgcatggtacttcaagctgtttcgctgtccatgcgactccacgtccatgatttccatctgttgttgaaacaagagtaatatcctttaattcttttttccactgaccagatttaagatattcaaatgttatttctgacatatctttattaatcattttgcctatatacttgcctattgcaaaagatgcaccaagaaccttaaatgcatttaatccaaaccttgttgattcatcttttataaaaacatttttaattcctactttttttgagtagtttttaagtatatgaagtgatgtttcagaatattcactaaaacttttatgataatttatcgcttgatcatcaatatacaatccataaaatttttccttctcaatttcttttttattctttaaattatcatttttcttccagattattgacttattcatttaccaatacctccaatacatatgtctatttaataatagaaaaagtcttactctattatgaatagaataagacctcgttgtctttttaattatgctaaaatattttaatataagtataatcttgtaaatttatacagtcaatagaaattgatcatttaatctaaattttattaaatttccctgccacaacaatatcttgctatgatattctcacatgttccaagatatattaatttttcaattctctcttcaagtgtgccattgtaatatttccatagatttttatcatcaattatcaatgcatcaaattcatatccttcttcaaagcttcctaccttcccaaagaattttccaccaccttttgttgcaagataaaatgcctctgaacttctcaaccctctgcttccatcattataatcaattgcccttattttagataattttattgtatctgctattgtagaaaacatacttatcttttctcctcctgcaaggtctgttccaagaccaatattataatcatccatcatcagtttatttatagcgcaaactccgcttgaaatatttatattagaatttggacaatgtgctatgaaaatattatttttcttcattcttgaaagttcatcttttgttaagtgaacacaatgtgccataacagtggtagtttgtcccaaaagattatgatcatcataaacatgtccataactttctgactctggataaagttccttaacccattttatttcagatatattttcacttaaatgtgactgtactggtaaattatcttttaatgccatttttcctaaagacatcataagttcactactacagcttggtacaaatcttggtgtaattataggctttacataatcatatttatctttatactcatctatccactcctcagtttcttttattgattcttttgttgtttcaacaagataatctggagaattaatgtccatatttacttttcctacatatgcacaaagttttcttttgcttagtaaatccattaaaacccctgttgattttctatgtattgtagaaaaaatcacagaacgcattgttccattattgtacaagtcgcaagcaaaatccttatacactttctctgcatacaatacatcactaaactttgcttcttccttaaaagtataattattgagccattgtaaaagtgtcttatcatatccaagtccacaaagtgaatactggggagcatgtacatgtaaatctacaaatcccggaattattaatttatcaccataatcagttacttttaaagttttatactcttctggaagtttatcaaatattcctatgacataattatcatttactacaatatatgaattttttaaagtggtaaatgtttcgctttcttttgtaaaaattatatttcctttaattattaatatgttcttttctttacctgtcataaacatcaatcctttttatataaaattaaagaagttatatgcatatataatatattaaatataacttctttgttaattaattctattttattttattgaatcatcataatttatgatgaaaattggctattataaagatcataataaaatccgtgttttttaattaattctttatgatttccctgttctactatttttcctttattcataactaatattttatcagcacttactattgttgaaagcctgtgggcaataacaaagctagttcttccactcatcagtgttaaaaatgccttttgaattctcatttctgtaagtgtatcaatagaacttgttgcttcatccaaaataagaattcttggttcagcaagcattactcgtgctatagtaagaagctgtctttgacctgctgatagattttcttcattaatcactgtatcatatccatctttaagtctttttataaatgaatgtgcatgtgcctttttagctgccttaattatatcttcttttgatgcatctgaatttccataagaaatattatcacttattgtactattaaaaagccatggatcttgaagaaccattccaaagttctttctaaggctatctcttgttacatcgcatacattattgtcatcaatatatattgcacccttgtctatatcataaaatctcattaataaatttacaagtgttgtttttccacatcctgtaggtcctactattgctattgtttcccccggttttgcttcaaaagagaaatcttctattaaaggaatactcttatcataagaaaaatacatattagttatttttatatttcccttgcaattttcaagttctattgcattttccttatcaggacattcacctgtttcatctattatgttgaaaatacgtgttaatgatgcaaacgctgtctgtatctgtgctgtaattcctgatatttcattaaatggttttgcaaactgagcagaatatattaaaaagcttgaaattattcctacagaaacacctttagttatagctaaaatacctccaactagtccaacagctatataagaaatattattgataaatcttgtacttggatttatcagtgctgatgcaaacatagcatgagtggcagttttgcatagattatctgaaattttttcaaactgtttcattgacattctttctctatcaaaagcttttactatcttttgatttccaactatttcagatacaaatgatgacagctccccaacagactgctgttgttttacaaatgaggtctgactaaatctgcttatcattgatgcaataatgaatcctactggtgttacaacaagtattcctattgtaatctctacatttaagtaaaacatacaaaaaagtgctgtaacaactgtcactatccctgaaaatacatttgtaattgatactgctaaagcatcacttacactatctaaatcatttgtaaatctgcttattatatctccatgcttatgatgatcataataagataatggctgcttgtttaagctttcaaaagtatctcttctcatatccattacgattatatacgctaccttatttgcatatcttgaaataaaccattgaaataaggatgaaattatatatataaatccaagacctattaatatacggtataaattattaaaattaactctatttattccctgcatattatcaattgcaactccgtttagataagttgccacaacaactgcaatattactcataaatgcacagacaatagccagaataacttgaaatttatatggtttcacataagttaatgctctcttaaaattattcataaattttcctcctctatctagtctgtgattcatatatttctctatatgtattgcagctatctaataattcttcatgagttccaagtcccatacaaattccatcgtctaaaactaatatcttatctgcagatatgattgaacttatcctttgagaaattattattgatgttgtgtcttttaaattatctcttaaggatttgcgaagttttttatctgtttcataatctaatgcacttaaactatcatccaaaataataatcggtggtttttttattaatgctcgagctattgcaagacgctgtctttgtccaccagaaaaattcttgccaccttcataaataacagaatttattccatatttcattcggcttacaaattcataagcttcagcatttttcaaagcatctattatttcttcatcacttgcatcttcttttccccatttaatattatctgctatagttcccgtgaacaaaactgatttttgaggaactactcctattaatttgtgaagaaaactttgagaaaattcttttacatcttttccaaaacaaagaactgaacctactgtactttcataaaatcttggtattaaattagcaacagtagactttccacttccagttgttccaattattccaaatacttctcccttgtttactacaaacgacaagtttgataaaacatcttctgagttatacttaaatgatacattatcaaattttattatttcttcattttctaataattcttcctcaaaaacatctttaataccttcttcgtcgtttatacttggagtccaactaagaacttcatttattctagatgctgatgcagaagctttagtaaatgtaaccaataagtttgcaactactataagtgctagtaaaacctgagtaatataatttattaaaattacaatgtctccctgagtaagtgttccaatctgtacattaattcccccaaaataaagtaacagtataactcccatattcattataagtgaagttaatggattcattaatgcagataaattagtcacctttatatatgcctttgatacatcttctgttgattcttttattcttcgactttcattttcatgattggcaaaagctcgtattactctaactccgcttaaattctctcttaatatatttccaaggaagtccattttcccttgagctgctttatataaaggtactgtcattttcataattacagctattactaaaataaaaattggaattaaaaatacaaatattaaagacatttttgcatctatgtatactgacattatcaaagcaccaatacataaaaaaggagccctgcttacaagtctaataagcattgcaacagctaatacaaccatattaacatcatttgtcattctattaattaatgttgaattaccaaaactgtctatatcagaatatgaaaataatgatattttatttaataagttttttcttatatcattcccaacattctgacaagtataagatgcataatactgacacaatgatgcagatgctaatccaacacttattgttaaaaacattaaaatagtcatctttacaacataaggtatgtccttatttataataccaatatcaattattttacccataaaaatcggtaatagtaactctaggactgcttcaaatagtttagcccctgaccctattaccgtttctttcatatatggctttaaaaatcttctgagtctatacaacattcatccccccattgtatattttctttaattatacattaataggaataaatgttctagactctatttcttaagaaaagatgaagtttgttaatcataatactcttatataaatattaagaatatacaactaaaaattaaagcaaataatttatttaaacttttaatcataatcttctaaatatcttttaatttattttttataaaatctatgtcatcctctatgatttccatattatttctacattgctttccatattcaataacaagatcggcttctggtgtatattccttatacatttcaaaaaattcttccatgttaagttttccatttcttattgaatcatgacagtcatgaaatccatcattattgtgaagatgatatgatacaattttatcctttaacctgaatataacatttttcaaatcccaattattagcaaatgcatgtccaacatcaataaggatattgtttggaatactttcagccatcttaataaattcttcttcatctaaaagcatattgttatgagaaattactccacaattttctacaacaatatttccattatattcgcgtgatatattatttaactccaataaattttcacttgaaacttctatcattttaattctttcttcctttaaaatttcacagttgttatgatgatatacaatatatgaactgtttaattcttttgaaagctttaaagtttctatgaaatacttttttgctttcatatattcacttgaagttttttctgcactatgttccgtatcatagtatggaccatgaagtgatatattatattccttaaacttttctatattttcttgtaacacatcaatgaatacatcactctgccattctggaaaaatttcaataccaatatcattgtgcttcatattattaagtagtttaaaaatatccattaaattttctggactgtacatatttgtgctaatatatatattcataatcctcaccttttcaatttaatttgttattcatttgctgctttatcaagtacctgaaattcaggatatccaagagaatttgttgtttctctatcaaatagatgtatccttttaaaatctggtgcaaaataaactgtgtcgcctggtttaaaatgattttcatctaaaactgcaataatttcatttccatcaacatcaaagtaaacacctgctttattgccgtaatcttcaatgtactttacacatcccttaaatgaattcttcttttgaatcttattaagctttatgtgttcaggtcttattccaagagacaattctcttgtaccactatactgcacaatatctgaccattcttttgtaagttcaatagtttgatctcctaatgttatgcatccatttgaataatacacatcaaatatattggtagatggagaaccaataaatttagctgtaaatatattacttggtctgttatatacattataaggtgtatcaatcatctgaagctttcctttattcataagtgcaattctgtcaccaactgtcattgcttctacctgatcatgtgttacatatatcatagtctgcttaaatgtttcatgaatctttacaagttcttttcttgcgtgacctctaagctgtgcatcaagatttgaaagtggctcatccaaaaggaaaaaatctccccttttaaccacagctcttgcaagagcaactctctgtctctgtccaccagaaagatcctttggctttctatcttcaagtccattaagctgaagcatttctactgcactatttaatctttcttcaatttcttcttttggaagcttgtgtactctaagtccatatgttatattttctgcaactgtcatatgtggaaaaagggcatagttttgaaataccattcctatatttctgtcaccgctctttacatcatttacacattttccacccatatacatcttcccagaagttatatcttcaagacctgcaatcattcttaaaattgttgattttccgcatcctgatggaccaagtattataagcctttccccttcttttattgttaaattcaaattatctactaccgtattctttccataagatttagttaggttttcaaatataatctctttcatatctatctcctatccctttattcctgatgatgtataagtgtttataatatatttctggaatattatatataaaattaaaggaattatcattgttataactgatacagccatagctaccgtaaagtctgtacctccttcagaacttataaaaagctgaagtgcaagtggaagtgtaaagttttccttagactttaatataagtactggccatacatattcattccatgaattaatgaaaaacattattcctgtagaaattatagctggctttaccataggtattactatatctctcatacgtttaaggtgtcctaccttttcaatttctgcaacttccataagagacttaggtattgttttcattgattgtcttaataaaaatattcctgttgcatcactaagctgtggtagtattacacccataagggtatcattaattccaaggcttgatactgtaagataattaggtatcatagtaactgtaaatggtatgaatatagtacttatcaatacaaaatacaatatgttcttatacttgaaatcaaaatatacaaaagcatatgccgcaagtactgatgtaagtactttaaatactgttactgtagctgcaataaaaaatgtatttcctgttatttttgcaaaaggcagccttttaaagacttgaaggtagttttcaaaagtaggattatcaggaattattccaaatacattgctgtatgcttcgtttaattctttaaaagagcttgaaactgcaaatattattggaaaaagagtaattactacaaatgcaactaataaaacatgccatttaaactctgaatccatcttaattttcataatatactcctttttctacatatttaaattctaatataagaagccctataaacaatatcatagttattattgcaaatgctgatgcagttcctgttctataaaggacgaatgcctcctggtatgcattatatatagcatttgaacttgcattgtcaggcccaccttgagttattacctttataggagtaaatacatattgaagtccttgaactatagtcattatgaatacataaattcccgttgcactgctcataggaactacaatatcaaagaagattttatacataggaacattatccatttttgctgcttcaatcacttcacttgatactcctgatacacctgcaagaactactataaagttatatccaaatattttccatgatgttataagactaagaactacaattacaagaccttcagttttactccaaataggaagtgttaatccaaaaaacttagcaataattgcagctggacctgaaataggatttaaaatccacaaatataaaattgatcctacaactaatgaaataacgcttgggagaaaaattacgcttttataaaatcccttccctttcttaataactgctgataatataaatgaaagtatatatggcgctacgaaattgagtactagaagtattattatatacataagggtatttccaaaaactttatatgttaatgagtctgtaaatatggaaatataattctcaagtcctacaaatgtttttgttggctttaccatattccatgaaaagaaactcaagtaaatcgttcttataagtggccagaacataaatacggcaaacactataatagatggcaatataaaaagatgaggcagtattttttctctgccaattttaaaattgcttttgttcttcttcatcaaaatttctccttattttaagctataattgcttagcttaataggcagaatcaagttctgcctacagcttattttcatatgtttcattaatgaacttttaatttattttaataaattattaatttcatcttgagctgaaatcaaaccatctcttgctgaaactttaccgcctaaaatcttatctcttgtatcaagcaatacctgttcagcttgaagacctgcatctcctgggaatgatgtccatgaaacaactccatccatctgagtagttgcagctgccatcattttattttcttcaaggaaactttttaatccattttccgcttctgctacatcttttcttggtggaacataacctgtgccttttgtccactctgccatagattcaacactatataagtatttttcaaattcccatgctgcttttttctgttcttcatctttagcagttattgcaagaaaacagcctcctgctggaagtcttttttctttaccttcccatgatggagaatttattgcagccacatcaaaagatgcacctttttgaacatttgctctttgcgctatagttgtgtaaagcatagcaacattaccatcaatgaaagactgtactccttcattccatgagatatgaagtgctgactttgtatttacaaccatatctgcataagtttcataagcttttattccttcttctgaagcaaaagtagctttaccgtcagtaatcattctcgcaccgttactttcaagtatcgcttgagttgcccagttatcagctggttcctgaatataaagaccatatttccctgtcttttcttttattgtatctgagaacttcttgacatcttcccatgtttttggtccattttcatcaagacctgattcttttaatatatctttgtttatatatagtactggcgtacttaaagaatatggtattccaacttgaattccgtcactattttttgcaagctctaaaacattgggaagaaagttatcattaaggaatgtcttatcctctggaaaatgtttgcttattacatcttcaggagttgtgtattcaaagttgtttgagaaataatctaaaaatgcccatccaacttgtacaattgctggagaatttcctgctgctgcttcagcctgcaaattctgaagaagtcccttatacatatctggattaaactttgctacaacttctactgtatcactttgtgcattaaaatcacttacaagcttttctactgccactccaccttgagtttctgcattaggatgccaatattcaatcttaaccttttcccctttagaagttacatttttttctgcgcttttacatcccccaagacaaagagttacaagtactgctgttgaaataacttttaaaaatctttttttcatttatatttccccctagaaataatttagtttttaattttattttcacattcttgttaaacttaatattctataagctctggattattgtatacatactctaacttctatttatattttcttattaattctattaccccattttcatattcacctttagtcacaacatcagctatcccctttagtccgtctactgcattaaaaactgctgctccaacatgtccttcttctaaaagttctttatcattcatatgatttcctattgttgcaacttcgttatcctttaactttaaatattctttaagtttcttaagtgcatttccttttgatacattgttttttacaatttcaaaataatcatcttcagatattacatatctgaattcatctcttaaggaactgtctaaatcattaaatatctttttaaaaatttcaacattacctattataagaatcttgcttataacaagctcttgcttcaataaatctttccctgcttcgttacatgttgcaatttcctttttttcgtaggctgaaattctttcattatgcttcaggcagaatacttgtccatcataatagaaaattactgaccctcccattttttgaacttcttctaaaaaaggtatccatatgttcaatgaaaaatcctctgaataaatttccttaccatctgagttaacaattttggcaccattatacgcaatatatggagcattgattccaacagtttttgccacatctaaacttgtttctataggtcttcctgtagcaattgtaaaaatattacccctttcttgaaactcttttatttcctttataagttcttttgaaactgtataaccttttttatcactattaaacaaggttccatctaaatctgatactatcattttaatactcatgtctaactccttaatgtaaattgaaatataatgtaactaaattcctatcctccttcattattttataaaaatatgttcttaaaccattaatggttttcacacttctccaccactaatcttttaatgttttcatatttttattattttgctatctatataaacttctttgttctttccaattatttaaatcatagttccaaagattatctttactaaaagataccccatctgcacctgcatttaatccactaattatctgtgcttcattatcaataagtccccctaaaattactggcttattaatttcttttttaattacttccacaatggaacttgcaagagctggcataacttctattacatcaggatcattttcctttatactttcaatagcatttcttaatgatttagaatcaataagaaaaattctttgaactgtaaggagttctcgcttttttgctgctttaatcattgagccctttgtagaaacaattcctgctggatttacatatttctttataaaatctactgcttccttatcgtttgataatccttttaataaatctgtatgtataaatataggtttttcattttttagaacctgaaactcattttccataagactattcaattttccttccattaaaaacacagctgaaacttttgacttaactgccctttgtaaactatcatgctgagctgctgcaattaatggattattttttaaaatctctttaatattcaaatctacccatcctttagatttactttatattttaataataaatataaaatgttaaatgtatccttaaaattaataaagatgagttaaataaaagtaaagtagttgttaatttatatacaaaacaagcatcagattatatttcactataatttgatgcttgaaaattttttatttatgttaataatatatattttttaactactgagtttcataatcttaaatcttcctatttaatattataaatatcaccaacttatattaatgtttgtactattttccaataaatgttataatttatttaattttatgagcactaagaaattttaggagatgagaatcaatggatattctaactacttatgttaacaatactttttctgccatacctgagacagaagaaataaaaaagctaaaatctgaaatattaaatagaattgaaaaaagatataatatattgaaaagtgaaggaaaaagcgaaaatgaaataacaggaattatcgtatctgaatttagtaatataagcgaacttattaatgaaaaacttaatattcatagctctgctgaaaatactgatatcatctctgatgatgattcaataaatttttataaaaacaatagattattaaaagcaatagttagtgcttattggccttctgttgtattactgtacttatttgtaagttttacttttggaaattggtatgtttcatggcttatttttattcttgctgttgtattaaaaaatttcttctgtacttattttaacattgaaactaaatagtataagaaccttattgggaattttttttattaatttcttaataaatatattttgttttctactgctataatctcaataaaaaggattctatttctagaatcctttaatctactatttatactattaatactcaaccttattccatatataagctacatctttatatccttcatcaaccttatcatataatttatctatttcatctatcataggtttttgaattttgttaagttttacatataatgaatctaattgttcgtagtatggagcaagctttttatgtgtatctattaatttgtccttttcactgttagtcaagattggtaatgacttgatatactctatcatatcaatattatatgaattttcatccatgttctctataagcttagtctgctcatatttataaaccttttccattatttcatcattttcactttgactttcataaattttattatttaattcatcaatttggttttctatatttttccctgccttattagcatcatcaattaatgaatctatttgtttatatattggttgtacaattttttctgcctctatcaatttctgcttttcttcattattaataccttttaaagatagtatatacgcctttaattcactatccaaagtatagctttcttgtgtttgctctattgtattttctttaacattatttgtattacctgttgctgcaaatacagttgttgatattgaactagttatcatacctgcaaccactaacatttttaataaattctttttcataaataaaacatctcctttatttctttcttatacttaataagacgatttattcactataaaaagttttaaaaaatttaaaaaataataaaaagacacgtactaactcgtaggtgtctaatttactatttttcttattatacaattataaatcatttcaaaaatattcttttagtgttccttgaaaagaccggcaccttttataatttcctgttcagaaaaaagactataaacgccttctttatattcctcaatattttttcctcttcttatatttttaagatattcttttccatttgaaaatatataaatcatatatgaccataattctttcatcttgaataatgcacctatatcttctggatataaatctatatatgcatttagaatttcatcatgaaaagctttcatcttttctttagaaatcatgtcatttcctataatctcgtttattaatccaggatttgcaagtatacctcgtccaatcattatcctatctacttctggaaataaatttgtaaactttgtataattatcatttgtaaaaatatctccattataacaaacaggattgttacttaaagaaagtgcatccttaaaaacttcccaatcaggcttatttccataaaaatctttctgagttcttggatgtattataagttcttctaaaggatatttattatatatttttataaggtcgtaaaactcatctctactatcctttcctatcctagtttttattgaaattttaatattattcttttcaaatatttcatatagaaatttgtccaattcttctcttttagctaaaaaacctgatcctctgccttttccaacaactgttccagatggacaccctaaattcaaatttatttcagaatatccaagttcctgaagttttttagaagtaagtataaaaccttcagaatcatttgttaatatttgagggactatgcttatccccttattgttttctggcaaaacatcaataagttcttttgtatttagccttttactttcatttggaattatgaatggtgtaaaatatttatctatattatgaaaaaacttctcatacgcatttcgatatatatgacctgttatgccttccattggtgcaaaataatatttcatcgtgtaactccttcataaactaattatagtaataatcaaactacttttcttatactagcttattataatttaaatttcttaaaatattataacaatgttatcttcacttatctactttactttaaaggaaaacttattctatgcaaaatttatacatacatataggaaaataaaccctaaagataggttaaatcttcaaggtttattttttcttcataaattctttctatttttactaatttttttagaattaaagttctctatatttttctataaattcatctatacattttgattgtttccatatatctacagtacttggatcaagtaaatacattatagttccgttagaagattcaatatattccccatcttcagaccctagtgcatttcttgtaatgttaacacctctttttttataatacttttctgtttctctatataattcctctcttttctctatataatctctaacctcattattcaaaaaattataagcatcaacagttgtctcaccctctataaatgtttctttaattgctattttttcatcccataaatgaattttattccagtcaaaatatatttcaccatcatccggaataaatgaaaatcttgaaataatatatacataattattatactttatctcataataatcaggtaaatctttaaatttcataaaataatctacatagtcattttctaaaatttctttttttacaaatggaatactttcaataaatttaaatatagattcttctgtttcaaaaatacctacatcataaattttttcatattgtttgatttttaatatgtacacactagcacctcctcaatattttttattttactaaagaaatattaagaattcttctatacaaagcttaagatattataatcttaataaaatattatattataccagatctccctttgaaccaattatttgttatattgtgaattttttcttaaacatatttttctatataaaaattattgatatatttataatattagctatttttatagtaatactataattaaaatgaaaaggaggattcttatgaatggaaaaataatattaaatctagcaataagtttagatggatatatagctgataaaaatggtggatttgattggattgttggagatggccattccacattaaatacagaaaataaatgggattatgataaattcctagaaaacattgacgttgtagttatgggtaggaattgttatgatcaaaatttccataatgattataaaaataaagatgtgtacatcacaacatctaaaaatatagctgactatgaaaattatcattttataagtggaaacatatgcaaaactataaatgatttaaaaaatgaaggaaaaaatatattcctatttggtggcggtcgtatgattgatgattttataaaagctgatattattgatgagtatattatcggaataatacctacgattttaggaagtggaagaaaattatttttagaaaacaaccctaaaatagacttaaatcttcagtattattcagttgaaaacggtattgttgttatgaaatattccaagcgaaataagtaaatagtaattgtttgttaacaaggatcttacttattgtattgaatattttaagaactacttagtatagatttttaaatctgtattctcttattctttgaaaattattgttcaaaatgtaaatttattatctatattatttcttttgataattagcatttaatgattactttcataaaatgctaattataaacttttataataattccgtataattttagagctattcttagttttttaattttctaagatagctacaatgatccaaagatgtctaaacgatcaatattttcatataaccataatgtcatacttttatttatatttttcagttcctcaaatttatcaaattgactaaaatatgcataacatataatttggtttgataatactacataatataataaactttttatttattttccaacagtttgttgctctttcctcatttgaataatatatatcttcgattgaaataggttcatctatatcccaattttttaaaacctcttttaacttcttatgtgttatcataatatactcctcctgcctaagatttattttgaatggttttttaggtttatggagattaaaatactttgttggtgagcaaccaaattcttttttaaaagctttgtaaaatcccgaatgtgtttcataaccataatctgcttctactataaacattggtcttcccatttccatttcataaattgcatgaagcagttttcttttttggatatattgcataacaggcaatcccgtcatactttgaaaaacacgataataataaaatacagaaaaagctgctctttttgccaatacttctgcatttaactcattctttaaatttgcttcaatataatcaatgctcttttgaataatatctatattttccatttaaatctccttgtatcttagctggctataatactaaacatatgataacatattgaaatgcttttaatatttccaattttgctttctttaaaaattaaactctcttcctttattattatttaatgaactacttaacataaattaaaatctacatttattttgtgtaaaaattaatactatagttatacctatatttttatattctcagtaataattaatgctgcaagactttacaaatcaattgctactttatattcaccatctattaaaatgtaattacaatcattatttacccccttaatacaaactaagatttatctagtatgtgaactcttactatatctcataaaaaatagtaaatctattaaacttttatgataaggtataaaaatttcctcatcaatcatatataatatttcttcctttttaaaatacatttaataatctattaactaaatttttatattttataattgacaatggcctttcccagtaatatactacctatattgtaattatatagcagaaagaggttttatatgaagatattagcatttaacggaagccctaggggcaaacaaggtaatacagaagttttaataaaattgttcctcgaaggatgtagacaagctggtgcagaaactgaaactatatatttgaaagacaaaaatattcacagctgttcaggatgcttcacatgctggacaaaaacacctggtagttgtattcataaagatgatatgaaagatttattagataaattattagaagcagatatcattgtttacggtactcctctttactatttcacttatactggaattatgaaaaactttatagacagacaacttcctcttgttgacagaaaaattgtttgctctgatcatggctacactcataatgctagacatccacaacatataaaaactataaaaaatgtattaatatcaaactgcggtttcccagggaaaaatcatttttcaggccttttagaaacatttaaagtgtggcataaagatagtattgccggagctatattagtaagtcaaggggagtgctaagttcaatagatcatgatgaatatttaacaaaattatatacaccattaatccaatcattaactaatgctggtaaagaagttgttactttaggacatataaattctgaaactcaaaagctattagatacagaatacatgcctgatgaagtttatgctgaaaatgcaaacgtaagctgggataactaacattatctaaactaatttccgtaaatttatcataagcaaatattaaatacttatgaataactctatgcaattaagaaaaagaaaggaactaattatgtatggaaaaaccaataaagccagataaaaaatactctataataaaaaacatatttaataaagactttataataagtgctataattccacttcttatatatggagttgcaacaaaatgttctacagaactcattggcttgatattatctggaatctggtgtattgctgttgttatcgtaaattatttcatgtctaagactattaattttcttgcaacaattggtgcagtatttaatggaattggcttaattggaacaataatttctaaaagcccaacattttatctagctacaccaatagttgaggatttcttattcgcttttatccttattatgtccatatttctatctcatcctattattcaagttgttgcagaacaaagttttttgaataatgttccaaaaaatatcaaagataatgcaaaatacaaatctagctggaacattataactgcagcatgggccgcaataaatattctacaggcaactgtgagaattattattctaaattatttttccataaaagtatattacacacttagtaatatttattccggtatatctatgcctctctttatcgcagcaagcattatttttagtaaatggtatctaacacattaaatttaaggatctgttagatataattattgatttatagtaataataataggtagttaaatttaaactacctattgcttgtctatttaataactttatatatataaatccatcaatatttcatcataataatcaccattaatgttaaagaaatttttatgaacgcctacttctacaaatccatgccttttataaagtttaatggcattatgattatcctctttaacaccaagactaatattctttatagatttattatcttttgcaaattttattaactgctctataacaaaactaccaactctgtttccccaatattcttttattactgaaattgccagttcactattatgacttattctttgtctgttttcactacttatttgagaaacactcacaattctattatcaattacacctaacaacataagagagtttttatctttattaatattttcgatatatgctttctcttgttcaattgtaagtttaaactcaccttctccaaaaagtaaattattgctttctccaccaacaatatttaaatattcaataatatcgttagcatcgtctactgttgcctctctaaagattaattgcgatccattcttcaattcaactttatcaataatattgtcaatatgttctatgctcataaactcaacccctttgaaagttattataactataacaccagcataaatatataatattatatacaattttaggaatattaacaaccttttgttatataaacaagtgttcttttagtcaaataaagcttcccacttatctgaattattggatgcaaaacacatttttatttgttcaacagtatttttttctaacgctaaatctgggagattatccatagaaaaatattcagactctatagtttctatatttgtttcaaatttcccgccattattttcgcaaagtataaatactttacatattccataagcataaacaggataattatgtttatttctatcctgtgcagcaattatttttttaggaataacgtttaaccctgcttcttccttaacttcttttataatattactatatatagattgatttacatctacccagccacctggtaatgaccattttccatctaactcttttactaataaaattttatcattattaaaaatagcagctcttgtatctattttaggagtttgaaagcctgtttcattacagaaaatatcatttattttctcaacaccataatctgtatagttacttaatatttcagcagatatttctcttattctttgaaatctttctatatcaaaattgtcctttgaatacgtcaaaccaacttgacctataaactgaagttccatagcccactttaaccaatctgaaagattctttttatttctctttgagaataaaatggtaaatatatcagtaggctcttttaaatagtatgtagcttgtatatgcttattagtatgaactccccagccagctaatgcaaaatcaattttagataatcttgcacaattcatatcatattcagtatcacctatataaagaatctcatgtttttcaactcttgataattccatatatttaataagaggatcaggaaatggcttatgtttttcagtatcatctgcacaaactacaatatcaaaataattattaatttcaagcttataaaaatcttgaatgaattcatcttttgttttagatgtaacaatacctagtttataaccagacgatgtaagtgcttttaaaacatcatctatacctgagaaaatgtttattttatcactgaattcattcatgttttcattccaaagttctaacgttgcagaaatattgtcaatacctaattttcccagagcattttccccgggtatccctaaagcaaaagttaatttagaaatttctatcttcttatttaatgttacttctaaagttttttgcaacgaatgtaaaatagcatactcagtatctattaaagttccgtctatatcaaaaacaatatgtttatatgtcataatctcacccatccctataatttctaaaattgtattataatcttaaacataattatagtttagttttgtttactaatatatactatttctgcttaataatataattatcctgccaaattttacggtattctaatggtttacatcctacatgttcattaaatactttcccaaaatagctactacttccaaacccacatgcatagcttatattaataatactttctttagtatttgttaacataaaacatgctttttctatacgaaaatttttcaagtattgtactggagttatattcaagtacttattaaatattctaaaacattctcgttcacttataaaggctgcattagcaatttgagcaatagaaattttttgtgagtattgttcatgaatataaatcatcattatttttaatttatcatttatatcacaattattcccccttttatttaataacttatctgtaagctttaaggtttgacaccatatatcacaaataactgaacgaagttttaattcatatccataatcatcactagaaaatttaaaagaatcgtaaagtttatttaaaattgacacatgttcctgtacatcaggaaatagcggtaatatttcaacatgagttgcagtaataaatggagtaatatatttcttctctattcggctaccttcctgtccacttaaaaaattagtatcaaaaatatgtaaaaattgaatattgttctctattccactttgtggcctagtcatgtgaagaacattagaatttacaattcctccagatcctttaggaaaaactatttttccttgtggcgtataatattctaatactccactttctatataaaacatttctatctctttatgccaatgccaaggaacaaaccggcctatatatttatcgatttctgcatatgaagctatatatggaaaatcaggttctatattaggtaatagctcttgcctgcttccatttcgaaattctatacaatttacttttttcataaattcacctattttctatagttattaatatcctatttaatagaacaacccttttttatatgccaaactattagatttttctcctttatttttctatatttatttactaatattataaattcattattataattgtaacataaattttttccaataaactctaccaaattaaccatgtgaaacttctaatctattttttattaatttattgttatattttattaatactgaataaaagtccatatctaaacaaaaaatataactgaaatttaagcctaaaaatcatagtaagttaaattaaatgaaataataaaaatatcctctaaataagaagggagacagtaatctatatttatgaagaatcaatatgttcaaggaaaacctttgtttacttatataaataaaaataaaatacaatatccttacttgaccaaaaatcttgaaacggatgtttgcataattggtggaggagttactggagctatagcatcatattatttcagtaaaaataatattaaaactgtagtattagaaaaaaaaagaatagcacatctaagtacaagtgtaactacatctcttttacaatatgaattagatgataatttatcagagctcacagaatatacaactattgaaaatgcattaaaatcttataatttaggacttaaggctcttaatgaaatagaagattttataaatttacacgaaaacaaatgtgattatagaaagagagatactctactatacacgtcaaaaaaagatgaggttaatagcataaaaatagaatataatcttagaaaagaaaatggattcgatgttgaatatatagatgaaaataacaatacctatggatgtgatataaaggcgggtataatatcaaaaaatggaggagcagaattagatccgtataaatatacccatcaattactaaaggtagctttaaacaatggtgcgagtgtatatgaaaatacagaagttatagatttaattcataatgataactacatagatgttataacagaatatggttacactgtaaaagcaaaaaaagtaatagttgcaacaggttataataccaagttattttccaatagaaacttcgcaactaaaacaactacatttaacatagtaacaaaatctctttctaatttggaaagctggaatgatagaatacttatacgggataactgtaatccctaccattatctaagaactactgtagataataggattattattggtggtgaagatgttgattttataccagacatatttaatgaaaaattagctaatgagaaatacgatttattagaaagtaagttaaaatcaatgtttaaggatattaaaaatatagaaatagaattcaaatactgtggagcttttgcatcaacgcctgataatttagggtttgttggtcctgataaaaatcacaataatctatggtatttattaggatatggtgcaaatggaattttatttgcaatattaggtgctataatgttatcacagttatatagcggtaaagaaaataaagatatgaaattatttaaggtagacagatttgataattaataaaacacattttaattaaataaaatattaatattagataaggagatatatttaatgaatcaaaatgcagagttattaaattttatttatcaaaattctcaaatgggcatagaagcacttgaaaaactagtatccataactatggatagagagttcaatacatgtttacaatctcagctaaatgagtataaacttataaatgagaaatccaaagaaatattaaataaaaatggctatgatgaaaaaggaataggtactttgacaaaacttcaaagttatataatgattaatattcaaacattgatgaataagacaccctctcatatctctgaaatgcttattactggttctactatgggagttatagatgccataaaaaatactaaaaaatataaagatgcagatccaaatattttaaaattaatggatgatttaaagatatttgaagaaagaaacataaatcaactaaaatctttcttgtaagaaatagctagcctaaaaataggttagctatttagtttttcaatatatttacttttatcgtcgattaccatctttatcaaaattcttctttaatgctttttctactggcaatatagacccaagtaatactatagattgaacaatgagtataaaagtcagtatataactagcatttgaattgaataataattgtattagaatagaaattaataacataatccatcctattttccaccaaagcttaccacagtattcatgtgcaaaattccatgtgtcttgattctttttagacatagacgttctataaccgtatgtcccatttattgttttaggcggataatccgaaaaaatttttccaaatataatcattaaaactggaataaacaaattgctgataaacataaatacacctcctaagttaaatttcattttagttaagtatatgatattatctcaatatttccatttcaaatccatattcacgcaatacaaaatcatcaaatttttcttcataaattccatcaacttgcttaaaaccattttttaaatataagtttatagctggtttatttacatctacaacgaataatctcaaatacttaacattttgtgcttttgcaagttctatagcattttttattattattccacctattccttgcctcaagtaattcacgttaactcctaaacggtctatataaagcgctttctcttttgcattttcccatttcacatgattttcaccatcgtttgatttagataaagcaaatgcagctactatatcatccccttcatttaacacataaagacttttattttcaatgtcatttttgaaaaattcacaaggatatatttcatcccaaatatctatgttatttttattcatattctcaattatttctttatatgttgctttaagattgtttaaatcatttttttttgccaatttcagtttcatattaattcacctcaatttaataaaattatcccagtaaaattactattattgatgtaattgaaccaattacaattatgttctcaagattctctcctaacaaccattttataccacattacttattacattatatcatatgatgattcatacaaccttttacgaaccttaacaatattaatatatatttttcatcaaataacgcttatgttgttcaaaatatatcttctaagaatagtgtttatatacttctttttgatcaaaatcagcttcaactacaagctatacgattagaaccaaaatctgaaaaatataatctattaccacttaaacccaactatagaattgtaattgttggtaatggcgaagtctttattgattaaatgatactttctagtgtcatttaatttaatatgatttttcacagatataaaataaaataccgcaaactcactttatgaataatacggtatttctataaactaatatattactatcctataataaatagagataaattattaacacatctataaatattatacatgtagcaaaaatactatagaaaaaagttaactttatataatcaaaaatttcattaaaatatttactcaacagatacaaccttttcctcaatagtatcatttttatcctttggctttctagtcactctatatcttctcataaataaagttaaaaatatagcaataatagttataactccagttacagaaattgaatatgccatggcatctaccgtagcctgtccttgaatactctttgctaattgagatacggctgctatctttgcactatcttgtggaagacctgaacccatatatgattttgtaagtgcacttatagtatcaactgctgatttgttatatatacttatttgatctgagagttttgaataattatagtttgtctgtgactgcattattactgtcatcattgttactgctacagaacttgctatctgccttacagtactatttagtgcagatgctcttgaaatcatttcaccttttatagtatttaatccagcactacttattggcatcattgcaagtcccagtcctatatttcttaaacaacttatagctattattgatccttttgttgaatttatgtttatagatgtagaaagcataaatgtacctattgccaatataataagtccaggtacagctactatcttggctccaaatttatcaaacagtgatccgcttataggcatcataaatgacattataagtgcagatggaaacataatcatacctgcttccattggggtatatcctcttatattttgtaaaaatagaggaactatatatgaccctcccattaatcctattgtcataactgatattataacgagacttattgtaaaatcaaatgatttaagcactctaaggtctaaaagtggcattggatgcataagctcattaaaaacaaataatataatactaagaactcccacagctactaatattggattttcaatatcattccagttaattgaattaccttttccaataacgtacagtaaacatacaattcctattgtggaagataaaaatcctactatatcaaaagacttaaatgctttaattggttcatcttttaaaattatcatagaaagtaatacacctattattcctattggtatgtttacagtaaatataagcctccagtccaatttttctattatcattccgccaagggttgggcctatagctggtgctgccattgctgctattccataaactccaagtgcaaggccaatcttttttcttgggaatactgaatatattattgtcataccaactggttgcatcatacctcctccaatagcttgaaatacacggaaagcaatcatactggaattactccaagcaaatccacacaatccagatccaattgtaaaaattgccaatgcaaaggtatatactttttttgctccaaatacatcttgaagataccctgttaatggaatgattgctccaagtgtcaatgtataagctgtcattacccattttatatcatctaacgctacaccaaatacagtcatcatttttgttaatgcaacattaattatacttgaactcaatactgccataaaagtaccaacaataaccacaatcattgttaaccatggatttgactccccattattattttcattcactcaacatcaccccattacctaacatgaatcttaattacagcattagttcctggaattattttatctttatattcatcaagttgtatttttattggaactctttgtactacctttgtaaaagtaccactgcttgatgatgaaataagagacaatgcggaattcgatgtttcccctatagttttaattgttcctgtaaacttttctgaagcaaactgatctatcgttatatcaactggttgtccaatatgtacttttccaatctttgtttcctctatattcgcacctatatatattttatccgtatctactaatgtaaacatagtttggcttgatgaccataattctcctacagttccctgtcttttagcaacaatcccatcaataggtgatcttatcaatgcttgttctatattaacatcagaaataccattcatatcttgtcgagctaatatttcattttttgtaactttatcgccttcttccacattaaattccattagtttccctgaaatttgtggagttacactaactaaatcagcacttacccttgcatcttcagttgatacataataagtattttcataccaataataagcacctattgcaccaactactgcaataattactatcaacattccaatcaccaatattttacgcttaccattcatctaaaacagcctccccatattattcttctattccaacttctgcaaacataccaggttttaatgctaaagttggatctgatataattatctttactaaaatacttctattttgagaatttagttttgaatttataacagatatctttcctttaaatgttgtatctcctgcttcggatactttaattactacattttgtccttcacataaatctccaacaacatctattggtgcatatgcatttacaactagtgcattaggatttgatattgttagtaaagctgtatttggtgataccatctctcctgctttaatatttttagcagttatagaacctgaaataggtgctgatattgttccattatttaatgtagtctgtgcagttcttaaggctgcctgtgcttgttcaacttgtgctttatatacatctatgcttgtttctgttggaccgttttttaacatatttaattgttcctcagcatttttcttttgtgattctgctgaaactaactgttgctcagctgtttcaagctgctgctgagtattaccgccagcttcaactaattgcttcatacgctcataatttttatttgcaacatcataattcttatttgcagtatctaatgctgcttctgcttgcgctatttgctctggtcttgtactattttcaacatttaccaatgatgcctgtgcagtatttactgctgcttgtgcctgatcaacctgtgcctgtaaatcttgcgtatccaatttaattagtacatctcctgcatttacattagatccaatatctgctgatatttcagatacccttgctgaaatttttgaagccacatttacctcttcacttgcttcaattttaccagccattatatatttatttttaatttcttcctgaacgttatcagtaatttgttcattattattttctgcttttttattggcaatactacatccacttaataatgctattaaaattaaatatactataccaatttgtatttttttcacaaatattcccctcctgaatttaaatatctaacacgtgttgaattattttttcatgtttagtattatagttataaatggaaggaattacaatcgtcaattttagagtaaaatgtaaatttttcaacataaaacctttataatgttggatttttttaaaaagcgaggagtgaaaccaattacatgaaaaagaaagaagataggcgtattttatatactcgaatggttattaaagaaagttttctttcattaattcaagaaaaaccactagataaaattaccataaaagaaatttgtgaaaaagcagatataaacagagctacattttattatcactatacagatttgccaacacttcttactgcaattgaaactgaaaatgcagctcatatatctgatttagttaaatcctgtaaagaatcaggaaaatcctttttagacttatttttagaacttatatatactaatcaaaatttttataaagctttctataattgtaacttaggaagtggagccattaaaataatgctaagtcaacttcacgaacaatatatattgaaaagatcttgtttgaataacctccttgaagaaatgcaggctcaatatcaatttcaatttataaaatatggctttataggtgtcatgagaaaatggcttagtgaaggttgcatagaatcaccagaaaatatagcacatattatacgaaaaatcctaaataacaatcctcaaatgaaataagaaaaagactctgaactttaattaagttcagagtctatttttattaatttgatgcatacaatggatttgcacatctaacttcttgtccatattcattttttaattcattgaatgcctttaaaactctatccgatatatccacatgagcaatgaaaccttttccatttggaccatatccatttgcatcatcagtaagtcttggtatttcccccattaataaattaacatatctatcaacatcccacattccataaatatcagtatcatatgttaatgaatcatcttttacaataatatttgctctataggatgcataattaataatattaacatcagaagatacatatttacgaagtcctgcctccatgcgatattgcattgttgcatcctgacataaaataatatttttatattcaatctcattatctttaagtaaatctaaaagataagttatattgttaccacaattggtagatttacattcaagataatcagctttcactccatatctaaactcaatatattgattaaacagctctgcttctgataaattcatagtttcaattaatggatactctttatgcactctttgacgcaaagtttcagtagtgtgtccagctcctccaacaataatatatttctttgatatattattttttattgcctgagctaatacatctcccccgcacattatgcttccaccgaataataccataacatcaacttgacttattttatatttatatttcaaattatcagatgtaagttcttctatatctcttttcccacaaaactgtcctaaaatatttatgtttcttgcaatttgctttttcatatatttaacctcataaattttcatttatttttagttaattataacatactaatacctatgcatataatacctgatattataaaacaaatagtatttaaactaaaattcagtgttgatcttactttgtttttagtttttttctcttcaatttctttaatttttatattattatttgaattaatttgagcattattttgtcccatagattgaattgacaaccccattggatttccatgcatagatgtaaataatgctaatataatcacaattattccttctacaaatataacatcttttattgaatatcctttaatttcagataatccaataccaatggcaagtaatatgataacttgaactattatccaaaacatctgttttaagaataactttaatatatgtttactcatataatccccctatactaatgaataaataccttattatagtctccaccatatactttcgtcttcttttatacaatcttaataaaaattcagagtacttaattattcactatcctaaccaattataacataatttgtaaatataaatttaattaatttaaaatatttctttattatttaaatgctttacccttcatgtgaaaaaacaattctggagtatcttctgtaataactctaaattcatagcctttagatttatagtattttattatctctggcaaagccttacatgtatttttttgcatatctgtacagtgcaaaagtagaattatcctatttctattttcacttccctttattgcctttctatataaagtatcaggacaaagttttggattcattccatctgtattatctaaatcccaatcatatattttaaaacctttatcatgtagcttttttaaattatttttattcaatctcttgtcacttccacatggaaatctaattatattaggtgaaactccaataactctgtttacttcattacggcattgaatcatctcttgtataaatgcatcatcactgctataaatttcatttattttgtgtgtatatgtatggagacctattccatttccttcattataaattctttttactatatcttcatttcctttaatttgattaccaattaaaaagaaagttgcattcacatcattttcttttaatatatctaagacatcgttggttactttacaactaggaccatcatcgaaagttaaataaattactttttcctttgaagtaacctcttcattaaatacccctttagctaatgcataagtactgtttatattgtacttatatatacctagaatcaatagtatgtttattccccaaaataaaatgtatttcaatttacttttcaatttcttttcctcctttgtaaattgcgttgttaaattgttaattagaaatctctttatttttattattagcttctttattctttttatttatagtaattttatgcatataataaaagtaatgaagaaattaataactgcatcaattattaatttctgaattttatctataaaaaacatcacaatactcgttcattattatgaatagtgtgatgtttaatcatgtatttatttttacttatttttatataaaattcattacatttataaattatttaattacgttaattttttatcatgatacctactgaacaaacttaatgacgtaacagaacctattaatgccattagcatatcccattgagtatcccaaacatctccttgtgttcctaaaaaagcatcggcagcatttccagtaagttttgcaactacaaattcaattaattcataagaagcactaatagctagacatatacatataactataaatgacaaatacttctttttgtttataaccttatttcttatgattatctctcttgctatcattgctggaatgaatccctgcataaaatgccctaatctatcatagtaatttctactcaaatcaaaagtatctctaatccaattaaaaataggcatttctgcgtaagtataatgtcctccaacgattaaaattattgattctattgtaattagtacatatataaaattcgaaaatctatatttaggatatatacagattaatactgatacccctattatcacaggcaaaacctctaaaaaccatataaataaatctttaggttcaataactgaccatattaatatactaagcaacataactaataatattaagtgaaatcttttattgcttttcatatttcccctccacgattaaaaaagtaaacattattataacatatttataaatatctcactatttaaattttgaagacatactattcaaaattttttaatatatttagtttttagtgcttgtttaaagttaatgttctatttttccgttctctagtataatattataattctcaattaaaaaattctccgtttactatatatttaatgttattttatagattttattctttatccttacatttcatgcttcaattctcaataagcataatattagtaacctaatattctaaataattttattttttcttgggaatattattcaatgaggtgacaattatgagaaagcgcttttttattttatcaacattgttaatagtgttcactttattatttacatctaaatcttatgcagcaacaccattatatcctgttaataacatatatacagaagggatttataaaatacctaaatcagtttttgattcatataatattcaatataaattggtaaatcataataagaagtgtacaataattatcttagatgaaaataataatacaatattcaaaagtagtgagtgtcgtgatcaatgtgatgctggaataataacaaataaagatactttaattataataactgaagatcaagtatcactatattttaacaaagtataaaaaacctaagtaagagtaaaatcctactcttgcttagctattctcattaattgcttctgataatctattaggcctcttctaaaggatttatcccttataataattccaacttataatatttcatttgatttttcatacatctctactctactttaccaaataaacaattctacttaaattaatataatctcttgataaatttaatgattttttcgaatattaagcctaaaattgtactcattcttccaaataacattccaattactatcattaataaaaaaacaactgttgctactacaagttccatatcaatttcctactttcacataacattcgctctattttttacatattttgtattataaattatattgtatcataataaggtcattatagttttctaatttctataataaccttaacattttttaaacttttaatattttttctacataaaaaataactattccctaatcaactgtatagcattaaccttttttactttctctatacttttagttcttattaatataaaaatcatactaattataagtaagcacattcctccaactaacatatagttacttcctagattcgcgataaatgcaccacaaactgttgttcctattgttgttccaagatttgttgctgcaagaaataatccattcccaaaatcaggagcttttggtataacagaggtgatccagtactgattaatattacctgcaattcctgctaatattccccaaagcaatgtaataattgctgttgataatttaaattctcccaaaatgaatagacaaatataagctacagctaaaagaactggaaatatccttacaagtcttaaaggcttctcacttaatccttttcctgctatcatatttccaacaatatttgctaacccatatacaaataacaatatacttactgaactctctgaaaaacctgttacacctgtcatataatctgcaaaataactatatactccaaaaattgatccatttaagaatataattgccataatagccaaccaaagttctggcaatttcaataccttaagctgatcaccataagacatcctttctgttactgatattgatggaacaaatatgcacgtagctataagtactattccattcactactgcaaaaaatatcattgctgactgtaaagaaattgtatttgcaataaaacttacaattggtactccaagtaccattcctgctgaaactcccatcataacttttgctgcagctttgggtgcttctttttcactaactgtttttcctgcaactgaaaatgctaaagatacataaacagggtgaaataatgcaggtattatccttgcaataattgccacataaaaatttgttgttaatgcttgaactaaactacttactacaaaaatagataataccattatcataacttttttcctattgattcctgaaaatattaatggcataatcggtcctgaaacagctactgccaaggcaaacatacttacaaataatcctgcttttgaaatggttaccccaaaatattgtgataaaagtggaagtattcccactaccccatctctgtatttattatactaaatactcctaatgttaagatcaaaagaataccttttgaattttcttttctattcatttaaactcatctcctttgttctttcttatctattacaattttacttctatccatcaactatatcaaatacttatattacatatcattatatgccttttaggtatatctgttcaaataattatatatcttttatagccttacattataatatactattgggattttatttaatattttagtcttaaaaatagcctgattctcacattttttaatgtagtaatcagactgattcattctatttatttagcattgcttcactacccattgttcataagctctaacaccttgatttaaacgtaaaagtccatcatctaatattgattttggacatgcaatattcattctcataaatctatttccattccctctatactgacttccagaagataaatacaaacctgtttcttttctgatgaatgagcagagttgagctgtatctccaattatatccgtacagtctaggcataaaagatatgttgcatcagagcaaaccatttttatctgtggtaattccttttgaagataatttgatacaattttcttattttcttctatatattctctaagctcatctaaccattcttctccgtaactaaatgctgctactactgcatctatagcaaaagtatttggttctgcaacttcgtcagaatttaatcctctcttcattttatttctaatttcttcattgggtatagatacgattgcagtctgaagtcctgctatattaaaagtctttgttgcagacaggcaagtaatactattttgttcacactcttctgaaacagatgcaaatggaacatattcttttcctaatgcagttaaatcacagtgaatttcatcagatagaataactacatggtgttttttacataattctcctatttttcttaattcttttacactccatattctccctgcaggattatgaggattacacaaaatcatcattgtagtcaatggatgagctaacttctgctctagatcttcaaagtcaattttgtactgtcctccattatatttcaatttactttcaagtacatgtcttccattattctcaatggaattaaagaaaatattataaacaggtgtctgtacaaggacattatctcctatattagtaattctttttactgaacatgtaactgctggaacaattccactacaaaaaattagccattctttcttcatagtaaaattatgtcttcttgaccaccagtttacaatactctcattccatttttcagaaataactgaatatccaaagattccttctttaactttattttcgagggcctctattatggctggtgctgtttgaaaatccatatctgccacccacattggaagttcattttcacttatatcccactttaaagaatttgtattatttctatctcttactacattaaaatcatacttcattttcttctcctccttaaattttatcttcacacacaattaatctatatttttaatagcttcatacaatgaattttattatctctctactttttgcatttgcatcctttaactttatatagaagatagtcaagacaatctaattgtttttgcgtttcatgaatacaatctaacaaatattttctctgttttatcagtaaacatattttatttccatctaagccctctttatcatattttagataatctctgatttcttcacagctacaacctgcatcctctaaattttgaatcaatgaattatccttgttctgctctttactcatggtttacctttctcttgttaattcttataatcatcttttcaattttattttatattaggtttattgatatatccaatacttataatttatatctatttatgcttgaaaggtatagcaaattcatgatattatttcaataataaatatacatttcttagaaaggaataaagctgcttttatatttaaacagctgataggtaaataacatggatatacgtgtattacgatattttttgacaattgcaagagaagaaagcatttcgggagctgctgattttctgcacattacacaacctaccctttccagacagataaaagatttggaagatgaacttggaactcaactgcttatccgtggtagtcgaaatattaccttaacagaatctgggttactgcttagaagcagagcagaagaaattatatcactcgtagataagacagaagctgaaatgaatatctctaatgaaattatcagtggtgatatttatattggcagcggggaaactgaagctataagatctattgcaaaaatagcaaaagatttacaaaagatacatcctaatatcaaatataatctatttagtggcaatgctgatgatgttaaagatcgtcttgataaaggtttacttgattttggcattattattgaacctgctgacataaaaaaatatgattttttacgtcttcctacaactgatacttggggtgtattaatgcgtaaggaccatcctttgtccgaaaaagaatatatcgaaccaaaagatttgtggaaccttccacttatatgttctgctcaatctacaatttttgataatctggctggatggattggcaaaaatatggatgaattaaatattgttgcaacatataaccttttatataatgcctctcttatggtagatgaaggtctaggatgtgcactttgtcttgatagacttatcaacacctcaggtgaaagtaatttgtgctttaaaccactatacccagaattaaatgtacatttagatataatatggaaaaaatatcatgtattttctcgtgcttccgagatatttctcgaaaaaattagagaacagttataaataattctatttttataataactatatttgctttttaaaaagatagcatacagtctaataaaactgaatgctatcactttttatttttattaagtttaattaattccatacttttttaaaactattttagtattttcttttttcatatcttcattatcaaaaattatttctccaatactgtctgcaacaatttgcccactatatggatttttaatactatcaatactactatcaattattgcatctacatttgaatattcaaatgcaagatcagtatttataagtttacaatttaccatttttatattttccatatagcacatcccctgttcactctcaattgtgcagttaacaagtgtaacattttttgaattccatccgaaatactgccctgagatataagaatcataaacagttacattttcactattccaaaaagcatcttttgataacatattagcattacgtataacaatatttcttccaccatcaaaagagtagttaccaattaaagttaaattttctatttccatgtcacaacttcccatagcaaaataatcacctttagctgtaacgttattcatttttacataagtacagttccataatgtttctaatgcatttggaattattacattatcaagttcaacattattacatcttctaaaaccttttggtgcatcataagttacatttttcatacttatattatttgtataccatattcctgctcttgccatatcaaacatagtagaatctttaacttttacattttcacaataccatagtggatacttccatttgaatccagtattatttatgttaatatttttactttcttttaatggtgattctccatctgcaaatgtacagtatgaaagctctatattattactttgaaataaagctctttctccaacaaatttttgttctatatatttttccatagtatttcttccccctgaatatttataatatgaattcaaaacaaaggattttttaatccatttaattagaaattttaaattcatttgctatatttatattatattgttgatgtttctacatatccaatacctatatcaaatacttttctatgcttttaaagcatatattataatatcaataaacaaaatatatggttaaaataaacccataagtaaaaatattatacagttaataattccttaactttttctgtgtttcaagtcaaaaaaaagccttacggcttttttatgctacaactcctgaaataataattccaattgctatcataaatcctgcaataactatagcaacagcagtattcttatttctaagttcttcatcaaaatcaatttttttaagcaccttgtcaaataccacatatcctgttatcagaagaataattccaataattccaaatactatgcttagcataatgtccaatgtaaaattgttcattttaatctcctccatatcaatattaatcttgtatatatgttgaaatgtacactgcatttttatcagtaacaatatcacccattcttgtataaatacctgctaattcacttcctgtaatatacgctcctataataggaaatttaaaggaatccatccttaacggtcttatattaaccctgtcttgaaatattatttcctcatttaagttttcatcatgttcttcataattcatcctaatatcctgtccttcacgtccgaaatatggcttgataacataatccttagataactttttatccttttccagggatgtatatggaatatactggtttataaaattctcataatcttctgataaaatcccctttcctatcacttcatacataaaagcaaataaaaccttagactgcattacaagtgtatgtcctggatttatcaagtaatcaccatttcttaatggttctaataaataattcatttcttcatcataataaagccaatcaaggggtagtatctatacactgcatcaatttgtatattataaagatatatttcattttcattcacttttaaatcatatacatttccaaatacaatattatattctttaaattccttcataatatctccaataatatttgtattgtatatatcctcatcataccagcatgttactacagcaatattcttaacatatttcttcttttctatctgtcctataatatcccttaactgtagggatattttttccctaagatgctcatttggatttctataattaattaaaaattcatcctgtataaatttatttatgcctatagactcaactattcctgccggggtttctgagttaaattcaagcatctttagtctaccttcattatctatacaaaaatcaattctgcctaaagcgcatagacttgaaacagtatcattttctatgattttataaagttcttctggtatgccaaataattcacccagaatattaagattatcccttatcttaatatacaggttttcaacaatgctacagaatttttcacctgcatactttatttccctataaagactactactcataagaagaatatcatttgaaacagctttattcacatttgtatattctccagtaaatttatagttaaatgccatatactcacacaatttttcatatacttctgcttcatttttattcccaatatctaatgtttctatttttattggaaattctgatattccaattggattcatccatgtttcataatcatttgtaagaagtgtttttccccatcgtactaataaacctgttaccttgtctttcattatgtacgtcccaaagttcccataagctgcaacaggaatattagtattatacaaatcaggtacataagtataatcctgccttatatctataagttcttggactatatgtattttatggttatctgctacatttcctattaaattattccattcttcatcagtatatgtctttcctaggtatacttcctgactatacctgccaagtgatgattttagcacaattctgtttttatcttttattactttttgtatgatttcttcattaaaaatctctgtatatggaactgatcgtcttattacttctttttcctcatctgaaataaggctactgtcattccttatcaaatcccatagatatgaaaaaaaacccttagactggactgctataattctagggtcatttattatgagaacctttcccttgtcaaatgaatccaagatatcttcaatgttatttatttcatgaaagaattcagtaggaaacaatcttagtattattttaagttttatctttgaataagcatatacttctccattaattacacttaaattttgtggcccaacctgaacgatatttatatttgtatcctttaggatatgtttaaaataataactatggtgcagttcttcataatgacatggatccataagaaaacctacatcaaccttatctatgcctgaatactcttttgttattgcaactagttcatctataagatcatctacaaaatttttatttacattttcttcaaagtcaagttttcctgcaagatgtatctctttctgtccacatggcttatcataattaaattctgcaaattttatattttttcttttatcaataaacgtatcatatcttgtccaatacattggagataagttgcattttaaattgaaaatcctttctttcaatgggaattcttcaaaataatctaacaattttttatgacttccatttatattttcaacaacgcgaagtgcaagattatttattgtttcactataatatactatcctgttatatatatctttttctatataaaatggtatctgactatgtacatattcttcaccataggcactgaccatgtaattatcaaacagcgcatcttctgtatatctgattctatttttcattacaaacacggctccttaacttgatgcacttccaccttttcctccagaataacctgacgaacttgtgattcctgatttccccttatttcctgaagatgaatttactttttcattgctacttcctgatgatgaactatgccaaaaagtatttccatggtatccactgctacctccatatcctgaatcatcgtcgtcatcatcttcctgattataattcttctgattagtggtacatcctgcaaaattgcttgaaagccctgctgtaaatactgctgctacagcaagtgacagtgcttttttcctattctttttaagcatttccttcatatcactcaaagccttccacctcctctatctttacttctatttctttttgtaaataatcaagctgtatcttcatatcttcttttaccacttttttagtaaatacacttaccttcccatatccaaaccgttttaaaaatgaagcatatggaaaatcatcatcgcctattccatattgattgttcagcttgtcatatattttttttaaatctatgctatcatcatacctgtcataatcatataacataataaatttatctgtattaatatcctcaagcattagtgaattgtttattaatttagatatattgttttctgttcctattattccatgttcattaaaaaacatatttatatttaatacaggctttattctatatttattattaaaaacaagagcaatatcaataataacatcaaatggaagatctacaatacataaggtaccttcatttatatgtaataaaatattctctgccagttcatcatattttccctgctcacaccactttaatttgaaatcatcataatcctgtaatgttacaaaaggcgtacttctgtaaaatcccctgaattgctttaaattctttttccattttctatatagttctcttaaatctatgtcttttaagtacatactctctacctttcgtaaacaacagaataaataccgtttagtgataagtactgcttatatccatcttcattaatgaatacaaaataattgtcactgcactccctttcgcagacttcgccactaaagcttatctccggctttgatttcctccatgattcggagttatgatatatgtttatttcttttaaaactccaaaaaatccatactctaatttatagactactgcaaaattacctgtaggtgaaaaaacctgtcggtaatttttattatctatatatgtatcaacggcaataagaccattttccatctggcatatactaccttcaagaacttcatacggcttatctttataccactgttcataagtcttgtatataaatatttccatcaaatcttcctctcattaaatcttaaaaacgcatttaacaatacgtgaaaattttaccatatatttagataatttaaaagaaatcagtaattttctgtctatgaaccaaattaaaatggactggagcactagattaaatctgctatccttatggtagagacataaaataataaaaaagaatacagtattaagtgtaattatactgcattcccataatcaaagtttattaataaatctctttttatacttaagttttgccatcttgcttatattggttagtactacataattggcagcacctccaagtgcaccaacaaaggggataccctgtacaaatttagatacaagaagactgtctaccatctttttagaagtttcttttatcattaaatctaaatctacatatatttcatcattattgtctattgcctttgatattttatcacaatcaaagaaaaatttcttacggtcttctttatcacttatgcctgcacatattatattgagaataaatactttttccttgtcatcatcataatcaaatccatatttcaaggagatttcataaatcattctaagtattacacctataaagattgggatatcaggcagacctatgccaagaaagccaagtgctgtaccctcaactgttgtaattcccttgcttaataaattccccatgtttacatttttatctatagccttcagattttttctgcttatttcttttgataatatatacttattagtgtcagcatcattctttaatttatcactgttgtaactcttttctattaaagatgtacctttttcaaaaatatagtaaaatcctttttcaaaagcattgtttaacccatttgtaactttatctggaatcttatcttccactttgctttttagtggattaagtttattctttaaaaatttattatcttctttctctaacagtttttcttctattttagccagcttattcttttgtctgcggataattttttcttcttttttaatctttttaatatttaaccttctcaacataccctccttaatacaacttatcaagttattttataattctttcattattacattacaccagttataagtgaaaattcaagtaatgatttttttagtttatgaattttttaatacacttatttctttcaatctagtatttattttattgaaaaattcaccagggttttccatcatacatatatgcccagaatcttttatgacaatattgcatttataaggagcatttatatattcaataaaatttcctgtatcaaatatacatgcataatctaattcgccacttactaatattattggacacttataactttttttatattcatatatattccaattaaaaactgtatcatacaatacattgttatacttattactcttagcataatacggaatatattttaatggcatatgaggtgatataagactctgacaaaacatcattaatgtctcattatgttttgtctgcctcaaatacttttgagataaagtgactaacttactaacaagctttaatcccagtcttttatccgcatgtaattcatcaattatactatcaattacagatttatttttatcgttactgtttattttactttttacctcatgtgctaactgaatcatgctctttttataattcattacctgtccaattcctatataagcataagttatttctgggtacatctgcgcaaatttaattcccacaaaacttccccatgaatgtcccattattattattttatttttgttgaatctttttaataaataatcaactacttccttagcatcttttataaatatattacattctattgtcttagatacttcattccagttttttttatttagataataactcatatttgcacttctttgatcataatttacaaatacataatctttttcccaaagatactgatacgtatgaagctctggaatcatcgatgtacctggacctccatgtaaaaataaaataactggtttatttaaattttcacctctgatatataaatattgtttaattccaccaatttctaatattacttcttcatcaataccttctttatttattatcttatgactgttatacagtttctttttcttctctataatacataaagtaacaattatactcattattattaatactacaaaacaataaattgatattagcaatttaaccacctctaaaataaatttagtcaatatactgactaaatttattctactcttctattttaatatagtcaatatattgtcttttctagaataaaaaaatgataaatctgattaatataaacaaaatttatcattttaattattttaaaagtaaaaaatattatatattttttgattttcttatagattatctaagcttaaatcaacttttatatcgtcttcgaacccatcctgcttaacaccatcatactcatatagcttttttaataatttccataaaatttctacttcatcattagtaaatttattaaatatatttttcaaaaaatttatagatgcgtccgaataactcaataattctactttaattgcatccgttatttttacattgacagcccttttatccttaggacttggaacaacttctaaatatcccttcttaaccataccattaacaatagtattaacattttgtttactcgtaccaagtttagatgctatattatttaatgtagtatcatcctcttttaagtgcaaaactgcaataacaagcataaactgccttgatgttatatttttaaaacatctgtcacttcttgcctgaactttatttgctgtaacaaataatgtggcatatgcctgctgcatcaaatataaatcctgtacttcctttgcttctttcatattcatcaccttaatatttttgcatttatactatcagtaaatccctcatatataaatatattggctatgattacttatagtacattttttaatttcttcaactcattgtttaggtttgaagcctaataactcctcataatgcaaatcatattttaccatatataaattttaattattttataataagcttttacctactttttatacatgtcattcattacagatataactttatttatattatctttattatttattacgaactcaataatttcctctattgatggttgcttataaacatgagctattctatttctattaatctctctttattcataatctatcacatctctttctctaaagaatctaaattcttcattatttttatatataatatcagttttgttataatcttttccatacagatctaattcatcattatatattaataatccagaatcataaactgaaaccttaaatcttagatctgtttcatcatcatttagataaataatataaatttccctattaatcatctttcctatttcttcttctaagtccatgatacatgtcagattaatttttcactacttaatattgcaatatcaacatctgaatattcttcaaaattatctgtaacaatacttccaaatataattacactatttatattgcttttcttaaatgtatctatacatctatctgatttaagtatattcataatctcattcttatcataaataccactatgtgctgaatccatatctgtacctcctgctagttactcatagcatagtttttaatataaactttatacgctaattgtatttaacaataattatagactataacataaatttttaaaatatatattttagttactttgatttcaaaaaaagtacttccaggattattttatcatcctatgagtactttaaatattagtatatattctaattaacaattgaatcttatatatttacttttccagtataatattttccacgaatatgcttatgatcaaatttccagtcatcatcatgctctataggtacaaaccatagaaaatcagtgtactgcattccatgagttatcttacataattcaacaactgataaattactccagtttagcttatctaaaatgtctggaagtgcctgattatcttcctgtactacacgttctgcacagaatttatatatatcttcaggagtaggtatataatttctatctttatcagcagtatataaaggccaaggtagataacctgtataatccttgtctagtataaaagttttattatctaaatctaaaatcccaacttttctatctttgttcttcagtataaatttactgcacattatatacacctctctttcaagtaattatttcttagtcttagtaaattaattatagactcttttcttaagtcacttaaacactctattttcatgactaactcttcaatattgcttaagtcatctatatatcttataaattcctttggaactaactttatctgcttatgctgcctgcttctaaacggcttacaagaagagtttctatctagtaagttaatatctttacgcaaaatatcttcatttacatcagctaataaagacataccattatcaaataatggagccatagaaataatttctccttcatcactgcatataaatccaaaattatttaaatgtctatctgtattatttattaaaaaatcaaatattatcatattgtatatatcctctttatattgaggaaacttttctattatcaagtctaataactcattagatttaatttcggaatctgataaaaacatccttatgcttctataaatattatcatttgataaaaaggactttgacatactaaccaaaacttttttgtgaaatacatctatttcctcaataaaactattgcatatatttatatttaacgtataacctatcgctgatgctatatattcagaaactggctctaatgtactaaatgtaccataagaataattacctgtcttaacaaaataaaattcaccatctctttgtacattccacttaggaagtgctcctctttcagttctgctattttctatatactttatatcacttgaatccatatttataaacaactctttatgtttattataaaattctatagcttcattatcagatgggttcttacttttcattatagtttttatatataaaatctcactctgtgtcagactcattttaacagctcctttaattttaagtcgtcccttatataatagatattatatcctattattactatactttaaatacatcttataattatggaaactaatcttacattattttagccatatgtccttctttgcacactccattcaattattccataaacacctcacaagatataacctcaccaaaagttccctgtaatgaagccataatactatcgtgtactgtctgagcatctattgtttgtccattccacttaagatcttttgttgtgcatgcatcatgtattactgtgactttatatccataattctgtgcagcacgcactgttgtatcaatgcacatatgtgtcatcattcctacaataacaagtttatctaccttaagtttatctaattgtttcttcaaatctgtctttaaaaatgcacttggataatttttagacactataatttctttcttctttggttttacaccttcattaaaatcaagaagatattctccattttccatagcatcaactttaaaattatgcttaacatgaattacaggtttattttccatcctgaatttttctaaaatctctgctgctttttttccagccctttctggttcatataatttataatcaccctcacaaaaatacatattttgaatatcaattaaaattaaaacctctcgcatttataatacctccatactttttattgattctaaaaattaaagcttttcttatattataaaaacataaatctttaatgtgaattacccacttttttgtatgtatagtattcttttaatataaaatcatatttcttctacttaactcttataccctttttcttcaattcttcttccataccattttccaccatatattcaattcctacattctgcattattttaaaagccttaagtatttcacgtccttttgttggtgtaagaaaatattcaacatgaagaggatatccttcatagctcactttatcaacaattccaaattcctgaagttccttaagctgttcaagaagcattttctgtgttattccattaatctccttttgtagttgtgacaaggattttgaataatctttcagctgaaataaaattattggtttccattttcctcttacaatatcatgtactatctcaagcggacatgtatagtcctttcttattttcatattagcgcttaccccttatatttcaatattattatatttattttaccactacatatgctgaatcttttaatctattttaaaaataacctaaaaaactcataaataaatcaatactatttatgagttcttatatatttatatttttctaagagtgtaatcaataaagccctggtttattttttaccatcataaattctttccacaattctataccatttaaataatatctccatatcttcaagacaattatctgctatacaatctatcctattgccgtaatcccctgaacggcttcaaaaatattaattatcaatattaatatgataaaaaatcttgtaaaaaagtatatgcactgttttttatctggcttgtactcacttattttatatttaatttttttactattcttaaatgcaactataatcaagattcctatcaataaaactattatgcctgtttcaatataatctgtaggcatattgtacctgcctaacaaatcaataaaattatcaaccataaaggaagaagtattatttaatatatgaagtattatagttaattttaccgaatactcttctgcaagatatcctaaaaaaattcctactccaactgccataaatatttgttcaaaattaccatgcataaatccaaaaagaattcctgatgatataactgcaaaacctttatcaaacttttttaaatatttaagtaccattcctctataagttaattcttcaattattggtcctattatacatacatatataaacattgaaggcttgtttaaattttgcatcatatcaattgaatccttcattgtatatccaatcatatttaatacagattccataccaactgaaaaaagaccgcaaagtgaattcacacctaaaagaagtataaaatatagcaaaatctttctgcttgaaattcttctattttcaattaaaatagaatttatgttcatcttgttcttaataaataaagccactggtataaagcctatcataacaggtataattgaaatgtaaggatttacaagaatattatttaatacactatccagcattgtttcactaaaatcaccactttttacaattaaccaaattatataaattataatagctactatactacttacaaacattagtatttctcttataaataatgtaagtccaaccttattaaattcttttttcccattatattcttctcttttactctctttcgttaacatatccataatacaacaactcctaatatctactttaatattatattattagataaattctatctacagtttaatttcagcgtgaaaagtaatattataggagtaaaatgtacttttctatttaggcagtactatctctaccctaaaaatatcatctttttcttttatttcaaaatctccattatattttttaactgcatattgcatatttataattccaaatccatgatttattgcatcctctttagacgtaatataattattttttattcttattttagctctagtcatattattttcaaaaattataaacataaaatttttgttgtctctaagctctatttttattattcttcttgatacattattttcctttatagacccttcaatagcattgtcaattgcatttgcaaatattgtgcataaatcaacaggttcaactgaagtctcattacccattctaccatcaactgataattttatattatgttttttcataattgaatacttctcatttaatatggagtcaactaccatgttgccagttttaatgacattatctatatttatcacgccattatttaattcgtatatatactttttcaattcatctattttattattatcaagaaattcacttatacatatcaaatgatttttcatatcatgtttaattcttcttgtttctatttgagattttttatatgcatcaaaatgctcaagttgcattttcatataatgtttattaatttcattcatacttttataataaactgctgatttagatttaaaaatagaaataagaaggcatgaatccattattattccacagatagcaataacaattataatacatctatcaagtattgcatcataaacaactttcatttttaattggtccataatacatataagaagaaatattactatacttactgttatcattatgactatatctaacttatttagtgtaatatacatattatccttaatcttttttcgtaaaaagattattattgttccatcaaatattattgagaaatacgttaatacattgtatatgccatctggcattggatcccttaatagcactggaccagaaaaaattcctatagccataactattagataagcaaacattagacttatagttaggcaaggaattatatataatacctttgccaatcctttaaatttataattataaagcattaaaactaagattaaaggaaatgagtatggtaattcaataatgtttatatgaataaccttcaataggaaaattatcaattcactaattccacatataataaatatatttttattaatatttatttccctacaaaagaaatacttaatcatataaatcattgcaataacagctagataactatctatactctcagctgcaatattaatcatatccataagccttccacctaccttgcagtttttttaataaataaatatagttgatctttgaaagatttatatttaagtctactcaaattaaccttttcattgttatctagcagtacttctttattagtataggattttacataattaaaattaactataaaactcctatgtactctaaaaaatccacattctttcaattgattttcataataactaagattgtttttttgaacataaacattatctcttgtatgaatatatatgtctttattttgagcttctaaataaattatgtttgttgcttttaaaattatttcttcatctttatacttaattataattttctttgcaccatcacatattttcttggcattttcaatacattctattaatttatcttctcttattggcttggacaaatatctaaatgcatttacttcataaccatctttagcaaattcttcgtgacttgttaaaaacgctatcaaaacatcagtatttattttacggatattcctcgctgtgtctattccattaatattttccatttcgatatccaaaaaaataatatcataggcactatcattttctttaaaatcctttataagagtttctcctctttcaaatattcttaataccatatcaatatcatctttataaatttcatttatcttttcacatacagatcttctgaaaatttcctcatcatcacatattgcaatgcgcatacatatcactccattatctaaaagtcttccgattaattcatgaaattattataacatattgatatcaagcactattctttctactagaaaatcgaactctaatggcactaaaatagcggttttgattattatttcaaaaccgctattttagcaaatttagatatttactatctaagttaaatcatctctcagtgcatctataatattttccttttttatcttactaattgtatataacattgtaatgaacacaataaataaaactccaaatacactaattcctatacttgcccatggcattataaaattaatatcatctaatccaccataaatcattccattaaaaattaataaagaaattattaatgctgttggaattcccaaaagtaatgccttcattccataaaatccacattcaaaattcatcatcttttgaaactcatgctctgacattcctactgaacgtaacattgcaagttcacgccttctcatcttaatgttcgttgagattgtgttgaacacatttgcaactgcaatcaacgaaatcataaacaaaaacgtataagcaaatacattagcaataaatatataatttctgctctcagcaagcatctgtgtattatctataaggctatatcctgtaaatttcccgtcctgcactatcgcacgcatttcactaatagactgtgatggatttttagatttaaatgtacaacccttaactttcatatctactggtgcatctgcgatttcaaacttctccctgagagaatatggagccatgactattatagagcttgacttattatcatttttgtcactggctgcttctaaagatactggcatgtcaggtggtactatatttacaaaatcaacatttaaattctgtccgtactctgtttttacctcaccatttatgactggattcatatttagttcaattgaagagttcttaaataaatttccaatctgatcaacctcttctagacgttttttattatcttctatttttgcaacagaaataagctttgcattacttcccatatattctttctcaggcaagccaagtttatttataattgccatataattttcgtcatcaatcaactctactataactggaagatcaatggttttatcttgtggctgtactcctgataatttcttatagtcatctgatagatcacttgtactcacaatacatgaataatttaaaacagccatatacatactttcacatacattgcttacatttttaaatttatcatataatagtaaaatctcattatcttccatatcaattgttccaaaaccaatatcgtaatcagaaacaatagctacacgttctgatccctgttttagatatgttacaaaagaactaactgatataaatagcactacacttaaagcaagcgaaagcacaatactacgatattgtttcctatttcttttaaaattctttaatgcaagcattccttccagtcctaaaatacattgtgtaaattttgatatttttactgatttactttcaaccttaacttcattagtctgacgtatgcattccattacagatgtatttgccgcctttcttgctggaatataagcggaaatgagaattgtaacaaagcttactgcagctgccgttattattgcaggaatagatatagtcaactttaagggtacattatcatatataacatttccaaaacttttagcaactatactaatcacaatcccaataccacaaatgcctgcaaccactccaattggtataccaactgtacctatacaaagtccctcaaatatcacagaatttctaagctgctttgctgtagcgcctactgatgaaagaataccaaactgatgtgtacgctcatttaatgaaatactaaatgaattataaatcaaaaataccgaacctatcattatgattataatgacaattcccccaactgtataaagcactgcattaaagatagtgtcatctgatagtcccatgaaacgcaacacattatcattcaatacgtagccatggttttcacctacactttttatatagtcatgaatcacatgtggattcttcaatgtaacaaacatcccacaattatctgctgtatctatagtatctattcttgtaattgcggtgtatcctggtgcaccttcttcttcaaatactggtgtctgacatatacccacaattgtatagtttttttctgattttgggataaaagtttcatttccagaaatgtacttgtcattctgattaagcttcctattatcctgtatacgttctccaacattaagtgaaattttatcgccgatagcaatattaattccgccatttgtttgaagtcttcctgaaactataatttcatcactgttttgtggtaatcttcctgaaaatattgttaaaggcgcagtttcaaaagccttgtcgtcaaatcctgccagaaaaatatatggccttgtatgatccttgacatcatcaagttctgcataacctatattttcaaattctgatgtatctatcactcttctgtcactatcctgttcttctgcaaaataagaatctacatctgaaaatgcaacatgccagccaccatattttgcaattgcaccatttgtaacataagttaacattgaaattccaaaagtagtaactgatgtaatcatagcagcagagagaataactccaataattgtcacaagtgtccttgtgcgattttttttcattccttccagagcgactttgtttaaaatattcattaaagagacacctgcctctcatcacgcactacttttccatctgcaatgcagataattcgatctgcctgaagagctatattttcatcatgtgtgactatgataagagtctgattatattttttatgactttctttaagaagctgaataatctcatgtccatttttgctgtccaaactcccagtaggttcatcagcaagcattacagctggtgcattcattaatgccctaccaattgcaacacgctgctgttgaccacctgaaagctgatttggcagatgtgtcttacgatcttttaaaccaagcatatccagcaaatcatttaatctattttgattaacccttctcttatccataagaataggaagtgtaatattttcaactacatttagagttggaatcaaattatgaaactgatagatgagccctacctgacgtctacgaaaaatggctagtttttcattattctgtccatacacgtcctgaccttccagatatattttcccacttgtcggtacatcaacaccagcaattgcatgcaacaaagttgattttccagatccagaagaaccaattattgctgtaaattcacccttttcaatagtaagtgaaacattatcaagtgcattaacttgattttcacccttgccataaaccttgcatagattttcaatctttaaaaattccattatgtaagtctcctttccctaagctttatctagataatacaccattcaacttacatctttgtgacttttaagtgactgattagtcactttggaaaatggatagaaaatacagcaccaccttgcatatgatttttagcagtaattgttcctccctgacctgttataattatcctacaaagagccaatccaattccgtatcctgtagcatctgtatttttacctctataaaaccttttaaataaataaggtaaatcttcttttttaaaaccatcaccactatcatgtataacaatctcagtgaacaactgattgttttcacaagtaatctgaaaccttccattatcacctacactttctatgcaatttttaaaaatattctgaagtgcttccgaaagccaacctgagtctccatgaataacaattcctttctctacatgtatctgcaaatcaatattatgcaattctattgaaatcagaaacggacgaagtgctgtagatattaacttatttacatctatttcttcacttttaaacactacaatccccgcatctaaacgagatattttcaataatgatgtaatcagccaatccatctgtaaaagcaactcttctgcttctctcttaaattttttcagttcattttcatcattactattctctaacaatgatagaataagattaactgatgtgagaggagttctaagttgatgagctatatctgcaagcgaatctgcaagatgttccttttctttttttaatgcatcattctgctctcgaatacgcaaagtcatttttcttatctcactttgtagaatcgaaagttcaccctcatttgattcagtaatataaagatgatcatcattatgaagaacaagatctatttcatctgaaatcttagcaatgcttttatatcgtgatttggtaaacataaaaaatactattccaaaaactgcactagaaataatagaaagaattcctgcatacacatttattacaaatccaaccattgcaaatacagctgccattaataaaaataaaattgaaaatttctgaaattccttattccgaagcatactcgccactcaatctatacccagtcccacgaacagttaaaattatttgtggatctgctggatcattttcaatcttctctcttaaccgcttgatgtagacagtcaatgtattatcattaacaaactcacctgctgcatcccacaattcatcaagtagttttgcccttgtaataatacttttaggattactaataaatactaacagcaaacggtattctaatgctgacagaaaaacctcatttccattttttttaactattccgcttgcagtatccacataaagtcctcgaatttcaaaattagttccaaagctctcacttttacgcagtgcattttttattcgcgcaatcaattcacgtggccgaaagggctttgtaatatagtcatctgcacccatattcaatccagtaacaacacttgactcatcaccagaagctgtcaaaaatataactggaatattcatcatttcttttatttccgtacatacagtaaagccatttccatccggtaaagaaatatcaatcaatgccaaatcaaacttattctgagcaagcatataaatggcatcccctcgtgtaggagcatgagtaactgtaaatccctccgaatttagtaaaagcgtaagatttttagcaattaccttatcatcctcaactaaaaatatatgtttcatttttattttcccctccttaatccactattagaacattaatatactactatacttccttaaattacatttattattttccatgcactaatctattgttcttgatcttcgtcacgctatatacattattcattatatttttctgagattaattcaaatagttttaaatatataaaatattagctataaaacaattattaaattttgtaaaataccacttatattataacaaatatataactaccaaacatcctttaaaatatcatgttaacccccattaattttacgtatatttgctatgtacattgataatgattttgattgtaaattagaaactatagatgattataataggatgtgacaaatttgatacaatgcaaaagaagtatgaattttgattaaaactcaatcaaaattcatacctcattttcttttcattataaactaagcactcgtatgaaaaataacttttctaatatcacataaatatactttataagttactttctataaaaatgcatctagtgccactgttggttttccagtactatcaaaagcacctttataatattcattccaatcaccataacattctggttcccaataaaatacccctatgccttttccaccagtaacagattttgttttctttattatatctgtaagaaattctttgcaaattaatggttgtgtaacatccataccaacttcacataacataacttctttaccatatctttttaccatgtcattcatattatctaaacataatttattcagactagcccagttagttgtagtaggatataatgacatacctatgacatcatactttgcaccatttgcttgaagaccatcaaatagccatctatatacttcattattatctccaccaggaagatgtactataacctttgaactactgtttactttctttacagcatcatacccacagttgattagccacgcaaagttcttcatatttgtagaagctcgaccttcttcccatagcataccattattagtttcatttccaacctgtacccattctggatatactccatttgattttaatgtactcatcacatcataggtataattataaactgcatccattaaaccattaaagtcatagtttgcccatgctgctggtttagcttgttgtccaggatcacaccatgtatcactataatgaaaatctatcattattctaaatcccatattttttgcacgtactgcttgttttactacatcatctttgttgcaaaaaccacttgaaggattaacccataccctaaatcgaattgaatttatcccatggtcttttaatatttgtaaacaatcctgtttaacaccattgtcattataaaagttccatttataatattccatttctgatagccatcctacatcagctccatttgcaaaagaagtagctgcctgaactttcttagttggaaaaagagaaatagttaacattagaattacacacaatactagagaaaaaatactttttaaatttttaatcaacataaaatccccttgtatatcgttttcataatataattatataaaatatattactaatatttattagtaaattcttttttagtaaaatattatagaataaaaggctttgctatttttaagtaaaaggtaagcgtgaatagttaatgtagaaagccttacagcacttcttaattttatgctcttgtggtagtctaaaccaaagtggtagatttcacgcaagtgaactccatgtaatctataattatcaaaaagctgtaagcctttttccttaacttttagttcttaccttttactccttacccaattctgtctttttctaaacctacataccgtcttgtcttcaaggcttataccctcaaagggcaccccgtccacagattatccaataaaataattttctatataaagcatgattaagaattactatctaaaaatgcatcaagtgctgctgtaggtcttccatcatcaccccatgcacttaatttatatttgctccaattgtatgctccttctggttcccaataaaacacgcctaaccctttattgtctgaaattgatttcactatctttataacttctttaagcatatcataggtgttagatacacttgtatcttctccaccaacctcacataccatcacttctttattataccttgatacaaattcaattaaattattactcaaattatctatagtttctgtataatctttttctatccagtatggataataagacacaccaattacatcatactttcctccatttgccttatgattatcaaaaaacttaataaacctttccctatcatctccttggtctaaatgaataataacctttgcttcattatatataacttttactgcttcatagccactatttaatagcttggataattgttcaaaattatcaatacttccatcaggccacaacattccacttggaatttcatttcctatctgtacccattctggcttaacatccttagcctttaatgcattcataacttctaatgtgtaattataaacatccaatactaattgctcaaaactatgattttcccatgcagcaggtttcttttgcttttcaggatctgcccagctgtcgctataatgaagatctatcatcaatctaaaacccatattttttgcacgaactgccatctctactacttcatcagtactgcaatgaccactttgaggatcatcagaaggattaacccaagctctaagtcgtattgaattaattccatgatcctttaaaatttgaaaacaatcttcctcttctccattatcattataaaacttataacctgttacctccatttgctgtagccatcctatatcagcaccttttgcaaaatatgtttcttcatcattttttttatttaccatttgcagctctcccttcataatattatctaaattcttataattctgtttttctcccaaactcttaatttccagctaataaacattagaattcctctaaaacactcatctgctgcaaaagcaatccatactccatttaatctcattttaaaaacaactcctaatatgtagcttaaagtaacacttactccccacatagaagctattaaatccatacttttagatacaatgtaaaaaataacaaatttttattcctaataagtataattttagacacattaaaataagtataactattattttttaacgtgtcttatcttttaaatttaatatctattgttttaatatctttactttatatttttctaaaacaatttctttttctactttttcaccagaaatcatatctaaatattcttcatcccctaaatccacagtcttttcttcatctgtaaaattcatcacaaaaatataaatattattttcattatgacgcatttttactgtaactcctttaggaatctgtccatctataacactcttaatttccaaatcctcaataatctttgaataaaaagaattattaaaatcttctccagttcttgcagcaatatgatatgcttttcccttaccatatttatttactgttactgctggcatgtctttataaaaatcactttcatatacagcaagaatatctgctgtttcagtatggattaattcacaataatctttaactttataattgccttgtaaattttctatactattatccgtaaatactatatgatttgattcattatcatacaatgaatctatttcttctgcccatattcctgttacatctcttaatggtcctggaaatcctccaagaaaacataaatcattttcatcaacaattccagtccagtatgttgttacaagtgttccaccatttttaacgaattcatttattcgctctgcaacaccaggtcttatcatataaagcattggggctgcaagaatcttgtattttgagaaatcacaatccatatctataacatcaacacttattcctttatcaaagaaaacttcatagatatcttcacatgtttttgtatagttctttttcttcatctttaagccctgtaaatcatctattgcccatctgttttcccagtcgtatattattgctacatcactttttgtgacagctccctttacttctttaattttttctaaaacctgtccaacttctgtaacttctctgaatactcttgtattttcatgaccacaatgatcaactacagctccatgtaatttttcagaagcacctcttccttttctccattgaaaatacagcactgaatctgacccatgtgctatactctgcattgctgacaataaatgtattccgggctttttaagcttatttacttcctgccaattcacaagacttggggtattttccataacaagaaatggttgtccatctttaaaacttctatttatatcatgaataaatgatgtttcaacacctattttataattaccttcctcttcagaatgccacctaggatatgtgtcccatgatataatatctacttccttagcaaatttccaataattaaggcctccatatgtgcccataaagttcgttgtaattggtatatctggtgttatttctcggataggttcaatttcatttttataaaaatctattgtttgtgttgtcacaaatctcttccagtcaagattatgcccatgtacaaatatctcacctttttcagatggactttcaatttgtgaaaaatcattaaatctatgactccagaatcctgtccaccacgctgaatttaatttttcaatgtcattatcatatttacttctaagaaaatttctaaatgcttcctgacacttttcacaatgacactcaccaccatattcatttgatatatgccacattataagtgatttactatgcttatatctttttgctaacattttgtttatagcctttgttttttccctatatacttgagacgtataacaatgattatgtctctgaccatgaagattttttgttctatcactgtttactctcaaaacttcaggatatttttctgacaaccatgctggtcttgcaccacttggtgttgctagtattacatttatattgttcttttccattctctccataagttcatcaagccattcaaatgtatactttccctcttccggttctatagcgctccatccaaaaatattaatagaaacagtattacaattagcaagtttcatgagacgtacatcttcttttaaaacctctggatattctaaccattgatctggattgtaatctcctccatgaagaaatttcgtaatatttttattaaataactcataatttttattcataataatatttctccttttttcatatatcaaatttttctttactcgtttcttttaattttttaaaaagacagataaacttatttatgtttatctgtctttacagtaaaaagtacaataattatagtattaataatttagaaaatattaagttattaattttctaccatcaactattagctgttgtgctgtttcatgtattctgcaacttgcttttcacattcagcataaatcttatcaaatccagcttcatttaatttttctttatattctttaactgcttcttcaacatcactgcacataccaagatctattggaacaccatattgtgtaattacatttcctactgctgccatttcatttttcacattactgtcatcaaatgagaatgctgcaaggggatttgtaactgtatattctttttcccatttatctttaatttgacctactataggtggttcatcagctggactacgtcctaatttttggctataccatccccatgggcatacatttgcagttgggaatccatcactaccatctaaagatgtatatttatcatcaccgtcagctttatagtgcttgccttcaataccataccaagttaaatcataaatatctttatcatatctcaataaatcaattgccattaatgctctttctggattcttagaaattgaatttattgcaataccattgttagtataagtattaatcattctgtttattccagttgtctggtctgcaacctgtacatcccattctggatgagttttattcattctctcagctctatcagcaacagatcctatgttccataccattgttgcagtttttcctgccataaaatcttcatctcttgttgccttacttgaaattgagtcacttgaccaatatcctttatctgcaaattctttcatcttctttgcatactctaaatattctggtctatctacatatgcaaatatctttccactctgatcatttacatcaaatcctatacttggagttggaacacctgcaatccctccaaaagcatatttctccatcatatatggatattgaagattttgtcctccaccatttgcaattactttaattccactttcagtatcctttgatactgcatccatatatgcttcaagatcatcataattttcaatcttttctattccatatttcttcatcaaatctcctctggcaccaaatactcttgtaccatattcaacttgatcacttggaatcatatatatcttatcatttatcttagcctgttcccatgcttcttttggttcattttcatatatatttggtgcatattctttaagcatatcatcagttatttcatagaacccattctttgttgcaacctgactataatatccccagcttgatgctgtaaaaattatatcgaagttttcaccagattggaataaaagctgatatttagttgtcatatctgaccaaggtaaaaaactgatatccaaagtagcattaattttttctttcattatttcatttacttttccatatacttcatcgaaatcttttggtttatcaccaatcagatacatttttaaagtaacaggatctaatttacttggatctgaatttgctcctcctacattagctttacttccacagcccatcattaatgttccaacaataactgtggttaacccaactgaaatcattcttttaagaatttttctaaaaaccattgttgtttccccctacttaaataaatgttatacgttttcatagaacataattataatatcattatttaatattgaataatgggtaaaatattttaaaaatagtataatattatagtttaatcatttacatttatgtttcataaatcacaaaatttatattttaaaattaaaaagcggatatttaaaataacaattttattattctaaatatccgctatattatagatacaatgttcttacttcatttgcttttcttttatgtaatgatttatctgattattacattcatctaatattttatataatcctgcttccattaatttttccttatactcattaattgccccataaacatcatcacacattccaagatcaattggaataccatattgttttataacattattaactgcagacatttcatttttaactattctgtcatcaaatgaaaattcattgaggatattatcaacagtataattttccacccatgtatcaaagatatcctttgatttatcagaacttttaaatggaactctatgaagactgttactgtaccatccccatggacatacacttgtcgttgggaaatcctcacttttataagtctgactgtattcataatctccttctgcattccagtgtaaaccttcgattccataccatgtgagttcttgtatctctttattatatctaagtaaatttagagccataatagctctttcaggattctttgaggttgcattaatagccattccattatttgtataaggattgactgttctagttaatccttttgataaatcaacaatttctgcttcccattcaggatgtttttcatttattctttctactctatctgctactgaacctagattccataccattactgcagactttccattgataaagtcctcatctcttgttgcttttcttactatcgaatcagctgaccagtaccctctctctgcaaattctttcatttttaatgcataatttttatattcttcagtatctactactgcaaatatatttccattattattatttactttatatgctattgttgggatgggagtcccttcaacaagctgaaactcatttttctcaagcatatatggatattgaagattctgtccgccaccatttgctattacttttacaccattctctttatcctgtgatactgcattcatatatttttcaatatcatcataattatttatgtcatctattccatactttctggcaagatctcctcttattccaaaaacccttgttccatactcaatctgatctcctggtatcatatagattttattattgacttttgcttgatcccaggcttctttcggttcattttcatatatatctggcgcatattcttttaccatatctaatgtaagttcgtaaaacccatttcttgttgcaacttcattatagtgtccccatgattctgctgtaaaaataagatcaaactgttctcctgactgaaataataaaggatatttttcatccatatcagcccaagataaaaattctacagacaactccgcatttattttttctttcattattttatttactttatcatacacatcattaaaatcatttggcttgtctcctataagaaacatcttcatctgaacatattccatatcactaatagcatcattatagctattgtatacattgtaacaaccatacattccactggaaataataaagattaataatatgcttaatattcttctgatcctttttagtcttctcataacagtatatcttcatcctcttcatgattattttacatattatttatataataacattttcttcttttataatctatcttatacccttattgtataatcctcaattttctaatatatgtaatattaattgtttttatttctttatacacaaaatatagcagctttcaaaactagaaagctgctttgtcatatacaaattattcttttactgcaccaattgtaacaccctgaacaaaatatttttgtataaatggatatagcaatattataggtccagtaactattattgtaagagccatttttaaagattcactaggcatatcaattgccgctccaatacttcctcctgtttgagataatattgtcttatatgcttctacattatttactatcttatataaataatattgtaatgaatataacttttcattatttatgaataacatacaattgtaccagtcattccaataacctattgctataaataaacctactgttgcaagtgctggttttgataatggcagtattactttcataaatatctgaaaatctcctgctccatctatttttgccgcttcaattaaagactgtggaatgctgttcaaatagcttttcataagtataatattaaatacgcttaataatggcggaagaagcattgcaagataactatcttttaaatcaagatatcttaccattaagatataccatggtacaagccctccactaaatagtgtagtaaagtaaaagaaaaatgaaaatttatttctccatttaaaatcttttctctgaagtacatatccagtcattgcaactatgaataatccaagtattgttcctattactgtaaggcttattgtaactccgtatgctctaactattgccattggatcttttagtgcagttctatatgcttcaagtgaaaaactatttggaaatagtgaaaatccactttgaattatctcttgttcatctgtaattgagcccattaataccaataagaatggtattaagcaaagtaatgatattactgctattactgtataacttatagcattaaaaaccttgacgtctctgccttttttcatgtatcttgtcctcctaatataatattaaaattgcaaataattttatctttacatatcttttctctctatcttttaatctatataaatcttttcatactttattagttatcaaattttagaacaatgaataatctttatcatatttcttaactagaaaattgcttatcattattgtaataaaacagaatactgattgatataaacatgatgctgctgacatccctacttcaccagattgaattaatgatctaaatgtaaatgtatctataacatctgtagcattaaataaaggaccattatttcctataatctgatagaacatttggaaatctcctcggaatatattacctattgcaagtaatgtaagtattatcattgtaggtataagacttggaattgtaaccttaaaaattctttggaatatgtttgcaccatcaatttttgctgcttcataagtttctgtatcaatacccattattgctgcaagatataatacggttccatatccaacatttttccatgcagatacaaaaatcattataaatggccatacaaatgtacttccataaaaattgaatttttctccaccaatctttgctatcatactatttattgtaccgttttctagattaagcatattatatgcaataattcctactacaacccatgatataaaatacggaaggaacattgctgtttgtgtaagttttttaaaatacttcccacctatttctgaaataagaattgcgagtcccatttgtaaaattgtattaacagttataaatgctacattataaagaattgtgtttcttgtaacaatccatgcctgtcctgaaataaagaaatatttaaaattatctaaaccaacccatggacttccaaaaattccatctctgaaattataatttttaaaagctagaatagtgcctcccattggtatataactgaatattaagaaatacagtattgctggaagtagcattaaaattaaaactttatttcttctaatcgttaacataaatttccttaatctgtttttcttatctactggttctaattctgtttcatcaagtaaaagatctagtttgccttccatgatattatcccccttttttatacgttttcactgtaataataatatcatttttaaataatgttattttagtaaaatattttattataggtaaaatatttatatttttctttaaaattataactttttattgtatactaaatatgcaaatgtaaatgttatcttaaatgtattcctttctctcttatttaatacgattttcatagacaacaatatattgagacaggaggtaatataatgataaatttattaattgtagatgatgaagtttttacacgtgaaggtattatggagatacttccattagaagatttaaatataacaaaggtaatatcagcttttgatggacttgatgcattagaaaaaattaagactttcaaacctgatatattattaacagatgttagaatgccgagaatgaatggtatagatcttgcatttgaagtgagaaaaacctatcctgatacttcaattatatttatgagtggatattctgataaagaatatttaaaatctgcaataaaattaaaagcaataagctatgttgaaaaacctattgaacctgaagaacttgaaagtgcggttcgtaacgctatattagaaaattcaaaatgtaaaacaataaatgataatatagaggatagtattgctatagaaatgactaattctttggatatttcaaagcttgacaatatccttattttatgtgcctctgaaaagttaaaaactctcctatttaattcatcattcttaacagtgcttatttcagctgaagatacaattgtagaaaatagtatcatatcatcactaaaatcagcctgtaaagtatgttgcttagacttttttatttctaaaaaaagtgattctcttatagttgtacagttattatttagtaaaaattctacttttcaaaatataaaaatgaatttatcatctctttttgcttcttttgatgaatgccttaaagaacacttcaattactttattggcactggtaaacttgtatattcattaaatgaaacatccgattcttttttatatgcaagtaaagctataaatcataaattcttttatgattataattctgtaatttattcgtgtgacaaagattgtaagacttatactataaatcctaatataatatctaaattagataactcattaaatactaatgaaattgaaacattaaaaagaattataaaaaatcttacttcaaattttaaaaacagcattggaacgccaatatcatatgtaaaagattcttattacagaattatacaacacataatgaagcatggtagtatacgaaatacttttcataaaaaagaaatttgttttagaaatattcttgaatctatcttagaatgtaataatttatttgaccttgaaaatattgttctaaggtttattgatgatattgccttaatgctaaatgatagttccaaaaagaattcaactgttccatccattttggaatacattcacaaaaattattctaatactaatttatgtcttgatgatataagtaaaaatacatatcttacgcctacgtatatatgtgttatatttaaagatcaaatgtctaagacagtaaataagtatataacagaatatcgtatagaaaaagcaaaagctttcttaaaggattcaaatataaaaatgagtgatattgctggaaaagttggatataatgatcctaattatttttcaaagatatttagaaaagaaactagttataccccttcagaatataggaggtattttacaagtgaaatttagacgaaagctaaaattagtggatcagtttttccttacattttcaattttaataattataccccttataatactttttggatatacttacactaaaatgtcctatatgataagagaaaatactattgcttctactaatgtggcatttaatcaatcatgttcatttatttcatataaaatagacaggctttatgatactgccaactccttaattatagataataatataacatcaatattaattaataatccgaaagattattctattccaaatcagatagaagatcttcagctattaagatcatatatatattcttatcagcataatatagatatttctgatattgaaatctatttaaatgatgattttatatattctaatgaaaaagttaatatatttccattaagtagccttgccaattcaaaatggctttctataacaaaagatcttaatgtaagatacttctgggcgccttatagttatatttctaataaaaatgaagattcagttgttcttggaaaatgtattgtcaatccaaaagattacactaatccaataggatacttatttatcaaatttaatacaacagatcttacagatattataactaagacaaattcaaatgctcaaagcttcagctgtattgttaactcttataatgatgtgattgctacaactgatagaaccttatattctaaatataaaaatattattgaaaatacaatccctaaaaatgatacttctcttcataagtatgaatatgattcagatgatatctatgttcaaagttctagtatagataaaacagactggaaaatagttaatatcgtgccttatagtactattaactctgaaattactaatcaacgaatatgccttattttaattgttatactctttggcggtgctgctcttatagcaggttataaatttttcaattcaataacttcacgtttatataaagttattgaaggaatgagacatgtacatgctgataatcttgataattttattgaaaatgataaggatgatgaacttggtgaacttattgaaaattataactatatgatttcaaaaatgtcaggacttattgaagaacagtataaatacggaaaagctgttaaaaatgcagagctaaaagcactacaatcacaaattaatcctcattttctatataatactcttgatatgataaactggatggcttataaaaaaagaacctctgaaataagtactgctgtgaaaagccttgctaaattttataaactatcactcaataaaggcaaagatataacatatatctctgatgaaattaatcatgtttcattatatgtacaaattcaaaatatgagatatagcaacagaataactttaactgtagatattgataaaaatattaataattatcttattcctaaaataacacttcaacctattgttgaaaattcaatttctcatggtatatttgcaaaaggaaatgtaagtggattgattactatttctggctatattgatatggataacgatgaaattttaataaaagtatctgatgatggaattggtattgaagaagataaacttcaattaatattatcaccaaatcaaatatcatctaaaggaagtggctatggtcttagaaatatagaccaaagattaaagcttttattcggagataaatttggactttcttttgaaagtatttatggatgtggtactactgtaataataaaaattcctcttataactgatgataattataacgatgatttctaattaacctatcaaactatttaatacaaatttcttcatataaaggagcaaaatataaatgaaaagagaattttatgataaaacaatttatacactaactaattattttgtgagttttttacaagcaagtctatactttgctatttctaatatttttcttattgtctattttatatttactttaataaatcctaatatttttaatttatttgttctatttttagtactacttccatttggtccttcacttggaggactttactcaatgtgtggcaaatctctaagggaaaaagacatgttctttgcttctcattattttaaatattataaaatgaattttttaagcaatttaaaaatctggttttttattacttcaatatgctttgtattgctaatagatttacaatatttttatcttaataaaacttcatcaggtatatatatcttttttaaagtattagttatatttttaggtttgattagcttatatgcttttcctattaattcaagattttatataaagcttaaagaccttttactaacgtctatttactacatgataaagaaatttcctttgacaataatgaaaggcgctttgatttttttactattctatattattaaaagtatttccataatttttttgatatttattccggttccattatgctttatatttatgcactatgataatattcttcttaatgaacttgaaaagcagtcagtatccaatattgctcaaatataataaatgctacttcaatagcttaggcgcctaactcctttgatttaggtgcttatattttttattatagatattatcaaaaaaagactcaacaactccaaattgttaagtctttaaaacattaattttaaaatttaataaattgtaaaactttcacacatcacatacaatatgttttatgaaatattatcctaaactcacataagttcttatttcaaaagagcttgttctctcaaatttttaaattcagttctgattgtttcatcatctgcttgaggatttaaacttttttgccatgcaacataataatcctttattttatcttcatactttgtccaatcatcttcattgatttttaaaaatacgctgcttcctactttagattgttgctctttagtcgcttgttctgcacttgtagtttcaacaatgtcaattacttcttgtgataatgaaattcctttttctgcattattccatgcaccttgcacaccaataacaacaccgcctgctacaagaagcaaagaaactaataaaagtaacaaaccttttttaatacttccctttttaaaataaagatatccaaataacatccatattgatacaataaatatgattgtacctacaacagctaatactgttccaaatttttccatgatctactccttaataaataggataaaaattcctaaaataaaatataaatttctttggttaactacttaatattaaatatttccaatacataattaatattatttttcatttttgccaaagttacttatattttatcacattttaccacttttttctacaatattttcataaataatgtatttttggtattttataattaacatttataaaagatacttagattccaatacttctaaaatttctatattcttatagcttacagactcatattcacgttcatattgagcacactgtgcatcaatctgtagcattatttcttcttttaattctctttttgcaaatgtatatactaccctgtcttccttatcaatatgccttgttaataaatcacaatatgatatagcatttgctattaaatctaattttgcttcttccgctccagctttaaccctctttaaagcctcttctaaatttttaacatataatcttccaaaatcatgttctactagcattccatgctttactaatttttctccaaggacgcctaagttctcaaccattttattaaaaaggaagatttcttctttattatgatgatgtccatcggcatattcttttataaaacctattattaagtcaaaatcactgtagtcatatatgtcattttttaaaactttaaagcatgctgcccttacaactttaagcatacgttcaatatatctatgttcattcatcattatttctatagcattcatattatcatacctccaaattacattcataattttttattaagcttatgtctgtaattaaagtatactattaaattataaaaagctgcgtaacaatcgttactaataaaaattaattattctatctatgatattgcaataaatatacaaaaagcaaacatgttaactatttaaaaactaatttcaatatttaatttattagtaataacactctttactgcattttcctttaaacagattatcttttatgttcttctcataatctgtttcatcttccatatgttcaagtatatatatagcctttttcagatttttcacatctctctccatataatcaatgtaatttcctcttccaactacttttaaatgagtaacccctgcttttttcaatctatataatgaacaaaggccacatccactagctccaagcttatacgtatcttcatcagctgaatcctcttcaatattaatattaactctatttatgttattactattgttacaaataacttcgtcattaagatcatttccattattaatattattttcattatttaaaaaattcaaatcaccatgtgaatcatcataataaatctcaaattttttatcaacttcctcaaaattactactttctttatctatcttagccatatgatatggtattttacatagatgtgccatttcatcacaatgaagtgagctacagaaagcacctgtatagtgacatctttcatttaatataaatgcttcgtattctttaatcatatctttgctttcacttatacatgattccatatcttctattgtattttttctatgaaatatataacgtgatatatttttaaatctgttgaaaaattcaattgaggatctatttatttcagcacactcaccacttaaatgcacatggcattttatatgttttttctctaaatatagtataagtgccgggtctgctactataaattcattaaacccaatattaataagatctttcacaatcttttctatcagctcaaattgctcatcaatataatacaaatagttaaaagttattgtaacaggaactttataaacatctaccattttcttcaatattttcatatcttccaaagaacttatttgaacattataataaagcacttctcgtctatttaaaggaaataaattaccgtattttttattccattcataaggtacatatccacagaatacttcatcagcaccagcttgtacaagccttatgtaatcatcaatacatcctaatccagctactattttcattaaatcatccttttatcaaataaaatttaaaactattctgtctatgcccatattaacatacttctcgaacatattcctgtcttttaaaagagtatcatcaaaggcaaatagagagttatattttccaaccatctttaaatgctttggataagcaaatacataatccatgcagtatttaggacatgaattaacaagtttttgacttcctctatcaagatttttgcacatggcataaagagtgcaatactgggatgtattagtcacataaaaaggcatctgaagactgtgtttaccttctccgattaaaatttcatatccacagttttcgtattcataacgctcaattttattttcttttaaaaaatcactaaaaattttactattaagattattctcagacatcatgtctttatttttctcatagcccttcttataaatatatcttggatctttttttcttttatttaataaaactccaagagatagtgtaaaataatctgttttatcttcaagtaactttatcattccccagtcatttatcacaatttctattttcattccactttttatacaccagtcatatacagttcctataatattctttgtttcttctatacgattatctctcatatatgtaaagcatagagtaatattaaggttatcattagcacactttttaatcatattcattaataattcagtttgtggaaataaattatgacagaattcatttcctatatatattcttgaaatactctttttaaacagcatatgattctctaaaaaattttctttaatgtaatcttctttgaacctatttatatctttatgtaaataattcttatacagtttatcattatcaagctttatcgcaatctcaagagattctaaaatatcttcactataattttcataatttaagtttgaaagccagttttttttctgctcggaataataatcataaaattcataatccatttctgctggataacctaccatttcctttgaaaactcattttcatctccaaaggtttttaacattatatattttgaataatctctaaatattctttctacattttctttatatttattatcatcaatagaaaacacatatttaaaataaaaatctttttctattatttcaataagtttatattctgtcagttttatttcggtgtatccatattcattaaaattgtaaaatgataacattacttcatttattttttctaatttttcacatacacgtattgtaaaatcttcttttgatacttttaatacacgcacttctgttccatcaacaaaacaacttaaaagtcctgatggaaataattcaatttcttcttttcccaaaccaatccctcaaatctcttatctcgtgtctagttactgtaactcttccaccatacactaaatatatatcatattggattaaaaatatttaatatatattattttttattttcttatacaactggtataaaaaacatactatttttacttttcattttatgtatttcaaaatttataccatatacagcctttaaattttcctctgtaagtacatctttcactaaaccttctatataaacttttccatccttcattaaaaatatttctttgcagtaagcggaacttaaattcaaatcatgaagaattgctataattgtcttattctcttcttcatttaatttttttaatgtttccataagttcaacctgatatcttatatcaagatgtgaaatgggctcatctaaaattaaatattttgtatcctgggctattgcccttgctacaagcaccctttgtgcttcacctccacttaaatatgaaaaagccttatcttttaaataagcacagttggtaacttccattgcatgatttattaaatccctgtctttttgtgataaatcctgaaatcttttcatgtatggatttcttcccattgcaacaatatcatacactgtaaaactcacatcaatattaacattttgaggtacaaatgaaatactacatgcaagttcttttcgtgaataatcttttatatctttattatcaaggcatattagtccatgttttgcatcaataaatcttaaaatatggcgtacaagtgaagtttttcctgaaccattaggccctaaaatcccataaaagccaccttctttaaatcttcctgaaatattgtttaagatgtatttctctttatcttctgccttccagcataatttttcaatatttaaatttctattatccatttttcatacctcaaaagcttctgttttttgtatttctatataaaagatatataaaatacggtgctccaaaaaatgctgtaataactcctacaggtatttctgttggctgtgctgctgttctagctatagtatcacataaaatcataaaaaatgatcctcccaaatatgaaaaaggaagaagtattctatgatctgaacctactaaaagcctcatacaatgtggtataataaggcctacaaaacctattgttccacttacgcatacacttcctgcaacaagaaatgcagaaatgattattaaaatattttttacttttcctgtatctattcctaaacttgaagcagcttcatctccagtgagcataatatttagttctctgctaaacataaaaataatagttacacttattatagatactaaaaataaaaataaaaccttactccagtttgatgaactaaagcttccaagtgtccataaataaactttctcaagttgctctctgttataaatcataagaagtgatattgctgagcttaacattgtacttatggctgtacctgtaagtaataaatttgttacaagtacttttcctcctattcctccaagcttatatacaagcataacagtaagaactgcgccaatgaatgcaaagatgcttacaactccaatacccataaaattcaatgtgattccagataaaattgccaatgtagcacctagtgccgctcctgatgaaattccaagtatatgagggtctgctaaagagtttctaaatattgcttgaaaggtgcagcccaccacagcaagagctcctccaactagagaagactgcaatattcttggcagacgcaccttccatacaattacttcatatacctgttttacatcttctgtatccaccattctatttaaaagtggaatctttgataatattaatttaaaactatccaaaatccctatagatgatgatccaatagatgctgaaattacaattaaaaggagcagaaaaatagatagtacactaatataaatatagtatttcttcttttttgactccactcttttacctccgctatttaaatgcatccttatggaatatttctgctaattttaatactccttctgcatttctatatccctgacggtcaataaggttgttatctatttcatatactcttccttccttgacagctgtcagttctttatatccttctgaggacatgaatttatctttttcaccatcttttaatacgataatctctggatcagcttctaataaagattccaatgaaaatgaccaattatctgatgctggaactatatcttttccacctgccatcttaatcaatccaccaacaaaagtattttctggtgctgagaaatctccgccttcaccatagcctacaacataataaacagatggctgacttaaattgctcactgtagattcaaccttgtctatagtttttttcatttcatctatcttttcttttgctttatcattcttatttaatgcagttccaagtgtttctatcatagtataaacaccatcaacattattttcttcatataatgaaataacagtaatgcctgcatcttcaagctttttagaattctcttcattaaaatgtgttgatgctattacaatatctggttcaagacttataattttttcaatatccggtgttctcattgtaccaatagattctacacttgtaacctcttgtggataatcacaataattagttcttccaacaagtttctcacctgcaccgagatcaaaaattatttcacttatattaggtgcaactgatattacctttttaggctctttatctaaagttacctcttttccataagaatcagtaattttcacaggatatattgtttctcctgcattaattgaactttctgatgattgattttcagtttgatttttatatgaatctttacatccgtatgttccaaatgtaaatgctccaatcaataataccaatataatgttcttaaataatttgttcatattatctccttcttgttttcttctactaccttctttatattatcttatccaaatataagatttaatataaaaaatttaatactctgattgtagtgaatttgtcagccatctccctcttagatagtatattataaaacaaattgaacaaaatatccacgatgctggataacaccaatataaaacacgtatatcattcatatatgaaagcatacttgaaagccatattactctaaataaacatattcccgttgcagttaaaatcattgtatgaaatgcaaatcctgctccccttattgcccctgcaagaacttctgtaaaacaatgtgtaaatgtgaatggtgcaataatatacatcatcacaagtcccatattctttacttcttcacttgttgtaaataaatttataagataactgccacttaataaaacaagaatactcatcataaaagttattataacggcgtatccaaggcatacctttacacctttttttattcgatctgtttttccagctcctatattctgtccaacaaaagttgatattgcaagtccaaaagccatcattggaacatataaaaaggaatctatcttttcatatgctgcacacccagccatagcaatagaaccaaaatcatttatctttatctgtacaagcatatttgaaatattaaacattgcagcctgaagtccacatggaattccaagccttattatttcatttgctgtttctttatcaaaatgtattttcttaagtctaagtctatagctttctggaatgttcattaaattaataattacaagtgctgctgagacatactgtgaaatcactgttgcaaatgccgctcctgcaactcccatattaaatactgcaacaaatataatatctaaaacaagattaagcaccccacttacaaaaagataataaagtggatgtttcgaatctcctcttgcccttattattccagctccaacattgtaaatcatcattccaacaatacctaaaaagtaaactcttagatacataacagatagatctataacgtcctctggacaatgcatgaattccaataaactttttgtccatatcataccaactatagtaattatgataccagctatactacttaatattattgatgtattcattgttttaagaagcttctttttatcatctgctccaaagtattttgcaaaaattacgcttgtacctgttgaaattccaagaaaaaatccaacaagtagatttattaaagctcctgatgatcctactgctgcaagaggcatgcttccagcaaatattccaacgattgagctatctactgcactatatagctgctgaagcagattacttaacattattggcacagcaaaaaataataggcttttccaaattacaccttcagttaaactataatctctctttttcataattccttctttctatattatatgctgaaaatatatatcttcataatatattaaaaacttctcctctaccagcatgtaaaacttcaaatttatatttagctagttaaacttttttaagttagtttctaacataaattgatcacaatgagtaccctaaaagaaatccatcgttaaatgccaattttcagtaacaatatatatacccatattaatattattttctataaaaattaaaaatctcatcaataattctaccataatttttgacaaattaataactatactctcataatttaaataattccgtatcttaattaaaactaataagcttctaaaattctaagtataacttagattcttagaagcctaagattttattaaataatttaaagtattattatcttaatattttgtattttttctaaatactatactacactttttactgctgaacagcacatatcttctctgcacttattgagtacacttttgtatgctggtataagaaacgcatctgcaaatatccatgcaacaggacttgctaaacatactgccacatagccaaaaataggaacaagtaaaaatccacaaattcctcttgctatcatttcacaaacccctgcaagtattgcaaatatggagaatcccattccttgaatagtgaaacgtactacattaacaagacataaaggtatatagaaaattcctgtaattattagatatttgcttacctgtgcaagtatttctgtttcacttccacttacaaaaagcaatgcaatatttttcccgaaaaatattgatacaattaaagcaattacagaatatgctgatcctattattatgcttgctttcattccctcacttatacgatcaagttttctagctccaatattctgccctgcatatgttgccattgtagatccaagtgcatcaaatggacatgccaagaaaatagttatttttgaagcagctgttaccgatgcaacaacaactgacccaagaccatttacggctgcttgaagtattacacttccaatggctgtaattgaatattgaagccccattggaattcccatataacttaaatttatcatacattctttattaacttttaattcatccttgtggaatttaagaatttcatatttctctttcatatataccaaacaacatactcctgatattccttgtgcaataacagttgcccatgctgcacctgctactcccatatgcatatatatgatgagtactaaatcaagaataatgtttattactgatgatattatcaaaaatataaggggtgtcttgctgtctccaagtgaacgtataattgccgataaaagattgtaaagataagtaaccggtattcctacaaatattataaagatataagcatacgctccttcaataatatcttcaggagttttcatccatagtaatatatttctacataatatacatacaaaaaatgtcataactgcagaaaatatagtagcaagccaaaaactatttgctacatatttgcgcagtgatttataatctcctgcgccaaatttctgtgcaactggtattgcaaaaccattacatactcccatgcaaaatcctattaccatgaaatttattgaacctgttgcccctactgcggcaagggcactaacgcctaaatattttccaacaataatcgtatccaccatgctgtaaaactgttgaaacagcattccaaacaaaagtggaatagaaaaccctaatattaatttaaaaggatctccttttgtcatttcttttgtctcattcttagccatttatctatcctcttttcatattaatatttaaaatacattgtaacgcactaataaagcctgcttttatataaaatcccctaattaataattaatgattatctcattaattcaaataaaaacagcctgtaccaattagttttatatctaaaagagtgtttttttaatttcttattattttaataagaatatcacttcatttaagtttttacgatataattataatagctttaaactacaatttatataattataaactcatatactataaatatagtgtcaaaatatccactaataggatttatctataaaaatataaaaactaactacaactataatctggaggatttataaatggaagtaaacaaagtagccgttgattcaaatttattagaaacaacatctcatggaaatcgtgaatttccaatggatgtttatagagacgatttttcaaaatattatactaatattataaactggcattggcatcctgaaatagagtttgtaatgataacaaaaggaaaaatagaatacagcacagaagaagagactcttattctaagtgaaggtgatggtatttttataaattccaacacacttcatatggcaaagtccattgatggatatcaagactcattaatgttttcagtagttgtatctcctaagcttatttataataataccgaaagcattatctataagaaatatgtaaaaccaattatagaatgttcaaaattatcatatttaaagcttgataagtctaatacatggcagaaacagattctttcacatttattgtatattgatgctttaaaatttaatgaagattatggttttgaatttataataaaaaatcaaatctcccttatatggcaattaattgcactcaatacatctcatttatatttacataataactgtcctataaattctcactccttatcccaagagcgtttaaaacagatgcttagatttatacataagaactattttaagaatataactatagatgatatagcaaaatctgctaatataagccgaagcgaatgtttcagatgttttaaaaaaatgataaatacaaaaccattttcttatcttactgattttcgtcttgaaaagtccctacagcttctcttagaaacagatataccagtatctgatatatgctattcctgtggcttcaatcattcaagctattatggaaaactttttaaagaaaaatttggaatttctccttcatcatatagaaaatcatctgctatttcaaataaacatatataaggaaataaactgattgcataatagctaattattaataagctattatgcaatcagtacaatctattatattctttttttaataatttttcttttaactgcaattaatccacaaattaaaagtattggaaaaattattgcacttaaaaatccttttttaagattatcttgaaatgctccagacactgttcctacaactgttggtccaatagaacatcctacatctccagctagtgccaaaagtgcaaacattgcagttccaccttttctaagagattttgatgcaatactaaaagttccaggccagaatattcctgctgataaaccacataatccacatccaataagtgcaaaaattgcattgttagataatgaagccattaaataacttataattgaaattaccgcacttcccatcataaaagaatttaattttattttttcactaaattgtgagtaaaacagtcttgaacatcccataagaattgcaaaagcacatggtcctgctaaatctcctattgtcttagtaacatttaatcctgcttcagcaaaagccgaagcccactgactcatagcctgttcagatgctcctgcacaaaccattaaaagcagtaaaatccagaatatcttttctttaaataattctcccatagacattccttcactttcttctgttaatgtctgtattggaacattagcaaaataaattgcatttatcaaaggtactaaagcccataaacaagataatatacgccagtgactaattcctataaaagtaaaaaatatcgttgtaattataattacaaatgcatgtccccaacaataaaatgaatgtaataaactcatagccgcttccttcttctcagtcgggcaagcctctactattggacttataagaacttcaataagtccaccacctattgcataaataaatattgatattaacaaccctatataaggattagaaaataattgtggaaggatagctagtccaacaagtcctccaacagaaaatatatgagccccaactacacatacacgatatcctattctatccacaaatttagctgctagaaaatcaacaataagctgaactccaaaattaattgttacaagaaatgctattttatctattgaaatattatacgtactctgaaatgttaaaaataacagaggtacaaaattatttactatagcctgagttatataaccaatataacatgcgtaaattgtatggttgtaattttcttttaatttcacaacaaatcctcctttctctttttcttctgcttaatataagctgaagaaatcatcaataatttgtacacatactgaatttttaattcatgctatattgaatatatttcaaaaccaataattcgcatataacaaaaaactgagaagtagtccaatacttaaaatcctttctttttattactattgagtgactataaaatggaatattaaaattacttatagaagctaattcattgttacctactaaattaattgatattatagatatgccttttgcttttaatttaagtgcaaagttatttacaaatgaattatttcctgaaaatgaaagaagaaagaatacatccttacttgtaagtgcctctaaaataatattagtttcttcttttccttcaagcacatatactagtttattactgaatatcatattcctttttaattctttagctgcatctttttgtacagcacccgaaccataaatatatattttatctgcattatctatagttctaaacatttcattaaaatcccgattttttaattcttccatagtcattattatatctttacatgtattatcaatttctttaggatcaaattgattttcacctttttcttcccattttaaatgaatctttaattcgctataaccttcaagaccaagtttatgtgtaaaacgtaaaattgtcgtatgagaaacgttgcactttgaagctagctcttgaattgacatagtcctgcattcttttttatgatgtaatatataattccaaatataaatatcattatcatttaatttttcatagttttcttcaattaaattctcaattttcataatattaatcttcctttttacttattgctgatttatgttccatatattttaaaaataaaatttctatcagcataaaataggatgttacagattcatacttaaatttatctgacactccatcaattataggtgttgaaacataaagattatgatcacaaagtcttgctaaagaattatcctttgattttgtaattgatattgtctttacatttcttatttttaattccttagtaaaatctattgtaaattcattctctcctgacactgaaattactatacacaaatcatcctgagttgtcattttaactatagcttttgcttcatcatatccacttatatcataaaatatcttctttcctaataaaaaaatcctctttatttccttttttattgatgattgcaccattccagatccaaatacataaagattctttgcattatcaaatgcttcaaatatttctgtgcaatctctttcgctcatacttttcattagatcattatatgaattgcataaaaaattcacattatttgtgttttcttttgtcatctgattatcaagttttaaatataccttcaattctccatatccttttaatgaaagtttttgagcaaatcttaaaattgttgttcttgatacattgcacttatatgcgagctgatcaattgcaagcttttcacattcttttttatgacttgatatataattccaaatataaatatcgttttcattaagctgattataatattgatttactaattcatctaatctcataatatttcccaccatttttataaactcataaattttattctatacataataacttttctattattaatctttttttcattatattacaagttcatagtattgtatataatttaactatttaagaaaataagtattaatactcattctcagcatattgaatatttctaagcaagatataattttcattttctatatactaaaaagaggtagaatgttaagcttgctctccctcctctattgaaatgtatttactttttaaaattattcatatttaatcaatacactgcttccggcttgtacatcttgcttattattacactctataatgttacgtccatttggctcaacaaccaccatcattgtaacatcagatatattttccttcctaagaaaatccctatctacttttgcaataacctttccatttttcacttcatctcctgccttgcaaaatacttcaaaaccctttccatttagattcacagtatcaagacctatatgtattaatacctgaattccttcatcattttctatagctatagcatgtttagtttctgctaccattactacctttccattacacggagatactatttcatcagatgttggaattactgccattccttttcctaaggctctacttgaaaacatgtcatcttttacctcagataaatctatacttttgcctgatattacagcattaaattcctttgcttttatttctttcttttttccaaatccaaacatatactttctcacccttttctctttattttaagaataattacaaatctatcagctttcctattataatgttttccccctttaaaagggggcttaacatttattttatctttcattagatttcatgatgatttctaagataattctggccagtattccttatttgcttcaattaaatcatctaagattaattttgctattcttgcacttggaactgttcttgaaagtgtaagagcctgccataatttttgatagcttccctctatccatgcttctactgttaacttttcaacacttacttgttgttccattaatcctttttggaattgtggaatagaaccttgacatattctttcatatccattacttcctactatacatggaatttcaaccatagctgttctatcaaagttttcaacagcaccttcatttggaactataagaaggaatctttcatttgtattttctgctatagcacatgctaaatcaacaatgtaagttgcatgaacatcagcttcaaatccaccttctttgcttgtaccactttcaattatctttttacaagctccaaatacatgtttttctcttccttccataacctcattagctctagtatgctctgggtcagaagtttccacaacataatctgggaatagatagtattttaagtatgtgttaggaattgttgttggatctactgcataaacatctcttgctttttggaatgtatgaatccaactttcttctacatgttgatttgtatttgataatgcatctgcaaatccattttcagccatatgctttttaatttgaggcattaaatcgttaccatccttatcatagatctttgaccaccatccaaagtgatttaatccataatatgatacattcatttcttttctagatttaagtccacacatgttagccattttttcttctaaatctataggcatgtcacatatatttagaatcttagaatttggtcttaatcttctagttgcttctgccacaattgcagctggatttgaataatttaacatccatgcatttggagaatattgttccatgtaatcaagaatttcaattactccacctattgaacgcattccataagcaattcctccaggcccacaagtttcttgtccaagcactccatattttaatggaatcttttcatctttttcacgcattgcatattttcctacacggatatgagctagtacaaaatctatatcagtaaatgctgtttctggatcagttgtataagcaaattcaatttctggtgcattttcttttaaataaatttcacatgcttttgcaactgtttcctgtctttgtgcatcattatcataaaattttatagaacgaattgggaatctatccatgtgatctaacaacattagtacaattcctggtgtaaaagtgcttccgccacctgctatagttattgaatattttttatttgccatttttcattcctcctaaaaatcagtgatttgtttttctctatgtgcttataatacactcataaaaatcaccttacaataggtttgccccctttagtgaacatactgtttcaagggtatttcgtaacattttttgtgaagattcacacctctatttatcattggcatctttatttaaataacatgtaaatttaaagttatctatacagataaaaagaccattcataattctatgaacggactttaaaacttcaatattaattctatagattctcagtaaacttaatagctgatttcaccttatcttcatgtgcaaatatttttttcattctatttataggctgatctttttcacatgctcttttagcaatttgatataattcctcttcatcctctattccaatttgtttcatattatatggaagatctatctttttataaagttctttaaccttatcaatcaagtgagcatctttattttctaagatcaactgtacaatagttccaaaggccactttttccccatgcataaaattattatacttagaaattgtactcaatgaattggctatagaatgcgcagctgctagtgaaccattttcaaagcctacgcaacttaaataaataatagcttctataactttttctaaagactcatttacttcattattttcaacagcattaacagcagaatatgcattttcaattattgcgtcaaaacattcttttgataatgttcttgcagttaatgaaatgctacttgagccaaatttctcaatatcaccttcatatcctgcttctgtttcaaaatatgttgatattccatcaccaattccagcttttaaaagttttgcaggtgcatttgctattacctctgtatctacaattacaccatggggattgttgtctaaattaatatattctttaaatgttccatcactttcatataaaacagatatcctgctgcatggaccatccgtagaagctgctgttggcaccattatatatttcatgtttccaaaatgcccaacagcttttgctatatccaaagccttacctccaccaattcctattacacatttaatattattgctttgggatttacagatgatattttttatattttccatgcaacattcgccagtaaaagattgtattatataacttatattatgcttttttaacccttcactaactttatctttaaagtgcatataagaaaatccatccataagtattagtactttttcatcttctaaaaaattaaaatatgatgcaattttactcattgctcctttttcttgtatataacatccgggcatattaattttcatttgttatccaccatcctaataaatttaatatataaccctcattttaccttaatttacatatgtatgtctatttgtatatatcttacctgtctaccttaaaaaatcacttattcataatttacaataacatatactgttgtccgtaataaccaaaatgagtgtagtccatctaaccacactcatgttaaagttaatattttaatatttttaatgaatactttttaaaaataatctgaaaaataggaagtctgctgctcaattgcatcttctaacatatccagagtttctggactacatgtaagacgtcctatcttatgaagataatctggacgcttatatcctagaagcatagtagtcatggtctgaatatttattctgtcagtagttttattagttgaacgaacaaccttaccctttccatcctttgtaatattcaatgtgaaagttccttgattgcatgaaagaataggatcatccattataaaagaccactctctgtctattgtatcaggtttaaatggaaattctgcaataaactgctctaaatcaacaattctagccataaagtatggagaaattgtctcttttatatctgcatcttcaagtaaaaaagctaaaggttcatctgtatatgtattaccaataacttttgtaatcattgaaaaatgtgcacttataaagttccataatccactacgtgcttcctcattaacaaaaatcatatctttaatgtgaaaaatttcatctttaatccaataaagaacatatccatctggttcataatcctcattataatatacagcagccatcaaatcatcagaatcccaaagaaggtattcattccatgcaaggtcatcacgcactaatgcaccatgagttttaatagcaaatctttcataagctttttttaccttatcactttctacagctactctttctacatctcctgaaacctgcttgttttttggaagttgataatcattaatttcaaatgttattttatctgaaattatttcccatcctttccttctataatatggaatggaatatggatataaatacgatatgctctgctttgcttctttcatgttttttaatgcttgataaagcaacttgtgcataagaccttgatttgcatattctggataagttccaacacctgtaagaccacccatatcatatgttttattaaatatacgaactttcataggataaactgccacttgagatattagtttatcaccatcaaaccatccccatacatctgcacgttctaatgttggagacttggccctaatcatttccttttcttcccatccaatctcttgaagctcttgatttgtaacttgaaaaacatatcttaacagttgattatattgttcaaggtgctccaaaccaacttctttcatttttaactgtctacgcctgctcatacaaatctatttccttcctttcataagtatcttctttaaatatatttaatcaatgagattatttctttattacatacttattatattaggttatgcaaaaatttaatcctgtattctaaagttatacttaggattaatcaataaattaaatgttatataatatgatagttgattaattctactcaatcataggttctctatttttattaaacacttacctcattagttatattataccattatatcgtaaatatatataattattagaaatataaatacaaatcttaaaacataaaataaaccacaaaaatcaaattatatttctaccatttgatttttgtggctttattgtttactaaattgtaagattatttaagtttaattattttgataaaatcttttctatctcaaccacatacattgtatggtaatctttttctggataccacttatctataatatccttttctatgaagcattcttcttttaaatcttgtgcataaagctttctacaaattaatgttaatctagcttcatcaaaatatggaacatcttcatacttttgtacttttaaatttgcatttgaaatcttatcctcatcttttccagaaacattccctagatatgcaagctcttttctataactattaggcagtacacaaacagaaagtctatctgaaaaatcaacaaattcttttgtatatctttgaggtcttataaaaatgtacgctacttttttattccatagaacgccaactccgccccatgaagctgtcattgtattcacctttccatctttttctgccgttattaaaagccagtctttacctatcatttcaaaagcattctcttgaaaattttcatgtttaatttctttcataaattcatcattctccttgcctatttttaatacaaatttacttttaatgtgatattttattttataataataaagttttattatttttatttaattgatgccttaactaaaccttcaatccaatcttgatgtgcattaatcattggatttggtttttcaacagccatttcctttgctggttttcctatttgtgattcttgtgtaagaacacgtaatcttccacccgaaagattttcaaatagccatgcatgatgaacatctaatttttcgtcttctgttccttcacaccatccatgccatgctattcttgctggctttccatctattggtggaacaaattctgtaacttccccttcaacaatcaatccaaatgtagtgaaacgaaaacgagcaccttcttctaattctggtccttctatgttataaaaatgaatatcagtagcattactataatatttcggccattcagtagcattacttatataatgccatacatcttctgtgtttaaaccttttactataatttcatttgatgagtaattatcagttgttcctggagtgtattcttcaggccaataaatataattcataaattttcctcctaaatttttataatatactttctactattcttttaatatttaattaaattttttgctaaatttatgggtatttcataaggtatgatgatataataatatatatactatttttgtacaagtacttacttttttatcttgtactatcttttttgatagtataattaataggaggattaaatggcagacatacaaaataactataattgtgctcttgaacttacaatggatttaatcggtggaaaatggaagttgattatactttggcaccttcttgacggttctaaaagatttaatcaattagataaacttatacctgcaattactcaaaaaatgcttactacacaactacgagaattagaagaaaaagggttagtaaatagaaaggtttatcctcaagttccacccaaagttgaatattctctttctgaacgtggacgcagccttgaaaaaatattaaatgctctctgttcctggtcaaaagactatgcaaacgaaaataatatatctgtttcttgtaataaataaaaaataatagttaaataaggatactgctagttttagcagtatccttatttaaccttaatataacaatacttttatcatgaaattcaatttatgatataattattttattaatatcacccttaataagtataatatagttaataaaatcatactaacattactagttcaattaatataacccttaaaatatattaattatccattcatgccaattataaaaatgaaaggacatgattcatattatgaaagaaaaaatcacccaaatgatagaaaactttgtacgatattatgaacagcaagatactatatcaacaaaatggggcaagcctttagttggctttgctgatgccaatcatccttatattttaagcttcaaagaatttattacaccaactcataaattcccaactgatgtaatctcagatgcctctatagtaatctgttattttgttccttttactaaagaaatagctaaaacaaatatggcagtgggtgatctagcctctccagaatgggcattagcttatgaagaaaccaatgcaatgtttattaagctaaatgaatacttaatatctgaagtaagagactttggttatcatgctgatgtttctaaagaagcttctacctttgatcaaaatctactaaaaagcaattggtctcatagacattttgccaaagctgctggtcttggaacctttggtatcaataacatgcttattactaaaagtggatgttgtggaagatttaatactattgtgaccaatttagatgtgaatgctgatttacctttagaagatgaactttgcttatttaaaaaaaatggtagttgtggtgtatgtgtaaagcattgtccgtctggcgcattaactttaaatgattatgacaggcacaaatgctatgctgtattaaagaaaaatgcaaaattatatacagagtttgggagttcttatactgatgattctggtgattgtccaaacagtgagggtagcgaagtttgtggaaaatgtgtaataaatactccttgtacttttttataaatactatttctaaatatagtatttttattatcttggtataatcgtgggggattctatgaactatttctaccttacaaaaaggtaatccatatttaaactttaaatcaaccatttactcttactcctacccaagctctttcctctatttctaaagtttcgtgagttgtattatagacatagtattctttttgtttatctgctttatgataatttgcataatcctttaatgcatcattacccttctcatagctttttaacactgctaaatcagttacaattctctttccattttccgaataagcagatatagcttagaataatatccatttatttttatgtgtatctcttgcctcactatacttcatcttaatcactcctcgtagttatagtattattttaattatatcctatttacaaattctaaacatcatacttataaatattttatttaaatatatggctatgttttaaataccaactaccacaaaaaatgttccaagagctaataaaacaagagtaactattcctaaagtaatccacctattgcaattatagtaacaataagttcacccttagcagctgcttcaataccaaaacaatttataagaataaatatagcatctgcaactaatgctgctacaacagatggaacagctggtactaaaaaatttatatatgcacctattgatattgctatggttggagtttcaaataaaaattctactaaacatgagaatccagcaaaaaagccaccaaatttaccaagggctcttgaagcatattctgaagcccctcctgcatgagaaattgcagttgataattctgtataactaaacataaatgtagtataaaaaactgtaacaattaaaattgctataataaacttaatattcttattatttttgctataagaatattaataataattatatataatttaataacactaaagctagtactatttttatatttgcctaactctgctctcagacataataacaccatcttttaaattaatgattaaatccccatactgggctgatgcttctgagtgagttacttgaattatcgtttttccatattccttatttatatttctaaataactccattattttaattccattttttgagtctaaatttcctataggctcatctgctaatataatttctggctgaaataacagtgctctagctattgccactctttgttgctgaccccctgataattctctaggagtagattttcttttatttgacagttcaatcaaatctagtattgttttcaactcttctttataattttttacttttctaccatccagtagtattggtagtaatatgttgtcctctacagataaattaggaactagattatggaactgaaatacaaaacctacatcttttcttttcatttgcgccttctcatgctcttttaatttgctgatatctttaccatttatgataattgatccggatgttttatcatctaatccccctaataaatatagcaatgtagattttccacaacctgatggacccataattgatataaaatcacctttttctactgaaaaattcaaatctttaagtactttaacttcttcttttccaatataaaatgatttatttagattttttacttttacacttttcataaactttctctccctattcatatttcatttcatttattatagaaaactttttgccatttaatatcactggaattgttgcaagtattattaatataaataatactactgaaattattggtatatatataatgttaagcttaatgtcatataacaatcctaacaaacttaataagtctttagtcatagtaaccattgcccaagaacatggaattaacaaaattgttacccaaaacataacaaaaattgattgatatattaataatttatttttctgtactctattcaatcctattgcatgcaatagggctatatttttctttgaatttaaataacttattcttgtattatttaaaactccaacagaggctacaataactgctattagtgagaatactccaaaaccagcaatagttttttcattttctgccaaattggctctttcaagttctttaaaagttatcacttttacattataatcttgaagtaaattccttaactgattcctaactgtgtcttcatctccaatagtctgcaaaactatattgttagttccaatataattaaattctttttctaaaacttcattatcaataagcactacataaccgccatataacattttcatatctaccgttccagctatttctatatccttttctatattattaatatttaattttaatttttctccctcttgtactttaatcgctttcgccaggctctttgaaataatgattttaggttctttagagtctttaaactcattgtaaatccgcttattctcactagcatcccaatcaacatagccatcataacttaaatacttttttgaatccactcctgcaatttgaaaagcaactccatcctgctgtccagtaaaaacttttagtttctgcaatgaactttgaacaatttcactactatttagatcttgacttattattgtatctgcaatatttactgtatttgaaggaatagtaatttgaatttgaaagttatttctattaaatccatcagtaattgctgctttaacaccatcaccaacagaattaattgcaattactgataatgatgctattaacattaatgttatattatttaataattctttagatgttctgatattatttaatgcaagtgaaactattggtgttttatcctttaaatactgatatataagtctgacaacaacatcaattaatttaggaaatgcaaatgctatacctaaaatcagcaatattgaacttaaacttatcattccatcaatattaataaatctcactattattcccaatataataaccatcaaaccagctagcaatttctttgagccaattcgtgtatttgtatttgaagcacctaatattacatcttttacacttaattttcttatttgtagaattggtaagattgatgatagtacagataataaaactccaaatattacagttaatgcaaaatagtatgtgggaatttgtggattagcaactaccccataatctttatgttgcgataaaaagtatgaagctgcataaatagctcctacccctattagaaacgctaaaacaccacccaatattccaaacaaagagctttcagttaataaaacaaagataatatttttctttgtagccccctggctaaaaaacgttcctataacaggcattctttcaactataatcagcttgaaagaactagaaattataactgcactaagcaatataacaatggtaagcaaagcaaaacatattgttcttccttccttaattgcattaagcattccttcatgattcgcaaaacttgtctctgcttttacctgtgtattgacatcattaaattcatttattgattgttccactgtactagccgttttacccgcaataatcttattgtattttgcattactattaaacttactacttaaatattcatatggtactattacattaaaagcttcatcagtatctccaaaaaaaatcccctcgtttaagtatatgccctgtactgtaaagggtattttttcgttatttataactatgttaattatgtcattttccttaatgttaagttcagtacttacacgctttgatattatacattttgcacctgtaaaattcactaatgcattttcttcacctgcattattaaactgaatatcccccttttttcttcccaatattgttacagtactattatccaaatcctttttataccatcctttaaactctagttgtggaataacatcttttactccttttaaatttaaagaatctacactaaataatgaatcatctgtattactaactatcgcaatctccctgttttccataacttgagtatatgattctgtataattatttatcataacatcggtaacacctatgctgactataaataatgaagtacttattaaaattgcaaataaaagtaaaataaattttcccttcttctctaatgctgatttgataataaatctaagaaaaatgttcattgattatccaccttctttttttcatagaaaagtaaattgtccatcaacttattattctcttctcctatcattttttatatcactccttttcttatccataagtttattgtattctacaaatctgatatgctactgatataattctgatatttttctgacataaaaaaaggtgctgtcgtcctaaataaattagtgcatggtccttttctatataaatgaaaaaatctgtatcaaattgagttataaaaactcaatttgatacagactctttttaaacatcttctttaaaactatagttattaaatataaatgccacacatatatcttattctagcaatggcaattgtacagtaaatactgtatattttgattccttactgtccacattaatggttccccccatctttttaacaatctcataagcaattgctaatccaagtcccccattttgtgtacgtgatgtatccccttgatacaatctatcaaaaataaatgtaatatctttcttactgattccttctccatgatctataatatctatgcagacattttttccctgcaaataaacttttacacctaaataaaatcctgattttccatgagtaagggcattacgaatcaaattttgtactactcgcgtgaatgatgatacatctacatctgcgaaatactccttatctggaatttttacttgtaaaataatatcattcttttctacaataggaataaaatcaattattacgctacgaacaagttcacatatatctgacttctccctattaaaatgtatttcattagcatcaaggcgaaccaactcaaataatagatctactctttgttttaaatcatatgatttttttaaagctatatctaaataaacatctttttcagtattatgaactactccaagtatcacagcctcaagataaccaattactgatgccaacggagtccgtacatcgtgtgaaatattagcaagtaactgtttacgtgccatttgctccctattcactgtaatacgttccttttgataagaatccattaattgatttatcaacagcgacaatttggcagttttatctccattataactaaacaaatgaaggttattattacctttgagtacttctttcaaaacatctgtgatttcattaatgtgtttatgtattctcatatatttatttacaataataataaatgcagtacacaaaattaatattataatatataagataatatcaaatttcattaattgccctcccaatgaaatctatatccaactccccatgctgtctgaattaaaactggattttcagggtcgtcctcaatttttttgcgtgttctccttattagtgccataatattattatcattatatatatactcatctttccatacctgttgataaatttgtttttttgaaaatacatgttcgggatgacttgccaaaaaacttattagttcaaattctttagccgttaatatgacttcattgccattcttaattacaatacgttttattaaatcaatatgtatattcccgtaactaagttcattaattgttgtttcttgtcctccaagtgtagtaaatctgcgaattaaagagtctacacgtgcacttaattctgaaagaccaaatggttttgttaaataatcatcagctccagactttaatcctaatactttatccaattcttgatcttttgcagaaagcattaatacaggcatattcatgctttgacgtatttctgtcaatactgttaacccactaagctgtggtagcataacatctaatatgactaaatgataatctccttttctcaccatttcaagtcctttaattccactatgcgccattgatataacatagttatcattttcaagacacttcttaagcaaattacaaagttccttatcatcatcaataataattattctttttatatctttcattttattttccttctttttatataacttgaaatatattaccatttaactctattatatcaaaataatccagtcatgcttatctcttgtattcctttatttcatgcgtcctgtactttggaatataataaaattcctatcaaagaaactattccaattacaatcaaactgatataagaatatgtaatagaaaaagcgtactcaatactcaatactttgatattgcatatccttaaaataataacaataggcactatagccgataatgtagacgaccatatagctacaatggatgtaattgcatatactattatgacatatatagaaacaacataactctttttgctaattataactattagaataatgggtaatattgaaataaacattaatactccagccattaagtagttttctaaaccttctaaaaaagttgttacgttaaaagttatgcctatagttaaagcaattatatttaataaatacgaaaaaattgtcattatcataatcagcaaaaataatgttattaattttgctattgcaagttgtattcgtccaattggaataatcaatagatttttataagtattttcaatacgttctcttacaaatataaatgttcctattaatccaaatatacaaggccataataataaaactgaaagcaataaattttgggttgaataccctatccaaaagctttgtgcattaattttagaatttacaacaatagacattataggtaaaatagtgcaactaactaaacaaatccataatatgtttgaaccctttaactttctgaattccgcactaattaatctacccaatggtatgccctcctgttacccttataaagtattcttctagattgcctttattcatgctaatttcacttacaccaatggaagcattatttagaactctattaacttctgccatatcacgttctatctcataaattttaagtgtattatcatcttctatctcaaaatcaaaaatccccaatttgctttctaaaataggaatagtttgcattgcattagaaaccgccatctttacatagtgacgattatatttaccaatatcatccatataagtttcttcaagcagatttcctttttcaataatacctattctatctgcaagttgttccacttcacttaatatatgactagaaattagaaaagtagtgtttttttgattacataaatcacgaattaatactcttatttgttgaattccaataggatcaagagcatttgttggttcatctaaaataattaactctggttcatgcattaatgcaagtgcaatacctaaacgttgcttcatacctaatgaaaattttcccaccttctttttgttttcacattctagaccaacaagtattaatgcactattaattgcattctcattatgaatacctcgtaatgaagcaattagttctaaattctcctgggctgttaaattctcgtagaaggacggagcttcaattaacgcaccaatacgttgaaaaactttggagttatttgtatttaatttttcaccaaatattctaacctctccacttgtaggctttaataatcccattatcatacgcaaagttgtggttttaccagctccattacgtccaagtaatgcatatatttctcctttttttacattcatatttaatttatttacaaccacttgtgtaccatattgctttgtcaaagcatttgtatccattataatcatattttatattatattcctttcttttaaataattataatattattaataattataacacttatgtaaatttttgtttttctattttttacattattattgtgagaatatcgcaaataaagtatacttattatggattaaaagggaggaataaacaatatggagaatactattttcagattaaactcaaaagggaagcttgttcttttagataacacattagaatattataatagcgctaatggtaataaagggaaatctatcaacctagatgaaattgtttcaataattaatgagataggtaaaaatgaaattaaattatgctttaagaaaaataataaggttaagaaatgtgaaattacatttgataacgaagaagaatgtgatagattttttaattactttgataaagatatgcttaataatatttcatatcaaaagacagaatacaatttaacacaaaaagaagcgctacagtcaccattatcattattaggaaacattattttattattagcttgtatttatggtgctatgtttatatcagaatttgctttagcaacaagaggaagtgctagaattcctgtaatattattagcaataattaaagtgtttaattggattggaattgagaagattttaattatttttggtattataacattctttttactaattaatggaataaagagatttaagaacccaccaaaggctagaaggatagagttttataatgcactaatcaatagttaaggatataacttatataaatattataataaaaagataaagcttcagaaaacatcataaaaaaacaactcttttgatagtttagatagttttgtgtaattaatatttttatcaagttaatatcactggaaattttgatttccagtgatatttttttatatttaagaaatacttcctataacttaaggtctattccacttttcttttctttaagcaaaatttctattaattgtacaatctgagcccctgcttctactggggcataccatttttgtgtatattagaaataactgttctttgagattctggctttttactgcttgcttcataagccatataacagctcatactttcacctgtagcaagtcctggtctttcccctattaaaattaatgtaacctttgcatttaatgcttcacttattttatccatagtagcaactcttgcatacttaacaaagattgacgttccaattttaagtcccttagcttcacatccatcaattattataggataaatttcttttaaatttgctgttatggctggtgaacttaagccatctccagctataatctgtacatctacatcatttatacatttttcctttatgtcagttaatgtttcttcagaaaagcatcttccaaggtctggtcttgttatatactcttccttatcttttaccaatgttttaactttataaaaccctaaattctcaactaccttttcatctacatgtgaccaaactgcatccatagcaactgcatgatctgctctaagtcttaaataatcacctgttttatatcttgaacctgctcttcctacgcaaattcttgctggtgttgattgttttaaaatcattaaccctttatagtcaattggattatctactgagactttagtatttaaatcaatagcagatatatcttctaaaatatccttctccatattttacactcccatacctagaaatattgacggatctccagctttacttgccaacactccatttttcattattccaagttcctcaagtctagtttcaaattctttaattggtcttttattagttacttcccttaatgctgcaatatcatgataacttgaagattgatacattaacattacatcatctccacctggaactcccatgaaataattgcaattagcttgtgcaagaagtactgctaaattttctaaatcattttgatctgctttcatatgatttgtatagcagacatcaacacccatagaaagtccagttaattttcccataaaatgatcttctaagccagctcttatgacttgtgccccatcatataaatattctggacctataaaacctacaactgtattaactaaaaatggattatatctttttgcaaatccataacatcttgcttccatggtaagctgatctgctccattatgaccatctgaagataattcagagccttgtccagtttcaaaatacataaaattattacctttagaagatttcaattctctcatcattgcatatgcttcatccattaattttacatcaattccaaaactcctatttgatatttcagaacctgctatactttgaaacattaagtccattggagccccttttttcagtgcttccatttgagttgtaacatgtgctaaaacacaattttgagttggtattttatatctatccataaagtttttaaaagcttttaatatgttagaaacactatcaatagtgtctaaagctggatttaagccaattacagcatctccaacaccatagctaattccttccattacagatgccattatcccttcaatattatctgttggatgattaggctgaagccttgctgaaagtgttcctggcattccaattgtagtattacaggttgctatattaccgagttttctagatgtacatataagatctagattactcataagcttggttacaccagcaataacttctgaagtcagcccatctcgtatttcttttatttcttctccattagatgataatagaaattccctaaactcacctatagtcatctctttaattctattataaatttcctcattaaccccatcttgaattaccctggtaatttcatctttatcatagtctacaactggattatttcttaaatctccaatagtaagttcagcaagtactacctttgcagccactctttcttctgttgaatttgcaataatccctgcaagtctatcacctgatttttcttcatttgcttttgcaagaacttcctttacatctttgaaattatatacatttccaaaaagtgttgtccttaaaatcatatacgtcactccttatagaaaaagtggctacaccacttctttaattcataatttgcaatttacaattcacaatgtattaaatcctaatttagcattgtgaactgtgaattttacatctttaaactgtttcccccttaagtccttcagtaatctcctgactgtctgttccttgaattttagaatacacaaagtaataaattatggccgctacataagcccctactacccaaagtacagttgaaaaatttgaaacaattagtgatattaaaaatataaatgctattaaaagtgctacagcaggtacaactggatatgcaactttaaatggtctattaagatttggctctttgcttcttaagataaataaagaaatcatacttataatgtatagggcaacagctccaaaacatgatataacaatgattacagcagtttgtcccgttaatacgaataccattccaattaaactcattattactatagaatatgcaggtgctcctttagaatttgtatttgataaaaacttaggtaagtatccagctctagacattgcaaaagcttgtctagaatatcctataattattccatgtaaacttgcaactaaaccaaataatccaataaaactcattccatttgaaattaagccatccccataaactcttttaagggcatctggtaatggtgaacctgatgtacttaatgtactaagatctgaaataccaactaccacaaaaaatgttccaagagctaataaaacaagagtaactattcctaaaataaatccctttggaacatcccttttaggattttcacattcttcagcagacattgctccaccttccacagctaaataaaaccaaattgcaaaaggtattgcaccaaagactccattgaatccgcctttaaaaatatctcctccaaaaatattactcatttcaatatgtggagcacccgctcccataaataaaagtaatccacctattgcaattatagtaacaataagttcaaccttagctgctgcttcaataccaaaacaatttataagaacaaatatagcatatgcaactaatgctgctacaacagatggaacagctggtactaaaaaatttatatatgcacctattgatattgctatggctggtgttgcaaataaaaattctactaaacatgagaatccagcaaaaaagccaccaaatttaccaagggctcttgaagcatattctgaagcccctcctgcatgaggaattgcagttgataattctgcataactaaacataaatgtagtataaaaaactgtaacaattaaaattgctataataaatccaactggacttgtaaaatctaaagcattattccacccacaatacattcccgatatcaccattccaactattatactccaaagttgtattggtttaagtgtcttttttaattcattattcatttccaccactcctagtatttattttttaataattgtttcttttattaaggaggaacttaaaatatttttaatttacttattatgacttcagttgtttatgtaccaatatcaacacctatacttaatatttgattccttaaaatatattttcacctccataaactaaaaaaaggcaatggagtcaaagttacatttgactccattgccttctgtacataatcaaataagtactattaaaataatgttttaattaaaattcattttaaaaatgtaattaaaaggaaaaaagaacgcttaaagaaaatatttctttaagcgcccttgcttaatctaatgataggattatatacctatatttataccttgtaaatatgttttcacattttgttaagataattaattaaaatgaacttaaaacttaattatcttattattttggcttctataaatcactactaatctatcatatggatgattgccctcaaaattttctgctatatttttttcatataaatcaattgctttgcttatttccccacatttttcatattcaatatctttcaaatttctatcaacttgtctatcaaatttattcatgatattctagcaatctccccttaaagtaatattttgctaatgtcaattaatttattacttgaaatccatcatagtaaatcccaaatttatctccttctatatgataaaacatcatgaatttagtattaatttcagtaattaaatacccatttagcgataattgtaatttgaattgcaattctttattataatttttaaattgttcctgtttcttaatttttttctaaaaagttatcagagttatgctttaaaatatcaataaaatatacttcattattagttagtttaataaacaataaatatttttatctatatatataaatccaaatttttatattaaacaccttgaaaactactgcttcattttctccataaaagccactgaactcagtgactttctattatatcaatattatagtttatgtatgattgaggagaagcgtggcctttaaaatccaccaagttttatatataccgcgtttcaaagtataaccttagtaactatatggataaactattattttttaatcaataaattaatctaattcttctccgtttgattcaataacttttttataccactcaaatgattttttcttatatctcttgtatgttccatttccttcatcatctctgtctacatagataaaaccataacgtttagacatctgccctgtacttgctgcaactaaatctatgcatccccatgatgtataacctattaagtctactccatcaagttcaactgcatccttcattgctttaatatgttcttttaagtatgatattctgtagtcatcttctacagttccatttactaattcatctttagctccaagcccattttcaactataaataaaggcttttgatatctatcatataagctgtttaatgtaattctaaggcctaatggatcaatctgccatccccattctgaagcttgtaaatatggatttctaagtgttgcaaatacatttccttcagtttccttatttacttctggatcagctgatgtaagtcttgaagaatagtagctgaatgaaataaagtctacagtattttccttaagtaattccttatctccatcttcaaaaggaaccacaactccctttctttcaagttcttttaatgcatagtttggataatatcctctagattgtacatctacaaagaaatagccttctctatcagcttgtagggatttaaatacatcattagggtttggtgtatttgcataagtattacctgctgcaagcatacatcctatcatgaaatcaggatttatttcatgtgcaattttagtagcttttgcacttgctacaagctgattatgtgccgcagtatacttaatttgttcttggttttcaccttcttcaaatactaatcctgcacctgtaaaaggaagatgaagaagcatatttatttcattgaaagtaagccagtacttaacaagatctttatattcattaaatagaacactgcagtatttaacatacaaatctactaatttacgatttttccatgatccatattttgttacaagattcataggcacatcaaagtgagcaattgtaactaatggctctatatcatattttctacattcttcaaatactgagtggtaaaaatctaatccttctttgtttggagtgatatcatctccatttggaaaaattctagaccatccaatagacattctgaatgtcttaaatcccatttctgcaaataattttatatcttctttataatgatgataaaaatctatccccttttgagctggataaaaataaccatcttcaaagtcaaacatctttctctttcctagagctacaggaaatctatctttaccgataggctgaacatctacagttgcaagtcctcttcctccttcattgtatgcaccttcacattggtttgcagcagttgctccaccccataagaaattttctgaaaatcccattatataaaacatcctttcataatagttccggtattaaaaccaatgccagaacttaatattttttacaattttgtctatctgattttattatttatctccatataatacttaatttattttataacagttattaaagtatcattatttgttattgcttttggtttagattcaataacatctaagaagctatctccattagtaacaacaacaggtgtttcaacagaatatccttcttttttaattgcatctatatcaaattctaaaataaggtctccgactttaatcttatcaccttgtgatgcatgagctttgaaatacttcccttcaagctgaactgtatcaaaacctacatgaattaatatttctgctccatcttctgatgttattcctattgcatgaaggcttgggaataaagttgtaagttctccatttacaggtgatttcacttcacccttgtttggtactattgccatacctttgcctaaagctccttgtgaaaatgctgcatcttgaacttcttttaatggaatagaattaccttcaagtggtgcttttattataatttcacttttattaagacttccattatttataacttcttttttattatctgaagctttttttgtatgttcttttacatcatccttgtaagtaatcattgttgctgcaaatgataatcccattgaaattgttaagcagattgcaactggtccaaaccatgctcctccatctggatttataaatcctggtattgagaacacaccaagccctgccatctgataagtaagactgtttgtaaatcctaaatatgcactacctaaagcagctgctatacaagttataacaaattgttttatccttggaagagttattccgtatatagctggttcagtaacaccaaagataccgctaatccatgctggcagagctattgcttttaactttttatctttagtcttaagccaaattgcaaaaaccgttgcagtttgtgcaaatgttgctgcaaagaataatgagaatattggtgaaggctgtcctgatgcaatttgcattattccaatggctacaattgccatgtgtacaccgaataaaactaatacttgccataatccacctagtaatattcctgctattactggactcacattataagctcctgtgattccacctgcaatccattgtgatactacattagctgctggtcctataagcataaatccagctggaactgaaattaataatacaagcataggtacaaagaatgtttttattacatctggaataattttatttaaatatttataaataaatgctgcaaaaacatttgtaataataattggtaatactgaactagaatatgatacattaaatacatgacccaaaatttgtaaatcaacattttgataagttggataaactaaacccgcaccaatcatcattcctaagaaatgattcattccaagtttattagctgatgtgtatccaagagctattgggaagaaataaaatattgaatctccaatcccattaataagtgtatacaatcctgagccttgatctatgaggccgaaaaactgtactaatgcaagtccgcctttaatcataccgcaggctgtcatcatagcaagtattggtgtcattacgcctgaaataaaatcaataattgctgcacctattccttgcttttcctttgtttcacttcgagacgatgatcctccgcttattcctgcaacttcacatacatcatcaaacacttctgtaacatgatttccaatgacaacctgatattgccctgcgcttttaacaagcgtaacaacaccatccatattttttattacgtcgtcatttgccttagattcatctttaagcttgaatctaagccttgtgatacagtgtgttaatccattgatgtttccttttcctccgacatttttaacaatgtcctttgctaaattttgatacttacccataatattttcctccattttctttaggttaatatatataggtttggccaacttaatgtaaccatccatagctaaagcaaactataaagatttgctctctctaactacttttgcaatgtgaatcgtaaggtataaacattcctcatcttctaaatcataattatattcatcatataaaaattcttttattttaagagtacatttatacatttcactatatttctcttttaccatatcaaataaatccgtttctttatcatcagtataagtcttactattaaatactctttgagtaaagaataaaagatgtgttacaaatctataatatgataaacattcttcatcatatattattttaaaatgatatttcactatatttaaaatatcagtcattgtcttagttatatccactgctgtcttcatattagtttcaagttctgcattcactatatgcatcgttatgcttgctgcttcattatcatcaaaattagaaccgagcctttcatttattctgcatactacatcgcgagcaatcttaaattcatctctatatatcctctttatatcccaaagcattgtattttttacatatgcattggttgtggctctctcaagcagtgtattaatatgatctgttaaagttatatatatagaattgttaagttttttcctagtgttgatttcacataattaataaggttttctatgaattcaaaattcactaaatcaatttcacttaaaagttttgtgaaatgactgaaatcgcagttcttttcatctgtaaatactttctgaatcctatcctctggtattacctgtcccttttttgcaccaaaagcaaggcctcttcccattaccacaatttcctcatttttatcattttctgaaattacaacattattatttaatatctgcttaattatcatatctctctcctaaaaataaaaaacctatctacaaacgcacacattaaaataaactttaatgagcatttataaataggttttgcataacttaatattaacaatccactttatatttagtatattacaccctttagaaaacgttgtcaatatttttatattattttttacatttttagctatatccttaatttgaaaatactatgccataatttttttatctatttcttctaaagaatatcctttaaatccccatatgacataatgtttcctcatattatccacagactttactatgcttctaaatccaaactcacttaatctttttactttttcttttataaaacctccaatttcttctgaagtcctaccttctattatcataaatttaattacttttatgatttgctttgatgcttttaaatttttatatatcctgttcaaaattatctttatatctttttcataatggctctctctattaataatatcagtcatctcagattcatgaaaatatttataccttaaattaatttcaataatcttcatcttcatatatggtctatcagttatttttaaattatagtataattgttcaactatcaaataaaaaattataaacctctaataataatttacataataaaactgataataggatttgttatgaaatcctattgtcagtttaaaaataagttatatataattatatataacttattttatgcacctgctactgcatttttcttagcatctgcacttctttgaatcattcttaaaatagctctgctcactggtccagcaactaatatatttaagaaaaatgctgcacagaagtttcttggccatctgataaagaattcttttgtaacaagagatagactgtcaccaccaagcatacctccaataaatgtcataattaaagacatgcaagttacgataaagaaacagttaaatagaatccttgcattaacactatccttttctccacagaatttttcaagtaacattccattgacttttccaacaatagctccttcaattatgaaagctacgataaatgtaacgggaaatgcctttaagcatatgatcattacttcaccatcaaacactccatgatgtatagaaatattcaacattcccataaaaaataccataataacacacatagttattccaaatataattccctcttttttatttcttggcatagaaccctccttgtataaaattattaattatttatcagttagaatttttactgtatttatacatacatacccctaacgaacaaattgtattatagcatgtaaaaattttgcgtgtaagtatttttttattaattccttatgattaatatttgtctatttatttaaattgttgaaaactgaaattctttatattttgcaaatttttcttttactattaatgtttataagtgcctcaaattcctcttcaatcatttcatattcataaaatctattatctactggatatctatctataataaatttactatccaacatcctaagagtaaaataatcttcgtttcttaattcatctactaaatctttttttattgcgttatatatcattgctgtttcatgaactgaaagctctatttcatacttttgtattgctaaagtctttaatattctctcgatagttccatgaattaattccaattgtctttgatattataagcttgctttattagctaacatagcatctcttagcatcacatttgcatctgttttccatatcttatacttttctttatttatatttttaggcttaaacttttttagctacctgatttattggttctacattctagtgtgaatctttcaattaaatcttccatgactattctcttaaaaaatcaactacaacactaatattatgttctctagcataatcctcaatattactaagtatttcccctaaatttctagctttcataccttcttttacataaacttgtataacaaaataactaactctaacttgtaaaaaactattcacacaagcaaccatttttttattgtctttttctattatgtgttcaggttcaataaataatatacttcctatcactgacgcaaataaataagtacaaatggctatgattgttacaacagttattcctgacttaagtataatactttttactttattacatataattcttaaagtatgtataattattatgataagcagaatagattgtcccaaccataatgcaatcttaggtttacttaataatattagattgttaacatttagaatatattccgataacttacttatgaaaattaaaactataaaagcagctaattcaataagaataactttttttctatgtgagtttattttcttattttttaattttcctaccaatcccccctgtaattcgcctatctttccaattataggttattcatattttcacaattttacgaaagctttttcatagtttatcattaaaattgttcttgctgcaccataattaatataaataaccactaatctatatctacattaaaataatatttctaacacaatcaatgtatttgaaagactaactatcatttgaactgaagaaaatttcataatttgaattaaaaaaagccttttttataggcttctttaagtgcgtccatttttacaaacatataatttttgatagcacgttactgaaaaaaataagaaacggagctatcactaatgggtttttaaccctgccgatgcgacagccccgtctttcatggatttcatgtctaatgactatgattttgatacaatttagtgaattttttaatggagttattgattttaatatcgctaaaaagtatagaatttctgctaaaaagtgcacacatttgtattgatatatttccacatactagctgcggagtattggggaatataattctaatttttcttatacataatcaattctaccaaatctataacaagttcagccttcattaaaaaatctaatcctagcaagccattaactctttcatttggatcaatttctccaaaatctattttaaaatcttttaattcaatattattacaagcaataccatcaattctctttctaacagcataactagaagctccaccatatcctgatgcctctataagtttgtcatcatctgcaaattttgctcctaattcatctaaaaaatctgttgatattattgtatgaaatgcacctgtgtcaataataacattctctacaattatacattctccctcatgcattagttttatagatgtatataataatccatcttttaattgtattttactgttcattatatactccttctaataccaacatgtctaattttttctattgtaacactttcattttgtgtactatatactaattgaccatttttacatcttgtaaactcttgcatagcttctcttggatcttttatagcttttattattgcaacttcatcaacatatttaattttatcttcttcgtgatattctataatttcaaacttaacaaattgattgggatatagctctctaacttcttgccacttcataaacagcacctcttttcttatattttttaatctagcatttaatatatcttaattatatcctattaattaaatctaaacatcatattcaaatattttgttataaaatcctttctgccaaaaggtgcacaccccataataaaattctactaatgggtgtgcacaaatactcaaaatacctaaaaagtggctaaaacatccattaaaatcatttaaagaattatctttataaagcaaaatacaatggccaagccttgatttttcaaggttttaccattgtatcactttcttagttcttatttggtggaggtgaggggtgactattagtaccctcgacttcaactataattatcctgatatatattctatagttgcattaaacgcaatattgaatattcttcttgacctaactggtccaattaaataagctttttgtaaatcctgttcttttccttttaatatatcttttattgtaaaaaagcctacctctttcaatgtatttctttgataatatggtaaatctagtttatctattgaagaactaagtatttcatctaaaattgacgttctagtttcctctgtgcctaagtaatctattttatcaataccttcatatgaatatgaattcactccataatctgtaaatagcttaatagataaattgctaattatctctttatatctgtttacaggtgtactcttaacttctgatgctaaaacaacgccaaaatttatttgatacctatcatatacttctgttctaacctttgtaccttcagtatgcaagcttactatacctgaatattccaatattttcatagcttgttttactactagaggtgcatctctatgaattgcaaaatatattgtttgattaatcttttcatcattcaaccttttttcatttttattactagtttcaactaaaaccttgttttctataaaccatctaccccagtcaataatagctttatgacctttatatatttcgcctaactttgtgtgttcattccatatactagttctataaaaattctttatagtcgaatttacattcccaattttaaaactatgtaattctccagtagcttcatatatactttttaacaacaatctaggattacctgatgatgcatatattaaagcattaaaattatcaccttgctgagttaacattttaaacgtttcatcacctaactgatttttaactatctctctcattttatctacatagtcattagaattaatatcacgttctactttttttactattgcatcatgaaatgcttgaaatgttccatatgatgttatgccaggatacacagcagctttacaactaatatatggacatctcaaatcacgaaataacgtgaaaaactctctttgttgtataggaatgaaattatgacaagcttcatcaaataatatggttattctatcgattccataattttcacatatttcctctatcataactttaaaatagtccacatctcttaaaactcctatcctagctgcttctacttctaaaatagaatctaattgtggtaaaatttcaaaatctttattatgccaagaactttccataacatcaataacttttgttagcttgtctattatttcgtctccatcttcattcaccccaaaatatttagaaaagattttaggattactaagtccaattcccattttggctaattttaattttaatgataataatatttttgaaaacatccattgcctaaaatataatatatctcttgaagtgtccactaaaatagctttactaaagcttacaaatatagccaacacattatcctcttcatattcattatctaactctttttccgctattcttaaaagcatagttttccctgtacccctgcttccaaccagtactcctggtgatttcctcttaagaaaatctatgttctctctatcattttctgtttcaacaaatatatcttttaatttagttaactttatgtcttctgttctaaaaataaattcaccttcataattactcactatatacacctaccttagccaacttaaactctcttataatttcatccattactatctttttatcttcttctagtttttctattttattattgaatcgtatacctataaagacaatcaatatctttactaccattagaaacatttgactccacacttcaaaattttctttattatatataatattttgctcatttatttttgtatgcatatattcatatttcccatgtacatactctgaacattctctgtaagtattttcagtaatatttattaatacctctaaatctacttgattattaaacaacgctaaatattttttagatacaactccattttcataatttttcaatgtagcccacttcatatcatattcgttcttttgccataataaaaagtcataattattgtctacaaaatatatgaagcttaaccccaattccaaggcacttcttaaactaatatatccatttctatacataccatttgatactataaacaatgatgtaagtaaatcataacaaacctcttttaatactatattagcttctaattcgttcgtttcaactacccatgaatctaataaatctaaataaattatcatttcagacaaactttgaggattattttcaattgtataattaatattttttcttaaagaatctgtcatatccttcattatacttactacatcatatctactcaattctattcaccttccaaattgtttacacatattttatttagtatatttatattaacacgtttttcttttatttgccaatattccattaaattattgctattttttatctacttaaccataccaaataagttatatgtctaattatgcttttttcttatactccatatactagacttactgctaaatttatacttattatcttctcccaaattaagacccacgttgaacactacttcaacgtgggtcttatatactataacttctttaacaaagttttgtatgaaatttttacactctgggatattcttagttattacatcttctttgaagccacttaaaagacctcttatatcttcttctgttaccttagtaactgattggttggcttctagttctatcagctttccttctaagtatatctttctatcttttagctcttccattttaatcttaaactcttcttgcataaatccattagttattgcagttacaatattattaatttgcttttcaacttcttctaactccttttgaaatacggatttcttatcttcatcgcctttattttgctttcttaaattttcattaatgccttcaactaaaataggtattgctttatcattaaaaattcttgcttcaagctctgttaaaacatattcttcaatgtattctttccttatttccttgttgttgcaaacattactgcttgtacgttttctgcaaccacatctatatgatacatataatggcttatccttaggttttctacgattaccatacatagaataaccacattcaccgcatttaattattcctgatagcaggtagctttctttagccttattaactgcttttgattttttcctacttctaagaatttcttgagctttatcatataactctttttctattattttaggcataccaccttcaattctaattatttcactagaatctttttgtagatggctatttcttttaccaaaagcatcttttttagcagacttattaaaaacataaactcctgtgtatttttcattacttagaacactattaatgctattacttttaaacattgctcctaccttagttttaaaacctcttgcatttagttcatctaccatttgactttgggtatatcctgtaacatacatttcatatataagtctaacactttcagcctctctatcattgataacatacttcttatctgaattaacatcatatcctaaaggtggaagtcctcctgtatgtttagcttgataagctgtttccctcatacctttcattacctctctagcaaggtttttgctgtaatactcagccattccttcaataacactttcaagaataatagactctggactcccatctagattttctgtaacactaataagctttactccattttgctttaattttctcttatattgagcactatcatacttatttctagaaaatctatctaacttatgaacaataacagcatcaaagacatcattaccactatctttaatcatttgctgaaactcaggtcttttatccgttgtagccgatttagctttatcttgatagacctttactacttcatatccattagattttccaaactcttttatagctcttatctgtgcttctaaactctcatctcgttgattatctgaactatacctaatatatgcacaagctcttataatttcaacaaccttagattttatcaccagcattcactcctcatatttttactccattttcttgagaatctaaatacttagaggttaataccttaactaaagaatcatatcttattctactattaactttttcatctattattacatcttcaatactgtccctactgtagtttctatcatataatttatccctgcttatagtagtcttaatatatttcttcattagtaaacctcctaagtacatcatttttataatatatagttattagcttaattaaatacactatcttgcttcaagagcatcaattaaaatactcttgaagcagtgcatgttaatttaataatttttgcatatactcttcacaaaaatagtatcctgaaaaatcatcatctaggttcttgttaattgctatactcgttttaccatcttttctagctgtaaaaactttaatacctctaatattcaaattaagtctaattttcttaagttctgtttcaaatatatattccataccaaggtattctaaattattatgatctccttctaatgcctgcctaaatctattaagtataataattaatttatctaaattaccttcccacctatgacatccatttgtaaacttaagaatataatttaatagtagattactttcatttcttctaatttgcctcatttcatttttataagtaaaaaaagtcttcttcatcttcttccctccttgcttttacaaatggttcttcaagaaaatctataaccgtaatcacatcaccttcgtaattaaagttattaatttcaaaagtatattcttcgtcaaaacatgattctttttctttaacaatactattttgaaaagcaaagttctcatcaattttaatttttactaacctataatcatttaaatagtcttgaaatatctttaatatgtttttaaacgttctaagacttataatttcgttgattttcttatttctccaaactactctaaaaaaaccatcttcaatatatattaatgctggttttatccttaacttctgtaagaatattttaagttcctctaaatcttcattgatttttaacttattaggtaattcatatacctctaaatcaatagcatacataagaggaactaagtcctcttctgctactattttaaatggcaccaatgcagtaacatctcctaacctatacatattactgatttccgtttcattactcttattattaataatttcattaaaagaattgcctttaggtttaagcatcattttttccattaatacactcctcacttaatctaaaaattctttccttatatgcaacaatcttggtcttgaaatagtaccatcatcattcttaatagttttctttgttacattagtggtatcttcacactttattattccattgtacgctaaagcttttagcaatcccttaataggtaattgcatatacgttccagctttgagcaacttagttctaactaagccataaatattagttgaattaaaatagtaaaactcagaatcatagtatccatctgtaggcttgtacgtatttcctactaattccccagtttctaaattcttcaatgttattgacctgcttgttattaattctttaacagtttctaaaaacaaatctactggattgtctaactttgaaagctcatgtttagcttttattaattctagaaattcacttttggcctcatcaattgattcattaacttcattttctgaaactattccaattgatgtaaaaaattgatacatcatatctaatgaacacagcaaccatgcaaatgcctcataagttcttccatgtgttgcaattgcattttctcttaattcctcaaaaaataattataattatccttaatagcgtctaataactcttcactattaaactccatttcatctgcaatccatagaatatattctctcattacaactgttaacaattccgtattcttttgagcctctgttaattgttctaaattaacactctctttttttaactctaaaggaactactcttgctactgtagaatttcctggtacaattgtttctcctgtaattagagccatccccctaggaataaattgcgtttgactatccatagtaacatttaatctccctctagatgttctatcaccatatgctcttacaattttttctgcaattgtattaatattttgagtttccttaaagctttgttgaggacagaaatcatcaagaagcattagtgaatcctttaacttttaggcttttaactcaattgatgaatatgtatcattaaagcttgcagttactctattttcaaaatcaccaaaataagaagcaaataactttgctattgtggttttacgggttccagtgaacccatataaccaaacaacaaactcaggtaattttgacactttcccaatatgctccaataaaggacacagaaatactaatgccattaaaacatatgcactacctttatcaactacatttagtaagctaaggcttgcttcggctgctttagatacatcaatatcttctcttgaaaatctataattacttagatgttcatcaatatctaccttaatgctgtcatttgttatagcaccatctgagtctgaatatactaattttccattagaactctcaacccaccctatactattataagtatccacaacctccacatctttaaataatttcttcagtattagaagaaactcatttttcctaccatcagctataattgcatgcatacctagtttcataggtatccattgcaacttgtacatctctaaagcaggtaagtttatttcaatttccttttgtccatcaacacttactccagctgtagcatacatttcctctttaccattgatgctttttctaatctgacttttaggagctactatcatatttgtaaaaaatgtattttttgagtcaaaaacttgtccatctttagttatttgatatccttcacttattaaaattctttcaacatcacttctatgcattcttaaccacctcatattctgctggaatagtttttatttcacagtagccacatctgtaattaagttcttcattagttaagaacctattaagcctttttagcacacttataccatcttcatattcacccaaaactataaattcaacatttacctctacaacctcttgtaccatatcaaatgacttaattttgaatttagcaactctagaatccctgaattctgataagttagaacatattcctccattctcagcaattactacagcttttactaacatttgatttcttacttttttcatatctaacatctcctttttttactgcccataaagcccaagtcaaaatatctattagatatagtagatagatacttttataatttttatatttaatagttattttcaagggctttaagggcttgtttatattcttataatatctcagaatgctatttaaaacttaaaagaggaactaagtgattttacttagttcctcttttaaataatacatctatttatttgatataattattgattaaaatagttgctataaacctatccacatcgtctttatacttatatatattacttgtaatatcacccctaaacttatttatttcctcttcctcatttaacataaattcaagtttagtacactctactagttcctccactgttgaaactttttgcaaagactctaaaacactatttaatccttcaatcctattacttatagtttttttcatctcctccttcatagtaaacaaatccttatcagcaattcttttctttatatcaatagctattctatttatatcttctctgctttcatcctcatcatattcaccttctagaattccattatatataaatctcttatcttctgttgttttaaatgtatcaattaactccttataaatatcaatattactactaactgtttcaaaattatattcatctattaatattactaacacttcgtttaataaatcattaattgagtaaaattttaattctccatttatatccaaatcagaattattcatatagtcctttattgctagccttaaagctgtcctattgacatataaattttcaatccatccatcaattatcctgcttatatagttcataaaactaacttgttcatcacttgcaattataaacatagctgaaatcaattcagagagctttgatgatatcttttccattgctccaacaaaatttttattatccttataataattattatcatttatttcttcttttatatatttaggcagcccttctattcttgaaaaaatctcatcataatacttctttatatcttctatgttcctattcttactactattagctctactaaaaggattttccttatcaaactctattaataattttaatagctcataccattcatatagcagaatgtaatctccagtctcattatttcgtattttatagctatgtattccattttcttcacagattgatttaatcttttttcttaacgtcttttcagttattcctgtatcagtacttaaatcttttaatgtataatctatatcccttagtttattacctcttgtagccattttatctactcctctttagtattttctaatattttatcttactaaaactttataaaaaaggaatattgcaaagaatgagcaaattatatacaaaaaaaattctataaatatttacttattatttatagaattttcatttaatatctattaagtattcataaaaagtcctggtaaacacactattaattttaccttagtgaaagctatgtaaatatatatgacttatcttgttaaagtccattacttttttacttatttccccttatcttgttatatacatatcttccaattataccgacaatagttattataaatgtaattctaattagaacccatattatagagaaaaatccacctgcaactacccctaatatacttactattattcctgctcctaatacacacactccccatacggctataataccaccacaaccaaaataagttatctcacacttaaaaaatacccaagcaaaagttattgttcctaatataagagttattatccataaaaagttgtccatttttattatctccttctatttttataaaaaccttctcaaaaatgctgctgaaacattatatctacttgctacatctgatattgcagtatcagtatctatcccactagcaattaacttcaaaagtattataattatctttaatatcttaactggattcattacttcttctcctttatatatgtgtaaatatatgagtaacaatcttttactggaattagctttattacatacttagctattttaaagtctacatataaaagagtttcattattatagcctgtacctccacatagctctacaactttttcataattgttaactaactcaaattgaatgcaatttaattcttgttgaagcttctttaaatctatttccttattattatttaactctattattaaatctctaggattccattgattagctaatgcaccatcatagaagtcaaatctcattacccctaaaagttccttactatcatagttaaaacacttttctttacttaattctttcatatttaatcctccttaatactcctctgaaagaagcatcgttgaatactttccactatctataacatatattttcatctttctatctagttcaatatcttctaatgccaatgaatatactttttcatatttgggaacttcttgacaatgtttgattactattgaaactccttcttttcttagctcgaatacttgtaaataatctacctcaacatttcctttctcatttaagttatcaattatactccacattaaaagctgtaatctaatatctacttcctcattaactcctcttgtaatataacgattgctcttgtttttaaacattttctatgttccccctatttctgatttaaaatttgagataaattctttataaattcctttgagaatactcctgcagttattgattctttaattaattgcaataattgttcttctgttacatccaatgaacgtggaatatatctttctgctgatcttatagtatctttataaagactaaacctaatttcatccctttttatagctttaataaatatcttttcaatagaataagtgtaatcttcatcagctactttcccttggcttaatatctgacagtactttgtttcttttattatttttttggccatagtaaccctcctatgtttctccccaaaataaaaagtcttaatcaccatttgcattggtaattaagactttttaatcaatcatataatttttcaaattctgtggtgttaattctaatggaattattaatgatatagcatagtcattattacatagtatcaaagaattagtatatatttcaccattatcacatactatcttgtctacatactcagctataatgtcatcacaatcaatgtatattttatcctttatttcttcaaaatcttcttttttctctacaactattacataccctccatcatcttcatatttatttctactagtaccatattctatgtctagtatttgtagtatttcttgtatagtttcttgtacctcctgtggcttaatttttaaaatatctttttctcttaaataagctatttctatcattaatattacctccttcaatttttatatgaacctatagtaattacctatctgttatagataaactttaaatataatatatatttaaaatttatctttattttaccttaattaactttatacaatttaagttgttatttacagtatatttgtataaaatctgtttatactataagattatgtacatttaaatattatagtaaggagatacttatgaaagcgatatgtccaaataattgtgccaaaaatgaattccacacagtagctcatatatctcaatattggaaagttgataatcacggagagtttattgaagtacttgataactgtttagaaattatacataagccaaatacctccgatatatggatttgctctcagtgcggtgctgaagctatagtgaaatattaaaaagggtggagaataattccacccttaaaatatttaatataaatttatattaaataccctctatccaatccttctgttatactgcctctccaatctgattttaaataatcccgtacataattaaataagtgttcaactacatcatcataaataggattacgaacatatgtctcagaataggtaaattccctatctgtatttttttgctttctcaatacatatatttggtcaacagcatattttttcaaattaacagcttctgttaattttaatctctcagctactattatatataacgcattaggatttctatcttttaattgtttacctgctgtagatgatccctctaacatagttttatctaaatatgttttacattctatagctactgctggaatatcaaattccacacgctctaccgtttctgacccttggcacttaaatgttgcgttaaccctagttcctatgacaaaatcatgatccttttgttctatgttaatcaacggcttattcaccatatctttgtaattatcagctttaaagaaaatgtccttaaatgcatgtgacttacctattaatgcatattcagagaaatcatttactaaatctttaaataaataatataaaaattcctctaacacagatgaatgtaaattggatcttgaatcaaatttttcagcataacactgttggtctaaaaaatccttatattcattaaaaagctttactcttttttttaatatatccgaatcttcatttaactctttgattgttggaccttttaatgtttcattttctttcttccaccaattatacttttctctaatctcttttaaatatttttttgactctgcatctaaatattttgttgtatgattttctttttgttttaaattatcgccatgtacgtacatatatactcccccttatgatactatatattatactacataggcatgtctttttaaatattggatattaaattatctgctatcgcttttgataataaaggtggcaccgcatttcctatttggctatattgacataaataagcttctccgcttcttccttccctctctagtaacttcttgctaactactgttggttttcctttaaatacataccaatctggaaatgattgaatcctagctccctctcttgccgtgaaatttctattcttaaacggatgtacaaaattactataaaaagcagctgtaattgtattgcaaattttataaggatgcatccttctgctattttgatcgtatgatttttctgatatttctccatttccacttctttttaaaggctttaaatgctctattgtaatatctgatactgattgcccccaagtcatatgagaaaatctttcaataaccctttttgtatgtttcatagataagtgattatagacttttaaacttccttctcttaattgcttttgatattcatttgtaacttcctttgtataatccatttcttctgaaccttctctggcttcaatgtcaggtaaatctgagattgcttcccataaagttggacatttctctaatccactttcttcatagttttcttctatactatgtgtctttattggaaaaggtctttcaagttttttcttagatgctattagaaaaaatctacttctattttgtggaacaccataatcatatgcatttaatacttgcatataaacattgtatcctatattctctaactcattttttataatatctactactagttctttcttcttagttttagcattcaatatatttggcacattctccataaccataatttctggattaaatattttccccatccttaaatattgtgtaaataaagaatttctcggatccttaggatctccagcatttttgttgcatattgagtaaccttgacatggcggtccaccaataatgatatctactttcttatctttaaatgattcaatcaaaaactcatcagttaaattctctatattatcaagtattactttgcaattttccttatgattttctttgaaagtatctgctgcccacttatccatttcaattgctcctattatattaaaaccagctaattgaaatcctaggctaaatcctcctgcacctgaaaaaacatctattacatttttcattaacattcacctctgcttctattcgttagtacatttttctatatttatttttcacctaaaataataatattacactaaatatataagattaatcaattaaaattatttgttctactatgtttttcactatacattcgccatataatcataccaaattatatacttacattctactacaatataaataaaacctcgacaacacatttctgtattgtcgaggttttcatggtggaggcgaggcgtacagaacccgtgtccacaaattacaaaaaaacaaatattaacataaaaagcagaaatcctcatagaaatctgtaaaacatagttccattataatcaatacaaatcttcacataaataatttttttcaactttactccagtctattacattccatatatttttaacataatcagctctcaaattttgatactttaaataatatgcatgttcccaaacatcaattgttaatattggcttcatctttaggcttaatggagaatcttgatttgcagttgttattacatcaagttcttttttatcattaacaacaagccatgaatatccagatccaaaaacagttactgctttattagaaatctcattttttaaattttccaaacttccatatttatttacaattgcatctaatagctgtccatctgggcattttttaggcttttttgcaagtatggaaaagtataaattatgattagccactccaccaccttgatttattacatctttttttatttctaatggaatgtcttcaggatagtataagatttcttctatggtttttccatctgtaaatttttcatatccttcaacagccttatttaatttgtctacatatgcctgtaaatgctttgtataatgtatacacaccgtttttttatcaatatagggttctagatctttatatttatattctaatggccatttctcatacttcatatattacaactcccttctatgtttataatattttatatatatttgttatattcatttattgtaatattttttattattagtcatcaaaaaaactgccaactaaaatttaattagtaagcagttttttatctatctctttcaaaaataccatacgtaaataatatttttatatttactatccaaaaatttctgtactaatataatacaggtatctattttaatcctgaaacccctgtttctaagatttccatctgaagtatagtctcatcatcttttataactttttctttgttatttacaattgtctcataaatatcatcatacacacgtccataatccccatcaactgttttaactttttcttcatgatattcaccattatcatcataataagtaagagttccataatgtttaggttcatcttttccaaaatcctcattatgtggcatatagaataatttcaaacattcttcctgacgatctttagtttcttttataaacatgccttttttaccatatactacaaagctaggtctctcctttattctgaaaaagctcgattttacagatacttttaacactccatagtataaatctaaatcaaaataatcattcatacgcccttttccaaggagctgacggacatcataattaatgtggtccggctttccaaaatagcttatgacttgatccagtgtatgacatccatgcccatataaatatgacatttcagccttaaattcatgagtattttctggcacataaggtctataataatcaaaatgcatttctaattctaaaaggtctccaagctttccactttcaattacattctgtacagtaagaaaatcactgtcataacgtctattttgataagcagaaataataagtcctttttcttttgctaagctgaaaatttcttttgcctgactactactctccataaatggcttttcaacaagacaatgcttgttatgttccaataccatctttgaatattcataatgactatcgcaacctgtacacactactaccatatcaatttctgaatcatttaatatttcttcaatatcatctgtatattttacaccatcaatatatttccaactatcattattaggattacgtctataaattgtctttactttaaatttatctttacgctgcaccacaaatggaagatgatatctattggtacttttgccattacctatgtatcctattgtaagtgcttttttacttatcattttcgaaaatcactccttgctgctttcttgctttttccattatctcactaactattatacttatctcaagcatattcttagctgttacaaaatctttttcattaattattcttataaattcaacaaattcataatataatctatgttcaggattttctattttaacctcttcacattgcccagtgttatagtttaattcatatgaaacaagctgacctacaggcatatttagtctaaagtttcctttgtctccctgaatagttgatactacaggtgctttacagtcttttgctccaatacatactgctttaaattcatcataatccataagaagtattccacttgtatcaattttattttcaatattagccatatattgtacttcttttggttttccaaataatgaaacaataaaattaatgttatatacatttaaatccattagcgcaccaccagatttcttataatcaaatgctgggagaataattccatttttaaatgaatcatatcttgatgaatactgactataatttaaacttacaatctttggtttacctatttctaaaatactactttttaattctttaaatgcaggaagataatgaagattcactgcttcaagaataataagatttctttctgatgcaatctttattaattcctttaattcagaataattagaagttataggtttttctattattacatgcttatcattttctaaagccctctttgcaaactcataatgaagatgattaggaagtgcaacatatacagtatcaatatcactttttagcaaatcatcatagtcaaaatgatatgccttcatattatattctttatatagttctatagttttttctttactacgttctgtacccaagatttcaacagattcaataggaagtttatttatagtagaaagtaaatcttttactatcattcctgttcctaaaattccaagtttcattaaaaagtccccctttatatttaaatcttattgtatttttaattatattagcttctgtatgtattcgttaacaattttcatttgtttatagtgtttattttattatgtgaaatactcttttaactcgtatcaagtcataatgcattttcgctaataaattatattctattaatttttatatttatattacttagattatatcacaaattcttgtattctaattaatcatatatttaatatttttattatactttttaatatataatcatttacatatatcatcatacaacaagtaccattatatttactcttattataaccattatattaagttaactttattttaatacaataattatgaggctatatttatactaagtaaaccactgaaaaacttagtgttttccagtgttttacttagtaataattctatttttcaaaacgctttgcaacattctccaaatcttttataataggtaaatgctgaggacagactccttcgcactgaccacattgaatacaatcgctagcctttccaaatgttttagttaagttattgtaatactcaccttgtggagtccatcctttttctttaacttcctgtaagtctgcattatataatgagaaatatttaggtatagcaatcttcattgggcaaccatcaacacaatatgaacatccagtacaaggaatagttattgttgaattaatcacattaactgctttatctattaatttatattcttcttcatctaatggtttaaaatcactcatatactgagtattatccaataattgttccatattagacataccacttaaaacaaccattacattatcaaggcttgctgcaaatctaattgcccatgatggaatagacatatctttatcatattctttaaacatactaaaaacttcatcgggaacctttgctaatgttccaccttttacaggctccattacaataattggttttccatgtttctttgcaacttcataacattttcttgattgaactccaaagctatcccagtctaagtaattaatctgtaactgaacaagttcaaattcagggtgttcacttaaaaccttatctaataactcaggtccatcatgaaatgaaaaaccaatagctttgactaaaccctgtttcttcttttcttgtaaccagttgaaacaatccaaatcattatatacttcaatgctatgtgtattaatatcgtgcaataaataataatcaaaataatcaacgccagttttctctaactgttcattaaaaatacggtcgcgatcatcctttgttttaataaatcctgcatgaagtttagtcgttaatgtatagctatcacggggatgacgttttactaatgcttctttcgctgcattttcacttttaaacccacaatacatccatgctgtatcaaagtaagtaaaacctctttctaaaaatttatctaccatttgttttgtttgttcaatgtcaattttagatgcatcatttggatctaaagatggtaaacgcatcaatccaaagcctaatttcttcattctaaaggacccctttcaaatctatttattgtacaaacttagcggaagctctaatccattctcttctaataaaactttattagtaagaatatcttttgtgtttccatcttttattatttttccatcacacaatagtattgttcttgaacatgtatccataatcatgtctaaatcatgtgatgcaataatctttaatttattcattttatttaaaatattaataagatttcttctattcctaggatcaagagcaactgatggctcatccaaaagtattatttcaggctccattgcaagaattacagcaatagatgcaagctttttttctcccccagacattctataaatctgacgtgttttcagtttttctatgtttacacttttcaatgaattctctacacgcttttctatttctttttcatcatatccataattacgtggcccaaaagccacatcttcataaactgttgacataaaaagctggctgtcagagtcctgaaaaacatatcctgtttcttttcttatgtctggaaaattctcttttacaagcttctttttattaataagaatttctccttcataacggtctaaaataccaaccataagcttaagtaatgtagactttccaacaccatttgctccaattaatcctacacattcattttctgaaatcttaatattaatatcatccaatattttatttcttccataataaaaattcatatgttcaatattaattctgcacatttttaatacctcattttatacaacaatacttccaataatcttaaataaaggaataactcttaaaataataaatattaagcaccagacagatgcatacgcaatgcttaaaatgacttttcccttatgattatttattataaaatttccattaaaacctctaagcaacatgctttcatatacaatttctgctctgtcaatactccttaaaagaagctgtcctgcgaagctcccccatgcttttatatttattcccttctggtatggagcacgaagcttatatgcctgcatcatacgctctgtttcttttaataaaacaataatgtatctatatataagcatgaccacagttactattccttttggaatatgaagaatcctcaatccataacatattttttcaattgatgttgtaactattaagaaatatgctgcacatactgtaaagatacctttaatcataagtgttaccatagataccattccataggtaatatatatgcctgatatagaaaatataatcttcctgtcaaaaaacggattacctattccaacaatacaaacaagtataagcaccaccttcatgtttttaaagctattacttaatggaatatctgaaattacacttactccataaagataaatccccatactaatcacaccataaaaatcatatttatcaaaagatactacaacaactatataaataaatgtaacaataatttttgataatgggtgaaggttatttatggtgctgtcttttgctgccacatcatccatatgatgaattccatgaattacttcatttattttactcatgttttactcgttttttgaatcccttcactgcatatccacccaaagcgcaaacaatcacaacaataactccgccaataagtcctgataatgatgttcctgaagcagaatcactattctttaatgaataatctggaagcagtgcagttgactcctgaatattctctgctttttcataaattgatccagctgatgatatttctgttgaacctgtcattttggcaatcgaccattcaagaccatctggatttgaagatgcagtaagtgaaaataatccacctacaatagctgcacatactgcaattattataatcatatttttgtatgatactctctctttagcttctaagttttcattattcatccataaaatctttggtctggtttcatatataaatattaaaactgcacctgtaaccagcccttctacaagtcctattgctagatgaataggctgcattgcagcaataaaagttataaatggaagttctgtaatattagaagctaatgtttcaaggcttacagaaaatgctccaagctgcaaagttaatatgcatcctaaaactgaagctgtcattatttttttcttagacatgccatttctcataatatagcgccatattataattccacctataaaacatccataaaaggacatattccatatattacatccaagtgcaagtattccaccatcagcaaacataagacattgtataagtagtattccaatcattgttaagaatgctgcataaggtccaagtactgctgaaagcatcattcctccacagagatggcccgaagagcctgtccctggaattgtaaaattaatcatctgggctgcaaatacgaatgctcccataactcccataagtggaatcttttttgtgtcaatatcaagatttactttttttattgaatacaccattgcagctcctgaacaggcatacatacttcctgcaacaataggtgtaacaagtgcgtcagccatatgcatatctcattcccccttttagattttttataagacaattaaaatttctctacaatttctttatattagtgctcaatcatttatctgctatatttatatccatacttcctgagcgaaatccctcaatatctaatgtaatatatgaataattcaaagtttttaaaaattccataataattttcctacattccaaaaattttatcatgtccttatcatcaacttctatcctcacaatatctttatgaactctcagtcttacattataaaatcccagcttccttataaaatcctcgcctttttcaacctttctcatttcctcactatttaaaggtgtaccataaggaaatcttgttgcaagacatggagcagaaggtctgtccgccactgaaattttgtattcttctgccatctttcttacatcctgctttgtaaaacccataagctgaagaggacttataacagaaagctccttaagtgctttaattcctggcctgtacacatgcatatcatcttcattggttccatcaaaaacattcttgatattaagttctgctgctttttcctttatttttgtgaacaagtgttttttacaaagataacatctgttaacaggattatttattatgcctgcatctttcaattcatcaatttttaatataatatgggctgctccagactcattagcaacttttcttgctatttcaatatccttcatgggatgaagacttgtatgcaaagttactgcatacacctttgtactttttttctttgaacagtcacaagctatctttaaaagcaggctactgtcaactcctcctgaaaaagctatcattatatcattatcagtatatttatctataaagttttttaaatctgtacacttttctttataatctttcataacttaacgccttcatttcactttgaattaagctatatgcctcagtatagctcatacctttttctttacatatgatagctatactttcatattcaggataatacttaagtttatctcctaatctgcacactttaacttttgctttcccaaaagaagtgtcaatctcttttatttccctctttaaaactgttctttccattacagtttttctgattcctattgttgttgtttctgaaaaaattatatgttcaagtttttcaacatattcttcttcacaaattacattcatcatatacgcaggtctgttctttttcataaacataggaatataatttacatctcttgcaccattttcaaaaagtctatccattacatatccaagattttcaccactgcagtcatcaatattagtttcaagtttataaataacatccttttcctcttctgaatcttcaataatcattgctcgaaggatacttggcctgtcataatttctctttcctgctccaagaccaattttcttaattttaaactttgaaggaagtttatcctttgtcttaactgctgcaactattgctgcacctgtaggtgttataagttctccataagtttctgtaatgttaatgttaagattgtttgactgaattatatttactacagcaggtactggtactggaataattccatgctgacaccttatagttcctctcccttcatacagttcagtaacaacaacatctgaaatttctagattatcaaggcatacagccacggctactatatcaactattgaatcaactgcaccaacttcatgaaaatgtacactatttgtatcacttccatgagcttctgcttctgcttttgcaattatcttaaagatcttcactgcagtattttttgcattttctgtaatatctgaactatatattatttctaatatttctggtaatcctttatgttcatgatgatgagcatgttctatctggtgattcatatctttatgacagtgttcttcattacattctttactttcattcactttaacattatgtccatgcaggtactccatgtcatgatcatgattttcatgatgctcatccaaaattacattaaaatcacatgcatcaatgccactttttttcactctgcttatttcaattttaaatccacttatcttaagactttctaaggatcttaaaagtgcttctttatctgcaccaagatctataagtgctgcaactgtcatatctccacttattccactgtaacattctaaatatagacttttactcatttttctcccccattctgtttatttgtgttgcaatatagcctgcaccatatccattatctatattaaccactgcaataccatttgcacacgaattaatcatagtaagtagtggtgctagtccattcatacttgctccatatcctacagatgtaggaactgcaataacaggcttatccacaaggcctccaataacacttgccagtgcaccttccatacctgctacagctatcacacagtttgcactttgtataatatctaattttgatagaagtctgtgaatgccagcaactccaacgtcatatattctttctacattggatccgaaatattctgctgtttgtgctgcttcttctgccacacatatgtctgctgtgcctgcagtacaaactgctattttaccaattctttttttatttttcttttctatcttcaaaatatgagatatgtggtcatattctacctgaggatacttatcttttataattttatactgatgttcatctgcccttgttccaaatacttctccatcttcctcatataattttccaaatatattgataagatgttcgtcagcctttccactgcagaaaataacttctgaaaatccagaccttacttttctatgtgtgtcaagctttgcataccccatttcttcaaatggctgttttcttaaatatttctctgcttcttcaactgatatttcattatttttaagctttgtaagtacttcttttaattccatataaatatcactttcttttctattttttaatatttttgtagcattcacaaaaaattttgtacttcttaaatgcacatacatagaataatttatttcattgttatacgttttctattttcccattagattctcctgcaaaattatggaaattatttcaaatataatattttaaaattaatttaccacatagaaccacctaaaaacattacctatttccattttttatcaaaccatacatctcatgttactcctttaagtgcactccaagtcaatacttttttgtgaatttattggaattagagcatataaactttatgcaataagaaagaagcagcacaactcaatgtgtctgctcctttctattcttatctgtattaatatataatcaataactattacattagatttagcataatgtaattatcctacttggtttactctaaacataactagtttatattaaatttattataatgatttttaataaatactgttattcaataatactcatactattaaatgttaagtttattaatccattccgcaagtatttctttcgatattcttccatttaacaattttcctggaaaccatgtcacagtatcagaacacgagctctttaatttttctacagtctgtccaagattacttccccctgatgtagcaaatggtatgattttctttcctgaaaaatcataggtttctaaaaatgtatttattatagttggcgctacataccaccatattggaaatcctacaaatacagtatcataatcatccatatttgatacttttccaataatccctgggcgataagatggatcattcatttcaatactgctacgtgattgattatctctccaatttaagtctgcatttgtatatggaatttctggtttaatttcataaatatctgcatctactaattgtacaaggcttttcgctacttttgctgtcacaccactacatgaaaaatatgcaactaaaaattttttactcataaattatttcctccatactataatcattgttttaccaatatattactttcattaaaatcatacaacttaaagctaactccaagtcaatacttttctaattaattatagtaaatcattgaacttagtcgaaaaaagtgttaagctatcaatattaaatttactaaaatgtatttatatattataaaatttagatttacaaaaaagtatattaaagagcttatttttccataggctcttttttagtgataaagagaggtataattatgataaaaattgataacttgtcatactcattccctgaaaaggacttatataaaaacatttcattcacattagaaactgatgctcatgctgcttttattggaactaatggaagtggaaaaagtactcttatagatatgattatggatactgagaaatatttgtatgatggtacaatagaaaaatcaccaaactgcagaattggatatgtacaacaattctcccaaaatgataaaatgagagaaattacggtttttgattacatatgtgaagaatataataaacttcaaagtgagataacatctatctgcacacaaatggaaacatcttctgacattgaaactttacttgaaaaatatcaggaagctttagatgcactagatgcaataggcggagatgaatttgaaaacaatgttaataagaaattaaatcttacaaacttaatgaaacataaagatttgatgatatctgaacttagtggtggagaatttaagcttgttcaagttatgaagggaatgcttaataatccagatttaataattatggatgaaccagatgtatttttagactttgaaaatcttaattctcttaaaaatttaattaattcacacaaaggaacaatgcttgtgattactcacaatagatatctacttaataattgtttcgataaaattatccatcttgaaaatatggaagttcaggagtttgatggaaactatattgattataacttctcgttactacaaactaaaatcgaacttcaagaactggctgccgcagatactgctgaaattgaaagaaatgataaattaatagataggttaagagagcttgcaactgaaaatgctgaacaattcagaggtaaaactcttagagccagagttaaaattcaggaaagattagaacaacgtagaattaaagcaccatttttagctattaaagaaccagatatcaatttaaataccgataacgtcttagatgaagaaactattgctttaaaaattaataactacaatgccgtatttgataatgtacttttagaagatgtaaccttcgaaattaagtctactgataaagctgcaattatcggattaaatggtactggtaaaactactttaatgcaagacatatttagctatataaacaataaaaagtctattgaagtaaatgaccaagttgaaatggcttatttatcgcagcttcaacacaaaaccctaaatgattctaacactatacgtgaagaattcattgaagctggttttaaaaactctgatgagattatggaacatatttcaaagtatggttttgaggatagagaaattcttagtcaagaaataggttctttatctggaggagaacagaatatgcttcagctagcaaaaatttctgtcagcaatgctaatatgttacttcttgatgaaccaacaagccatttagatacatattcacaaatagcattagaaaaagctattaaaaactataatggtgcgattcttatggtttctcatgatttctattcaatagttaattgcatggactacattttatatattgaagataaaaaaataagaagaatgaatatgaaaacttttaagaaaatggtttatgctaattacttcgataaagactatttagaaattgaacataataaaaaacagcttgaaatacaaatagaactagctcttagagaaaatgattttgatactgcaaaagatttatctgctgaattagaaaagttagttaagttgctccgaatttaatattttcttcaaccaaaaaatcaacgataaccagtatcgttgatttttttatttattagaaaatgaaaatgccattttagtcacttaattttcccatctgacttattaccatttcatagtaacgccctttattattcattaagcttttatggtttccactctcaagtattctaccatttccaataaccataatgttgtctgcatctctaatagtagaaagtctatgagcaattaaaaagctcgttctgtttttcattaatttaactaatgcattttgaatatccttctcagttttagtatcaacactactcgttgcctcatctaaaataagaattggactatcacataaaacagcccttgctattgctataagctgacgctgcccttgacttaaattatcaatagccccagaaaccattgtgtaataaccctttggaagcttacttataaaatcatgtgcatgagatattttagcagcgttaattacatcctcatctgaagcattattttgcgaatatctaatattatccataattgttcctgtaaataagcatgtatcttgaagaactactgaaaagtattttctaagactatctctttttaaattcattatatcctcattatctataagtatacttccactatctttatcataaaatctagtaagaagattcactatagttgttttaccagcacctgtttctccaactaaagcaacaacttctccagctttaaccttaaagcttacatttttcaatataggagcacatttatcataagaaaaacatacatttttaaattccacatcaccctttggagattttaattctattgccccataaatgtcttccttttcctctactgtatctaaaatttcaaatactctttcagcaccagcaagtgcagattgaatagtattaaacattccagctatggagtttagtggctgtgaaaactgttttgaatagcttaaaaagctgacaacagtacctactgccaatccatattctacagataaaactcctcctacaatagcaacgactgcaaatataaaattatttataacattcatcaagggcatcatatatccagaccatatttgggccttattactgctttcataaagtttttcattaatttctttaaaattttctaaaatatccttctgttttccaaaagcctttaccatttttaatcctaaaatattctcctcaactaatccatttaaagaacctaaactttgctgttgtgctaaaaaataatctctgctttttgatgcaattgttttagttaataaaactactagaggaatacataaaagaacaactaacgtaagaggaatatttaaatttatcattaccacaaatgatccaattaaagttaaaatactccaaataagctgagttgttgtttgagctattgttgagcttatattatctacatcattagtaattctgctcatggtatcaccatgagacctcacatcataaaattctaaaggaaggtgctgcatctttttaaaaaactcagttcttaaaacgtgtactagtttttgagataccttcagcataattactccattaacacttgaaataataaaatttgataaatgaagaactgatattatgattaaaagtattaacagcattcgtatgtttacagttctagtatcaacattaaaataattgaaagttctcccaacaaagtaaggaatactaataactataaaagaggaaataacagttaaaaacatagctaaaactattgtttttccccatctcatatatatatttacaattctaattaatgtacctttaacatttttaggtttttctttaggcccaaatctccctggacctccacctcttccagctcttcccattgaaggcatttttacttctggtttattatatatttgtcccacttattatgcctccttgctgctttctatttgagttttatatatatccctgtaaataggacagtttttcataagttcactatgagttccaaagccaacattttctccattatccataaccaaaatcttatctgaaaacattgctgtaccacagcgttgtgtaattgtgataattgttttatcccccatagaatttattccatctctaaccttagcttcagtaaccgcatctaacgcacttgttgcatcatctaaaataagtattttacacttttttagaattccacgtgcaatagagattctttgcttttgtcctcccgataagttaactccgcctccacctaaaagtgaattaaaaccttctgacatatcatctataaatgatgctccagcctttatagatgccatctttatttcttcatttgatgcatttgtatttccccattttatattttcatcaatagatccagaaaatagcattggcttttgaggcgcaatagaaatatcttttctaaggcaatctatacctatatccttaatattttttccattaattaaaatacagccttcattaacatcataaaatcttaataacagccaagctattgtggatttcccactacctgtaggccctataattgcaagcttttctccaggctttaatgaaaaacttaaattattaattgcaggcagaccacttccatttggatatgcaaaagtaacgttcctaaactctacttctccagttaattctgaagtatctacattattatgaaaatcatcttcacaattaaatatatcttcaatacgagcagtagatgctttggttctaacaaatgtattaaatatgtttgttatcattattaatgatgttaaaatctgagccatatatattgtaaaggctgtaatatcccctggatttgcaatatttaatgagaaaagcttacttccaacaaaaattattattacagtcccaataccaacggtcaatgtcataagtggtgatgttaaagttataactatctgagatgaaattcccttttccattaaattatcattagcctctttaaacttttctttttccttattgtaggtgccaaaagccttaactaacctaacaccaataagatactcctgaacaactgaatttaccttgtccatggctttctgtaaattataaaagcgtggataactaagcttcatgcttgctattatgagaataccaactatagctaccaatccataaattattatggataacttaaagttaagaagtgttgcaagaacaatacttcctatgcatgttattggagcttttagaaaaatacgcataattccgtttataaattgaacaatctgagaagtatcattagtcatacgtgtaataagagaaccactttcaatcttatcagcacctttttctgaaaaatataaaattttcttaaacaaatcatatcttaaatctgcaccaactctttgagaaactttagatgccagtatgttacgagttacagcaaaacaagctccaaaagctgtaaccataagcattaaacctccccagtaatatacatttgaaatttgtgctttatctattcctgaattaattatattagacataagtgttggtccaagcaaatcacatactgcctctaatgctacacaaataatagcagtcaaaaaagggaatttgtatcttctaaaatatttaccatataaattcaccttaccatctcctttttctttattatatatattaatttataatttttatacatagtattattataaatttatttcaatattaaatctccataaacgtaagaaaagagcagagtgtttttcactatgctctctctatgttgagaagataaattcccctttttatctatatttaatttgtatttaactttttaactaatagatcaattgtccattagaacttaaaacataaccatctactactgtatcaactatcatttcacctgattgattcaaataataccagtttccatcatcatcttttagccagcctgttttcattgatccatcttcatttaaatagtaccatttaccattactatcttttaaccaaccagttttcatgcttccattattacttagataataccatgttccatcattatcttttaaccaacctgtctgcatacttccatctggatttaaatgataccatagctccccatctttaaaccatccttgagctttttctccattagaatttataaaaaaccatgttttatcttcgttttggttccatccatttttaactttattattctgtaattcttgatttttttcagtctgccctacacttgtagaactatctatatctattgcttctgatatattttcactgctagaagaggatgatgtactatgactatggtgtgttgttgtaccctgtgatccactgttatttcctgtattacttgaattacttccactactactattgttgctgtcaccgttattttctgaattattttcacttgaacctgaatcagatgcatttactaatgccatatactctggccatattatattgttattttcatctctttctatagatgctggtatttctgtacccttaaacattgatttatctaatttcttaccttgtgaattttctgaatcctgtccattataaaaataatttgtttctcttttaacgtaatcaggaatgtaatcttctacgtcacttgaaactgttctgaatgatttatcattttcaaattcataatcaaggatagcagttgtgtaataatctaaactataattcttataattatctgaagatatagtatttttcaccacacatgctggattactattacctgtaacacctgctgcatcattgttaaatgataatgaatttaataatgtatgtttaacaggaagaccttctcctcctaacttaaatccatttccatccccttttgttactgtaccatcacttaatgttccattaccataagctatacaattttctattgtaacagcgcctattttgcctatttcaagtttgctaaataaatcccatccatcatcacagttattatgagatacgcatcctttaaatacatttccttcacctgttgtaagcttagctgcaaatccatctgcattattcatggcagcatccatattatcatatgaatcacaatttattatttcattatatttaggccataattcctttggatcatctgttgaaaccgaacttatctgtaatccagtatcaccatttttatatgtctttatattttccaaaatattatagtttcctgctactctgagaccagcattagcatctgctgtatttgttacatctataccttttatattccagtaatttccgtttaagaaaaatccttttgatacttttccaaaatcaaatattgctcttccatcataagattcaaatgatttcatattatcttttgttccattattagtactttctatagttactggcgatataagattatatgtgccacctttaaccttaatagtttgaccattatttacatattttacagcactataaatatctataggattatctattgtaccatcaccactttcagttccatttggtgatacataaatatctcccttttcaacaccatatgatttaacgttaacaataaatgttttatttattacagttgtatcagtattattatcagtcacatatggagtatactctatctcaaatttattatctccacttttaagaactgtaggtactgacaatattgattctggatctgccttaccactatatacattactatcatttaatttaatatttaaattacctttaactgtaggctgtaccttaaaatcataactcgtacttcctgttgcatctcctgattttatatttaatgctggaactattacttcagctggtttagattcaccagctggatctgtagccacattagatttagttaaattaatatttgaaacttgtattgatgcaatacgtgctgtgaagaatccaacatatatttttccactatctgcaacttccaataacttaggttcataataagttacttcttcaccatcatcaacagaacatatatatcctgtattggtctttttaagagttaatttatatgtggcactaccatcattagctggacgatctgcaaatttatgttctccattcattgttatttttccatctaaatcttttgttacaccacttctgtatacagactcaatattagctttatatccaccaaccaaaaccatattggatggcgcggttgaaacatcattagctacacctaattgatcccttgccataattccaaatccacattgcttatctggcttagttttttcaaaataatttactttaacattggctgaaagctcaaagttttctgatggatctatttctgtataatagtatgatataccatcatttgatccagttaccttaccacctgcatttgtaccatcagagtttccagatcttaaattaataactttttttccattttcatcagttgcaacatttatttcattattttcttttgaagtagttactccaaagactgtagaattccaattaaccttttcagcaacattatctaaagtttcagtgctactatttccagtgttgtcatcctctgaagtatctgcataatcatcttttataaaatcactataatcttcattttcatcataatcttgttcatcctctggatatgatgctaacatctttaaatcatcacttgggtcccagttatttaatatattttccttattatatttatcaatattttcaagctgtcttctatttgagttttctccatttgcagaaccttcaccataattattatattcatacatatcattatccaacggattagtgatgactcctgcatttgacattgtagaccatccatcagctgctatatgagctcctaaatcgcaattttcatatacaacattagatatcacagtatgtccaagatttgtttcacttgatggatgccaaggtcttccaagatatactgatcctttttcatttatattgcttgttaatttagaattttgaattaaaaatccatacacattatcttttaatgtacttggtgctgcaacatatccctttggtgatattccttctctatttacagattttatttcacaattatcaaaaacggcttgagcgcctccaaaaataaaatctacatctccacaaatgaaacaattatgataatactgtcttttcttatttgcatatagtgtatcttgattccctatgaatctacaattttcaaatacgcttttatcagcttcatttttcattgcaacagcctgtttattagcaataccagcatttacatcttcatcaaaagaatttgcaattgtaagatttgctgctttaaagttttctgctaactcttttattgttacacttgaagaactgctcgttccataagtaactactccatcaccaccatcttcacttctttttatagtacctgaggcatcatcataagttataactgtatgagctgcactttcaccaacaagagtaatattaggtactgctatagtcaatttttctttatatattccattttttataaagattattttttcatctgaattatctttatttatagattgtatagctgatgaaattgtattatatgtaggtataccacctacattctcaccttcatttccagaatattgcttgtcaacaataatatctggtgaaatagataaccctatatcactggtgattgctgctccagttgtagtttcatttgtaacttctaaaccgttattgtcttctaagtctgacaaattttcataactttcgtttgatactacagatttgtcttgagtagtgtttactgaatcatctttaacttctgcacttgcaaaagttgaaaacatagatacagctgttgttgtgctaattaacattgataaaacttttcttttcattttatacatcctcctatagttaacgttaacaattatgttttaataatattataaaaagaacttaattataattaattactttttctatttccgccttaagtttaacgttaacaatttaaaaataattttccctaagcacttttataatcgttttcatttttataatactatatataattttacttttcaatattttaccatataaattttttgatatttttttcagaaaccttttatttaagttatcacaataattttaagttttttcctataaaatataatataaaagaaaacataaatcaccttctgtatttacgttttctcattacttgacttttttattttattctacattctttaagttatgaaatatattttatacttatagtcctacttatttgctttttcttgatttcaaaatataaaatccaattgtaccaaataaaataattaaaaataaaggcataaaccctactgataaattttgccttccagtagtaattcccataagcgtatgtaattgaatatagaaaaatattactgttatttctgcattaattgctttcataaatgtttgagccatcaaaaactgtttttctctattttcttcatttatttcaacgcaataattataaacctcaggatacttcgataataatgcaattccaatatagcatataacatctataaataatagaattagcattgaactttttgaaccataagtatcaacttctccattaaagttataatgcattggaacacgatccggtgaattttgccataaaaaaaacgtacagactatcattccaataatcgataatgcactaatcgcatccataatcatatttactttcttgtagtctattttactgagccacttattcatagtttcacttccctatatatagttcttaataattctctgcaagttacatgttattatcatatatgcttatagtcaatattataattttccatatatgcgaatcgtttacacaaaaaaacttttaattggtttaaaaaactccaaaatatgatttctaaattttcactgcaaaattatagtctcttacaaaaagagattcttaaaagtaaaaatcttttggtacaatctcatacttgtcattctgatactaaattcaatcattttagatttagatatgcaattatatatagttataataaatattcgaatatttacagttatacggcatataattaaacaaattgacaataaccagaaatgatatatcaaattacaaatatattcccttaaaattaaataatatatttttacataatatagtataattataaaataaagccaactgcttaatagtgaatatatggaatgtgacaagttattggaggatgtcaatgattaatgttaatttaaatgaatactctaaaaaacaaaaaaatttagtggaaatgtattgttagcaaaaaataatgaaattatatttaatgaatcatatggatattcaaataaggaaaaaggaataaaaaatacacctgaaacaaaattcatgattggttctatgacaaaggcaataactgcattatgtattatgcagttatcagaaaaaggtatgctttcagtacaacaaaatattgaaaattatattccaaacttatacaatggtcaaggaattacaattcatcatcttctaactcatacttctggcatacctaatcacataatactaaaaaaacaaataaaatggggagaacgtcataccccacaagaaatactacaaattgtaaaagattataaattgaaattccctgctggtgaaaaatggtcgtacagtaatactaattatattattcttggtttgataattgaaatagtttctggaatgaattatcaccaatatgttaagaatcatatatttcttcctgctaaaatgaataattcaggttttattgatgaagaacaaaaaaatgtagccaataattatattaatggtaaaaaagggttctatattgacccatcaatgttgtttgcttgtggtgatattgtatcaactgttggtgatttttatttgcttgatagagcaattcaggatggtaaactactgaaaacccaaatagtaaaggaaatgcaaaaacctcactatgacggtaaatatgtaaaatatggatatggattgcttataaaaaaacattttgaccgtaaaagtatatgccatggtgggtcacttccaaatggttacacttctcattttgagaaatatattgatgacgatattatcattgttgtattaagcaatgatttggtaaaataccaattactatcattagaaggagccggtggcacatatataagtagagaaattgcttcattaatttatggtaaaaagttatgttttttaaagaagatattctaaaatatattctcaatagagatagttactacacatctttcttacattatattataaatacttgtataattaaccaaaaatattcttagagctacaaataattacaactggagtaagccttaagatttgaaagaacttgaaaaagataaaaaaataactttcagattgtttttaatagaatgtagaaaaatttgtgtaaacaaagatatttacattcttattcctgagagttatttcttatatatcaactatttcttataaaacttcatttgatattatatctttaattgcacttactaaccttttgttttgcttcatagttcctacagttatacgacttaatggaagatctcctcttattaaaattcccttttctttaagcttttctgcaataaattttgtgtctagtttagtatcaacataaataaaattggtctgtgttggaaatactttgaagcctaattttttaaactcttttgacaaatattctctgccctctttaataacttcctttgtttttttgataaactctacatcattaagcgctgcaattgcaccttctaacgccgataaacttgatgcaaattcaacccctttattaaattcacagaaatttctttattcattattgcatatccaactcttgctcctgcaagtccataaacctttgaaaatgtacgtataacaattacatttggatagttacctatcatctgcatcatacttttataatttggaatatctatgaattcaaaataagcctcatcaaccacaataatcacattttcaggcactttcattataaaattttttatttcttcttcctttaatatcattcctgttggattattaggattacatattattatcattttcgtcttttttgtaatagcatctaatattccatcaagattaatttgtaaattttcttttgttggtacttctacataatgtgcaccgtttctctttgctgaaatctcataagactcaaacgttaattgtgaagttacaagttcatctccgcagcatagaaaaacttctccaatcaaagataataagccacttgcaccatatcctatgataaaattttcttcatcaaaattcatattgtatttactattatagaaaaccgccaaatttttccttaatgttattccatcaaattcaggataaaaattattattaattatattattcatcattgccttagcagctttaggtgatactcccaatggattttcattataattaagtcttattatttcattgacgttatattcttttttcattttttccatatccatatctggatagtttatgggagtttgctttattattggtttttttattaattcttcaaacatccttaaccgcctcctgttttaatatatgcaaatcaattttcaactattttttacaaaataaactttaattaattatattatattatcctagaaaacttattgttaattgtgtatgtttcattatgaaagaaattaataaaataataatttctatgatttttccttattttgttagttgatatttagtatataactatgaaccttttcataagttgttaatcaaaatcccctttttttaaagcagtttttctttttaactatctttaaaaaaagggggattaaaatattataattttttatcaatatctattattgtttttagaattacatttgtacattttacccaatcatcaagcttcacacaattttctttaaaccgacctgcttcttttttacatggaataaaaatcaatgcagttggaactatctctgatataaattgagcatcatatccataactattatgtatttccttacaataataaccatattcatttgcatttttttctatgattttaatatattcagagctataattaaatactccatgttttccctcagcgactccaatatgaactttgtcgttatataaaatatattccttatctctatatgcttctataaatgcaacacaatttttagaattcagcctgttttcttcctcccccatgtagccacttgcttcaagtgcctctttaaaggttattccatcactatctacagcagacagtattacatctctttgaaacttacctgaaattacacctgatgacatcattgctggttcaaaccgagctccttctttattagtccatataactactgttattggatgcttatgctcaatattttctgttacaattgtttcgactatttcaagtgctgtgagtactcctaaaagcccatcattattgcatccattctcgatagaatcaatgtgagaaccaatcattatggaaggaagatctttatttccttttattgttgcataaatattggccatatcatcagttttaatttccattcctaggttcctgcatcttttgcagaattcctctcgtgcttctatttcttcagatgataatgataatcttgttattgtccctttaccactatcaccaaatttactgaaagttcttattttgtcatataatctttccttgctgcacgtcataatagctgtagtcataattctcactccttgtactttgaataatgtgaattcactttcaactcaagtataatcataatctataaagatatataatctgaagatatgcagcaattttaatattatagcactaagtgtgtaaccttattatttataatcaaacaggtaataattctaatatattctgataacaattttacttccataacttttcatatatatttattaaatcttgcttgcttatatcttttattgtatttgaaggactaccactattcatagcatcccctgccatcttatctataactttataaaattcatctttattaattccatattcttttaaagttggaatttcacatatgctgcatattttatcaagctcatttataaattcttctgatgcttccttatcatttaacttatcattatcttcatttattactcttgcaatctttgcaaattttttataggagccatcaataacataagataaacattcttttataagcatagcatttgaaattccatgggctacatgaaataaagcgcctatgggtctactcattccatgaacaagagttactgatgaattattaatacatacaccagcttcataagctgcaagtgccatttcctctcttgcctttttattttcaccatctttataagctataggaagatacgtgaatattctcttaattgcagataaagcataggtatctgttaatggatttgctttttttgatgtatacgcctcaactgcatgagttaatgcatccattcctgtagctgctgtaacactctttggtgatgtcattgaaaatttataatctataattgcaagatctggaagtaatgcttcaccctttagaagcatttttacattgttttttgtatctgttatgattgaaaacttagtcgcttctgatcctgttccagctgtggttggtataagtactagctttggaaatttgccttctattgaagttcccatataatcgcatatatttccttctaattctgtaattgctacaattgctttaccactgtctaatggacttcccccacctattgctatacagaaatcacatccagcatccttatatgcctttacccctgcttcaatcattgtatcagtaggctctcctgtaatatcattaaatatttcaaatttaatatctagttctgtcagatagtcagtaagtatcttaactgttcccattttagttacaacttttcctgatactataaatgctttttcaccgaagctctttaatgtttcaccactggcttctaacgcattttctcccattattattttctttggcagactaaattcatatgccatttttccacctccaagattgattatttactgatttgtcttttgattttatattataataatatttgatttttaaaactgtagtttaaataaattgcttgtctacaatttcaagaacttcatctaatttaataagctcttctttaagctgttcttcagtaattattaatggaggtgcaattagaaccatattttcatgagaatatgtcatgaattttctttcctttaataaccctattatctttcccattattccatctgaatcttttccataaggcactaatggttcttttgtagttttatccttaacaagttctactgctgaaaataatccaatatatcttacatctccaacacatggatgatattctttcatagcttcaagcttttctccaagaactttcccaactttatttacattttctaaaatatttgcttcttcgtaataattaacacaagcaactcctgctgcacatgcaagtggatgtccactataagttaatccgcaagataaaagattatcatcaaagtattctgcaatttccttgctcacaacaactccgccaagctgtacataaccacatgtaacaccttttgcaaaagtaacaatatcaggctttacatcaaagttttcaaaagcaaacattttaccagtacgtccccatccagccattacttcatcacaaatcattaatatattgaattcatcacataattttcttattcctggaagatatcctataggaggaataatgattccattagatccagttactgtttcaattacaatacctgcaatgctgtctggtccttcatataatatctgttctctaagcttttttatataataatctgtagcatcttcttcacatttaaattcaatagcttctctatatatatatggatcaaaaaatttaataaaccctggaacgcctggttctaaagcatatcttcttggctctccagtaagattacctgcaccaaatgaagatccatgataacttctgtatctactgaatattttagattttcctgtaaacattctagctattttaacagcattttcatttgattcagcacctgcatttgtaaaaaataccttccccatattgtctggcattaattctattatcttttttgaaagttttgcacgagattcagccccataagatggtcctacaaaacaaaatttatcaacctgttcttttattgcatcatttattgccttatttccaaatcctaaattcatatttacaagttgagctgacatatctgtatagcgattatcatcataatcccaaaaataaattccatcccccttttttataggtattggattaatgtttttttgtttactccaagattgtaaattgtatttttttaatgtgtttttaatttcttcaccattcatatataaccctcctaaaacaaatggagcctattcatattgaataagctccctcgcttgcatttatttcttatttatatctttattataaacttttactatagttcttcaacttataagtgactaattttctttgtgcacctgcacatattaagcatatatttcagttagcaagatatagcctatagctcttgcggatactccctgttagaaattaatataggtcttaaacaaaatactatattatatcctttatgtaaaaacccaatacaaatttcattttttcctcaatttccaaaggattaaatcctgtaatcttttctattttttttatttgattattaactgtgtttctatgaatatattgcttttcagctactgcctgctgacttccattattttctaaatatacttttaaaaatccaacaagatcagttctattttctttgtcatattctactaattttcctagcacatctttataataattattcaataaacttttatcctttacttctaaaagaagcttatatatatgaagtttatcataaaaaacgacatctttctcttgctttttagccatttccattgctttaaatgccttattaaaattttcatcctgaactcttataccttgattattctgacttattcccatataaactctgcaagattctttattccaattcttataaaatgtctttacaaaattatctatatcataattactatagtttacaagtactaaaatccaacactcattataaggaaatgatatataaagttcatggatatttcgtgcaattctttcagaaaacaccttcactctattcatttcaaaatcaccttccttattatcaagacacatagctataaagcagaatttactatcctgtaaatatccatacctctccatctgctgaatctgagtttctaaatcacctattttgaatataatattctttattgtagcactaacgcttatttcaacttgctctcttcttaatattctagaacatatatcccgtgtaatatccaccattcttgtctcccaaggaatagtatataatggcatatccactttattacagaattcaatcacttctttatctacagattttgtgtatggtcctatattaactataaaagcacttgttccaactttgtggagtttttttgcataatctaaaagccatcctttattatcattgagtattcctgatgtcagaacaacttcatgcccatgaagaaactgacttacctcatcattttcaataatatgaacccattcaactaaattattaagtcccttcattcctgctaataacttcatattatatgttatagctccatttccaaataattttcccactgttattgccatataaatctccccccaaatttatcatttcttatctaaagcgctactaactgctattataaattcatataaaatttttatatgtctataactattttattcattaactattacttaattaactttaaaatatattgtaatacatataaatcatcaaaatcctgtaagtgattttgataattttttgctaattaaaatccatatgattaaataaatacaaaaaaacaaaggtgagctataaactgcacctttgcttatattattatataatatatttaggtttaatggtataattttgaaaatatatttatttttataatacatttatatctatattattttccagctacttttaatgctatatttacaacattttcaacagtaaatccaaactgttcaaataacttgtctgcaggtcctgaggcaccaaatgtatcaagtgaaataacttctccatcaagtcctgtatatttatgccatccaaatgaacttaatgcttctactgcaactcttgatctaacacattttggcattacactttctttatatgcttcatcttgagcatcaaataattcaaatgatggaatacttacaactcttgtacttatcccttttccttctaattcatctgcagctttatatattaattcaacttctgaacctgatgccataagaattacatctggagtttccttagtgccgtcttttaatatatatccaccttttaaagcttcttttccgctttctttgtataaaggaaggttctgtcttgttaatactaacgatgttggagtttttccatttgttactgcataataccatgcagctgctgtttccttagaatctgctggtctgaaaacagtcatattaggcatacttctaagagctgccaattgctcaattggctcatgagtcggaccatcttcgccaacaccaatactatcatgtgttaaaacatatgttactggaagattcataagtgctgataatctcattgcacctttcatgtaatcactaaatacaaagaatgttgaacaatatgtctgtaatcctccatgagcctgcattccatttgtaattgctgccatagcatgttctcttactccaaaatgaagatttgaaccacttctgtcttctgctgaaaaatctcccctgctgtccatattagtcttattagaaggtgctaaatctgctgaacctccaataagattaggaattatttctgcaagtctgtttatcaatattccagaagactgccttgttgctattgacttatcaaaactccaaaattcttcactttctaaagcttcaacattaacctttccattcatccattcttcatactctgatgctaattctggatatgcactcttgtattctttaaataaatcattccagctttcttccttagcctgtccttcttttatatattcatccatatttctgtatacttcatctggaacataaaaatctggttcaagtttccaccccaggttttctttcatttctcttatattatctgcacctaacggttcgccgtgtgctgaagcttttccttgttttgaaggacatccaaatcctataacatttttaacgatgattaatgtaggcttaacaacttcagcttttgcttcatctattgcttttgaaatagcatcaatatcatttccatcggatactttaagtacctgccatccataagcttcatatctctttgcaacatcttctctaaatgcaatatcggtatttccttcaattgaaatattgttagaatcataaagaactattaattttccaagttctagtgttcctgcaagtgatgatgcttctcctgaaataccttccataagacatccgtcacctactatagcataagtgtgatggtcaacaacattataattatctttattgaatttattagcaagatagctctcggccattgccatacctactgcattgcatattccctgtccaagtggacctgttgtaatttcaactcccttagtatgtccatattcaggatgccctggtgtaagacttcctaactgtctgaagttctttatatcttcaattgttagtccatatccaaataagtgcaataatgaatattcaagcattgaaccatggcctgctgataatatgaatctatctctgttttgccaatttggattctttccattatggttcattttactccatagtgtaaaagccattgatgctgaaccaagtggaagccctggatgtcctgattttgatttttcaattgcatctgctgaaagtactcttattgcattaatagataactgatctaattctctactcatttttttcctcatttcttagcttatttttatttatataaatatttttcaattatgattttaaaattatgataaaaattattctttgagattacttcccaaatgctgctgcccagtctgctttaaatttttctaatccttgatcagtcaatgggtgtttaatcatctgctctactaaattaaaaggaactgttgctatgtctgcacctgctttcgctgcaagcaatgcctgcgttgctgagaatgataaaccccatttcatttgcttctataatataatctacatttgctgtatctaaaaaaaatttcattttactattctcctatctttcctttaattattataaaatttcaaattatctttttaaaatatatttaataagtgtataacatactcctaattcactggattattatacattacaataaataagctattttatttttaaaaactcttcaataacaaatcttgcagcccctaataaatatgattctttaaatcttgttatttcaacattgcatatagactcatccaaaaatagattatctttatatattacttttcttagataatcaatttcattattcaaaatattatttatttctcctccaataaccactacattaggatctaaaagcattgttaaattggatattcctgcacctaatatatccatatatccattaactatattttttacatcaatgtcattattattatatagttcttcaaaaacctcaatatcattaatatctttatttgtacacttattgtaatcttctaaaagtgcatttttagaagtataggcttcaaagcaacctcttgcaccacatttacaaactcttccacctatttttatttttgtatgtcccatctcaccagcagagttattgcttcccatatatatatttccattgattattattccaagacctaccccatcatttattgatacatacaaaagattatcaactatatcctttttgttgagatattcataatatgcagatagattcgcttcattttctatatatataggtatatttaaatattgaaatttctcctttaaattaaaattatctactttaagaagataacatctttttattatcccattttgagaatcaacagttcctggtacagaaatccccatacccaaaagctgtttgtcatctatattatgatttttaagaatgttcaatatattattatttgctagattaactatttcttctatgccttcattattatgtcgtactctgatattttcgatttcactactttttatatttataagagatagctttatatgccttggagtcaacgcaagccctaaggcataattacactgttcatttagtttaatagccattgcttttctgccaccagtagatttcatagctctaacattttcaacaatcccttcttcctttaattcagaaatatttgttgaaactgtggttatgcttatatttaaagtgcgtgatatatctagtttagttatctcatctttttccaataataattttataatcttttttctatttgtttctttgattttgctatgatttacttctttcaaatttataagctgctcctttctaaagctaaatcctaatctacagttagtcaatcataatatggcaacaatgacaattaaacactatgtgtattttatagttgtatatcttttaccttatcataaagagaattatatactgtataaacttcatcatatctttcctttaagtttttatctggattaacagtatcattacccttaacaatcttatcacatgcatcttctactgattcatatataccagctcctacaccggctaatattgctacaccaagtgctggaccttctgaagctttaactgtcgttaaattatattggaatatatcacaaagtatctttctccaaacttcactttcagctccgcctccacttactcttatgtcttcaatattcacattcatgttttcaattatatctaagcaattctttaaactgaaacttacgccttctaatatacttcttataaagtcatcgtgattattgattaatgaaactccaaagaatccacctttaacattgggatcaagatgaggagttctttctcccattaaatatggaagataaaccactccattagaccctggattagattttgcagctttttctgttaatacatcataaatgttacttccttcaactttacattcttcaacttctttcttacaaaatgtttctttaaaccatttaaatgataatcctgctccctgagtaacccccattacatgccattttcctggaactgcatgacataatgtatgaactcttccaagcttatcgaacttaggtgtatctgtagatgcaaaaacaactcccgatgaacctattacagttgaaatcactccttctcttacaattccgtttccgatagctcctgctgcctgatctcctgcacctccaactactggtgtaccttcctgtaaacaggttaacattgatgcttctgcatgaacatgtccacttacaactactgattcatacacatcagccaataatgacttgtctattcctaagcatttaagaagttcatcgctccagtttcttgtatttatatctaacatttgcattccacttgcatctgaaacctctgttgcaaatactcctgttaatttaaatcttatatagtcttttggtagaagtactttattaatttttctataattctcaggttcattatttctaacccacaataattttgaaagagtaaatccagtaagggctggatttcctgtaatttctatcaatctctcctttcctattttttctgtaatttcttcacactctttttctgttctctgatcacaccatattattgaatctcttattaatttattttccttatctaacaatacaaggccatgcatctgtccacttaatccaacacctttaatttgtgagtttttaactttactcttttccataacatcttttattccctgaacacatgcagtccaccaatcttctggattttgttcagcccatcctgcctgtggctgaaataagtcatatccataagtagctgtagccatagtttgtccattctcatcaaataatgcagtttttgttcctgaagttccaatgtctaaccctaataaataacgcataatatccctccgtaattttattaaacatttacaaattaaaaataaaaaaattaattattaaaattctttttaaatgtattttaataagtttatgataaagctattagcaaaaatagtcaatacttttataaaataaaaaatggctacagttgtaccatagccgttgattttattatttaattttatctatatgactctttattacatcacatgacttcctaaaatctcttagttcttcattattaagatttaattctattactctttctattccatcttttccaatcatacaaggtgtacttgtaaataatccttcaaccccatattgaccttccatcaatgtagttactggcattatctgcttttcatcgtgaaatatgcagtttacaattcttgcaagtgtagatgctataccaaattcagtagctccttttcctgcaaaagtaacccatcccgcacctataacttcttttagtaatgcttgtttatcaagatgagcaaaatgatcaggatcttccttttcaagttcacaaagtggttttccaccaaaacttacatttgaccatgcagccatttgagaatctccgtgttctcctaatgtatacccttgaatagatttatgatctactccagtttctcttgctaaaacggctctgaaacgagaactatcaagtcctgtacctgtaccaaaaaccttagatttatcaaatccagataattcccatactctttttgctataatgtcacaaggattagttatatttatgaaaataccatcaaaccctgacttaactattttttttacaaaactatcaaccatttctatactttcttgtaattcatctaatctatcatgagtcttagttattattcctacacttattactactatgtcacaatcctttaaatcttcatattccccaacttcaatattaactctatgtggtaaatatgtaacactgtcaattaaatcctgtctttcacttactgccttctgtttatttatatcaacaagtactaactcatctactattccctgagttgctaagctaaaagcacaatgtgccccaacatgtccaactccaactattccaacttttttcaacttattactcattttttaatcatctcccctttaattcatttttaattataatcccaatttttcattcattcaacaatttatgtaaattattgaaactttatcattaaaactcataaattatgatttatttataataaaaagtatgaatatatattgcaatcaataatttgcatattttactttagaattagtgttcttgaattttaaattaatacgtacttactattttttatagattgacatattattacttttatagtttataataaattagtaacataaaaaatcaatcacaagagaaatataaggtaggtgatatattatgcgatataagaaaacattattaatattttttattattttaactttttgcgtcctaggataccctgcatatcttttatgtggcaaaaccttttctaatttatgtcttcaatattcttcctctgaagaaagtaaaatatctcatgttgacaacatagatagcacttctcaaaattcgccctatgatttagcatttgcagttctaggtgatatacatgataatgaatctgattttcaagattcagttgatgatataaaaagcactgatataaaattagatgcattaattttaaatggagatactgttgaccaaggtatagcatcacaatatgaagaaatgaagaatgctatccagaaaaatataaataatcttcctagtactataattaaaaatattggtaatcatgaattttatgattatgaccacggaaataaatcaaaagaagatgtagatgagaaaatacaaaaatatctagattttgctcaagaaaaaaatgtataccatgacaaatggattaaccaatatcactttatttcattaggctctgaagatggtaattctcccacatgtaactcaacatcagcctttatatctaatactcaaattgcttggcttgaagaaaagcttgcagaaaactatgagaaaggaagaccaatatttatttttcttcaccagcctctaatattaaattggggatggggggatattcctggtacaaatgtaagctctaacttaaataatatattctctaaatatcctgaagtaatattgtttaattcacatacccataaacagttgactgaagaatgtataaatacaagtaatggatataccataggtcaaacaggtgctgtaagctatactctttttaataattcagacaatacactgtctagagattattcatatacaaatggattatttgtaacaattaaagataatatagtcaatattaggggacgagattttaaaaaccatgaatggatattttcaaaagatattgattccaaataaatataattcaatttatagtaattctaatacattaacataataaaggtgccaatttatggcacctttaaattagataatcttcaccttttctgaatattttactattaaattatatttctcaatattaaggttagataaatactttttaaatttatactgccattccttttcacatatattcaacaaatcaaaatctttcatatgtttaaataaaagtataacttctatctctgataaagttttaaaatattcatcgtattcactttcaaataagcaatctgcttcaagcatatctacaatatcctgaagactttctatgttattctttattatttctattttattatcagtttcaacactgtttcttattttttcaataattgctctaaattttgaattactcaatttaggtttatctatatactcaataaattgattctctaaatcatctataaatgatataaatactttttcaagtttatttaattttatacaattatatatatgctttactgaatctgcagctgccatgttcatatactttttcaattctttattttgtatattaagcatatcaatacatgtttctgagcacttaacaaaatatacttccaaatcatcatatgaaaaactttttagtttgttatatatattattacgatcactttcatttatatttaaattattaagatttttaccacatattattcttccaattgaattaataaatatcaattcaaaaatatttatcaataaaaattcactttccctatcatatccattaagaacttcacttatttcctgtgtattaaaatttctgcagaattcattttccagatctaaagtcttaagatacttctcaatatattcaattcctacacagcctatatcaccaccgatatctccaataaatagttgataatctatagaacatggtgcttcctgtggtgtaaaaaaatcattataggttgtaaaaaatattccaataccacgatctattgtatcattataagaaatattatctgttttgagtttatcattttggacttttaaaaagagtagtctgctttcttctctttttttcttaattatcttaaatccattctgaaacataaatgataattcttcattttttaatttatctaaaagaatattttgtttatttaaattctttagtcgtttatcttcttcatataattcttttaaatatatacttattgtatagtcaattccatctaaaattttttcagcatcttcttctaatacggaactactttcatcttttgtataatatttaagctgaacttttaatagttcgattctttcataatttattctctttaaattttcatcatcaattaattttttttcatagcattttaccaatagatctttaaaaaagaattcattattcatattagaattcaatatgcttttataatcttcaaacactattttgtttgttttttctaagtcatttttctcattaaaagtctcaattttttttaaatccattttatcatcaccactcatacttataaatatctaaattattacaatacttacttttacgtttattgattcttataaatactataaaaaattttttattcctcaacatatctctactttcatatagacaattattctttttcattatttatatctgtataatcttttacaccatttcttatattatctgcaattatataaagaacttttccttcaagaagctctaaagagccttgacagtagccatcaaaatattctttcattatttctataagttcatcatcaccaatcatatctaacgtttcatttttataattataaaaaatttctactaattcatttattgtatcgctataattgaattgcgatatatatggtgaatcacaaaagttctcgattaacttagttattatctcaccattaaattctattcttccacttcttttaagagctatttttcttgttttcataatttcttttacatcattatcagtaagcttaagataataattttttgtcaattgatttgttcctataatatcattaaatacttgtgtttctattaattcattactattatttgtaaaaaatctagtaatttcattcatttttcaaaccttctttcataaaaactattgacttttatcagtttttatgatatatttaaattatatatatcataggattattatacatttgacactttttattgtcaatgtattttgtcgtgaaaaaattaatagtacattataatattaactataaaaattaatctcagtatataggttttactaaacttcatatactgagattatttcaatttactattaaatttaaaattctttattattataaattaatcttgaacatatgatttcatcagcttatcatatcaaaaaaacttacctgatcactttcctgcataccatttaagcaaccaaattttcttaacaagtcagtagctgaattacctattttggcacgcttctttaaattatctacagaacttattggctctatttcatgaacagccgcatatattgattctgccgctacacttcccattcctgcaatactatttaaaggcggccttaagccttcttcttcaactttaaatttagtagcatcggatttatataaatctattggcaagaatttaaatcctctttcatacatttcaagtactatttctaaatcgtcatacatatccttatcctttggtgctgcatcatttccttgtgctaatatttctgccattttttcttttactctgtcttttccaaatatcataaattctgcgtcaaaagcctttgctcttattgaaaaatatgctgcataataagccttaggtatgtgtaccttaaaccatgcaattctaaatgccatcattacatatgctgctgcatgggcctttgggaacatgtatttaatttttttacacgaatctatataccattctggaacatcattttctctcataagtgcttcatattctgcccatttttctggattttttaaagcctgccctttacgcacaagttccattattttaaaggcagtatttggaggaagattcatcttaataagataaaccatgatatcatctctacaacatacagcatcactgatacttgtaattactcctgtatcaattaaatccttggcattaccaagccatacatcagtaccatgagaaagaccagatatacacaataaatcagagaatgtttttggaagtgtatctacaagcattcctcttacaaattttgttccaaactcaggtataccaaaagtaccaacttttgaatttatctgctctggggttacaccaagagctgttgttgatgaaaataaagacattgtttctttatcatccaatggtatagtgtgtggatttattccagtaatatcttgaagcattctgattacagtgggatcatcatggccaagtatatcaagtttaagaagattctggtcaattgagtgataatcaaaatgtgttgttataatatcagaatcaggatcatctgctggatgctgaactggacaaaattcaaaaatctcccttccttttggaacaacaattatacctccaggatgctgtcctgtagttctttttattccagtacatcccttagcaattcttgttatttcagccttagttatagtttgacttttttcttcataatattttttcacatatccaaatgctgttttttctgcaattgttccaattgtaccagccttaaacgttgttccttttccaaatataacttctgtatatttatgagcttttgcctgatattctcccgagaaatttaaatctatatccggttccttatctccattaaatccaaggaatgtttcaaagggtatatccattccatccttatccatgttttctccacacgctggacataccttatctggaaggtcaaacccatttttagatccataatcattaaaatcagaatatttacatttaggacatctgtaatgaggcggaagtgcattaacttcagtaatacccgtcatatatgcaactactgatgaaccaacagaacctcttgaaccaacaagatatccatcatcattagatttccatacaagcttctgagcaattatatacataacagaaaatccatttttaattatcgagtcaagctccttctcaagtctgtctttaactattttagggagattttctccatataattcatgtgcttttccataagctatgtcctttattgtctgttcacatccatcaatatgaggtggacacttttccggcgaaataggacttatctgttcacacatttctgaaattttatttgtattagtaacaacaacttcataagccttttcttctcctaaataggaaaactcttcaagcatttcttcagttgtctttaaatataatggtgcctgcatatctgcatccttaaatccctggccggcttcaagtatacgtctgtatatttcatcttctggatccatgaaatgaacatctccagttgcaacaacaagctttccaagcttttcaccaagacttattatctttctatttatttcttttatatattccttgtttggaacctgctcatttctaattaaataatcatcatttccaataggttgtatttcaagataatcataatccttagctatattttcaatttcttcatcagactttccaagaagtattgattgaaatagctccccttcactacatgcgcttccaagtatgagtccttctgaatattttttaaacatactttttagtatacgtggttttttataaaaataatcaaggtgcgaatatgatacaagcttatacaggttctttaatccagtataatcttttgcaagtattatagcatgatgtgttcttagttttttatactgaaccttttttgattcttcatcacaagcatatgtctcaatatctgaaagagtctttgcacctctctccttaagcatatcaatcattacattgaatactttaacagtcgtatcaacatcatcaagtgctctatgtgcaacttcaacttttattcctaaattcttggctattcttccaagtttatagcttttgtattgtggaaaaagatcctgagcaagagatagtgtatcaagatatgtgaaatcaaagtcatgccctaaaactttagcataatgccttaaaaatccaatatcaaactctgcattatgagcgacaagaatacttccttctatgaattcaagcattttaggaaataccttatctattgtttctgcatttcttaccatatcatcagttatatttgtaacctcaacaacccttggcggtataggtttttctggatttacaaaggtactgaatttatcaataacttttccatccttaactttcattatccctatttcagttattttttctagttttggagaaaaccctgtggtttcaagatcaagaacacagtatatatcatcaatgctctgaccttttatatttttaacgttaggttttttatctggtgctaaatatgcttcaactccataaattatcttcatatcagggttatctcttccaaggagcttatgtgcttcaggaaaagcctgaacaacaccatgatctgttattgcaatagatttcattccccagctcatagctctctttataagatcacctgcactagacattgcatccatctggctcatctttgtatgcatatgaagctctactctttttacttctgaattatcaactctttttgctcttttaattccatttgtctctactattatattggcaataatttctatctcaccagaaaacttgctataacctgaattaccacaaagcctcacacctttagccttttttagctttgatattacttcatcactctgttcaggttttaggaaggatttacagcacattgaacttgatccatcatataaatcaaaagaaacaagtatcttaccacttctcagttcttttgtttctatattcgatatttcaccttcaattgctactgtaccttcataaggagtaatatcaataattttaactatattctcttttatattgctacttctaccaagaataagaaatggattatttttcttattgctttttccctcactttttgattctcctccattagcttgataaaaacctttgttaaatgtaccctgcccatctgaatttttatttgattcagattttttttctttgctgctatttcctgatgtttcaaaacttcccgatgaaactttgatttctttttgaaatctaatcatctcttctttctttttatcttcatttaacttattctgttcttcactgcttacattatcacaaaaattaattctataattttttccataaatatcctttactgctttttgaatctcactgtcatattttaaatttttcaacatatgcgatactgacatattaaaacaaaaattaatttcattttcttttatttcataatcacaattatttatcactgcttttaaatatggatgtctattagataaagtatataatatgttatccatctcattttcaattggacttatatgaacctcttcagaataattaataattattctagattcatttagcaagaatctttcttttataaaattgttaagtccttcaatttcatttatttcaatatacttatcagaactgacttcaatttcaagtattttgcttttcttttttaattttattttttcaacaatagcagtatttatggtgccttcacttttgtaatcactaaaaacctcattgatttttttcattactatccaaaccttccacagtaaatttttagcactttacattatatataataactaacttatttgtcatatattaaaaatagctgaataaataaattgtaataaagaaacctcaaaaaatcgcttcatacttaatatcttcttaaaattagagataatttaaataaaaaatagaggaagtttataactcctctacttaaatgttaccatacactatatttctttaataataatctaaacaaacccctttgtcttttatatttattattctattctatatagtgtatttccatcttttatagtctctacaacttttatttctttaatattttcaatgggaatttctaaaggatttttatctaatataacaaagtctgccttctttcctacctctatacttccctttttatcttcttcaaaatactgataagctgcatttatggttacagcttttaaagcttcataaactggtatcctttcatcttttcctaatgatattccctttttagttactctatttactgctacatgaattgtttcaatcatattaggttctattactggagaatcctgatgaaatgtaaatttaatatcctttttcaatgaagatgcacttaaacttattcttgaagctctctctagcccaaaattacttatatgtacatctccccaataataaacatgagctacaaaaaatgaaggtattattccaagctcttttactttatctaattgatctctatctaaaaattgagcatgaatcataactggtcttatgccggcaacatcgtatccttcatttttaatcttatcaattgcatcaatatactgtttagctgctgcatcaccattacaatgagccaaaatctgcatattattttttgctgcttcccttactgcatcacaaacatctttaaattccatagttccatatccaaggtacatttcatcatttaagtaaggttttctcatccatgcagtacgggcttgtggagaaccatctaaaaaaattttataacctccaactttaaaattattatcatacttttttatagatttgctgaatttatctttgaagatttcaacagaatccacagctgaatatcctactacatcaagatttattatttttttatctattagagcctcatatagtggtgctacttgtgaaaccatcattccttcttgaactgtagttattccataagataaatatcgttcttgagccatacaaaatgcattaaataattcttcaccgcttgccattggaatcttctttaaatatttcataaaagcattttcttctatatatcctgttaatttatccttgtcttttcctattacccctccacttggagatttagtatttatgtttatatccattaactctaatcctttagagttaaatacaccagcatgtcctgatttatgctgtattataattggaaagtttcctttcacattatctaattgaaaacaagttggatgttttttatttataaaatcattatgatcatatccttttcctacaatccactgattttctttcatattatttatttctataaacgaatttatccttttaattatttcttctacgctagttgtttcttctaatgaaacttgtaaaaatgaatttgcagttgctgaaaaatgactatgtgcgtctataaatgctggtaacatagtttttccatttaaatcaatgagctgtgcatctgcattattttttattatttcctcttttaatcctacacttttaataagatcatcttctattaaaactgtatctactattttattgttttccatggttataattgaaccattataatatatctttttcatctctacccccttagttatataaaaaaaagcactaaaactttataattagcgcctttgccttaattattaatataatctaccattttcttaattatatactatattaatgtaaatttatatatactagtaaacaatcttttttgttctacaatacaaaaagatttttagatttatatttatatcttcttaagaagtttttacaacacatctataaaattttcatttcactttacagaattttgcatattatataataaaggtataggtgaataatatgaaaaggttaaaaaaatgcgttatttttttatatgtatatttactatttttttaatatctataaatgtttttgttatattttctcataacacaatgtcttcccaagtagaaaatctagcacttataaaatcccaaatttcagaattagattccttcaaaacaattattgtgaatcttggacattctcaaaaattctatttattatctcaagatgaaagctacaaagttaaatatgataattatcttgaagatgcatataattctttagatgatttatctcagaaaaattgtataaatgagggatctaaaaaaaatatcaaagacatgttaaaagagtatgatgctataaatgtaaaattgctggatactaaagtaagtttaccattaagttctgatatgcagagttatcttgcgaaatcaaatgaaattcagataaatataatgcatagtatttctgatgctatttcatcaaatcaagatagcacatcacaaagccactcttctttagaagtatcaatagataaccaaaaatcttttgttcaaggattaagtagtataacaacagttattattggtggtccctttgctatatcattaaaaaatataaaaatggcgaattaaaattagatgatattataactattctcgataaagaaaaaattaaaatagataattattctaatataataatgtttgcatcaatattaaatagtcataataaagagatgaaacatcaatggactgaagttaaagaaaaggtggaatcacttcaactttctatttcagatttaaaaaatacggctgcaaattataatatatcaatattatctgatttcacctctgaaatacaagatatggagataaaattattagaaatacgatttttaataaaacaactaccaaattaccatgaatttatagtaaatcttacagacaatataatctctacagaaaaaaataaataattgtagaaattttctcaacttttaccatttaattcattctgctttcataaatccctattcaatatctttccataatatatattctatcatcttattcttattttaaatacaataataaattaaaatattatatgaacagcagaatcatttattaaaataattagttttattaatatgaaaagctgacataaataatacgttgactataattatatatcaacgtattttctatataaacctattcttaataaaactacttaatattctttatggcataaaacttttcaagcattctatcaacatcagccatattgttacattctgcctttttttctgtaatcataagtccctttttttgcttatcataaatataagttttataaatataagtattacatcctgtacatttaaacaacttgttcatcctaaaatctcttctgttataattgtaaaattttatagaatctatttctttagctttacatctgcatccatcacataaaatttctttattcacttcatttttcagtagactttcatcagatgacttatttatatcctttgcttttttaaaacttataaaataattatatttgtataaatcatctattcctatcttttgaagaatagacttagtaataactgcatcataatatgcatcatgatatttatctctacatgctgatatattatatttttcggctatgccttttaaggatggatctatttttattccttctttattcataactactctttgcaaatctatataataagcattatttaaattaatatttttaattttattagcttcaaaattcttattcaaaataatccagtcactatatccccatgtaattattacaacatcttttaaattttctcctataaaatccataaactcatatactgctcttttgaattttactccatttgtttttatataattcatatcaatttgtattaaatcttgaactcttttattcaacgtgaccaaaaatttaggttttatataacgtttaaaacttgatatatattttagattttcatcaagttttactgcacctatctgtaatatttcatctgtcatatatgatggtctgttcagatgtaaagtatttgaaagtaacttatttctattatctatatgattatattctaaatctaacactataaatatcatcctattcccctcatataaaattcaataccttcttaactatttaacaaaatcaaattaaatatctaatttaatactttattgctgtgaaatattcttttcgtgaatgtaaatttatttatcatatataatactagtatatataatgaatttacattttaccagtatattccaaagttttatttttctaattaaaaacgaagaagcaatagttataaaataatttttacttcttcgttttatgttatataagtttatatatgaaattctatcttttaattatactccagtatctattgaaattttttatggttcttaactaacaccacctgaaaagatcttactcttttcttttggaagcttatttttagtaagaatatcataaaagccagaaataatatagcttatagtcataactatcataattgcaaccatttcatcaccaccaaaatattctaaagacatggcaatagacgtaattggtaaagaagttgctccacaaaaaacaccaatcatccctaatgccgtgcatgattctaagggaaatccaatatactttgcaactgcacttcctaaagctgcacctacaaaaaatgttggattacctcttccaccttgaaatactgagcccaatgcaatggcggtaaaaataattttccatacactatccatcagtgttgcaggcttatcaaatgcatctcttataaacgtttgtccaagtccattgtaattatctccaacaagccaaaataacactattgtgagaactccacctaaaatagcctttaaatatggatttttagtaataataccataaatcttgctactattatccaataccaaattgaaaatagaaccaccaactccaaaaattataccaagcagtactagttttattaatatcataaaacttaaatcatctaacattaatattggatagttaaccttggtattacctatagctgccgcaatttcattagaaaatactgttgttaaaaatgctggaattaatgcttgataatgaaatttccccttaagaacaagctccatgcccaaaattgctccagcaaaaggaacatcataaattactccaaaagcacttcctacaccacataatactaatgttctctgatcctcatttgaaaggttaaactttccagctaaaaaatcacctaaagttccacccatagcaactgcagatccttcttttcctgctgacccaccgaaaaaagtagttgctaatgagcctaaaaaaacaacaaatgtcatataaaaaggaatatccttaactgctgactgtacttctgactttaataggttttttccagaatacgcatttctttcagtttttaaatacataaaggtaatcataactcctgctataggaagaaaataaatcaagtattcatgatattttctatatctattagcagtcgttaatattatattatagtatcctacaacaatgcctataggaattgccattataatactcaaaataacccatttaaatatcttcttaattatagcaatataatcattcttgatttcttccattatttttactcctaactaaagtttattcaactctagtatctgtatacacatgataaattatttatatcctccaacttaaattacttaaaaattgttaaatcaaaatttcttattaaatttaaaattggccacgcattgcgtgaccaattccttttaaatcaatattttctaatataatattgttagctaaataaaggtaaagttcaatccatttctcttattctgaaatgctgtccatccaagcaaataattcatctaaatcataatcgcctccgtgaccttgccccaaggcactgcaaaatcaacaattgctccattactttcaagttttaatgccagtattgttggcgttgatattgctgtatcactatctttaacaccatgtcttatacgccaatacttagccatatctgttccttgcgtcccaatatagttcattggattcatcatagttattaactgttcgtcagccatagttccacctgaggtatcattatctaaactgaatttagtaaaatgctgattatcaacagtttcagtcccgaataaattattttctggatttggattatttaaatctacattatcaaatgctggagctgcctttgatcttgataaatatgatacatacccatcaaaatctacatctgtaacagttccattacttattgtaatccatgttatgtcagataggtcttttcctgaatcaatagccgtctgtgcagatttaactacatatgattttacgtaatctttaaacgttccatttccattttcatcaagaattaatgaatttccattttcatcttttaagtttaagctgtttatataatctggaaaagcagcttttaattcgtttgaatatttaatctgatcttctgtttgagtaagagactgcttttctctgttaatatttccattttcatcttttgaaatattcattttttcgtaatcatttaaaccattaaataaccattcatatcccatatctgcattatcaagatttgttataggacaatatgaagaaacagcatatatagcatcagatgcatctgctgctccaagttcttttaagtacgcttcataatctccattgttacctgtagctccaagtaaagcagacattgctcctccagcgcttgttccgttagatattatcttatctgcagtacccggcattgcttcatcattataatgtaaatatcttattgcagcttttaaatctacaatacctgcaggtgcttttcctgtattagttccatcttctgattcacttgtacgtcctcttgtagaaggagatgccacaacgtaccctttagataatgccattaagagtgaatttggagattcttcttttgaatcaccgttgctagtcattcccattcttgatgcctcaccatcaattgcacccttcatagatggtgttccagcttctgatggcatatatccacctatagtgttaggaaagaatattggtgcattctctgctgtaaaattaccaattgattctccattaaaatattcttctggaatgtatatattcatggattgatatttttcatctataggattttccacatataccacattctcatatgcacgaaaagtaacttcttcaccattaacggtaaaagactgagtcgtatagttatctttattaaagcttaatgcagtatttttattttctactacttcacctttattagaactaccactagttaaatttttactgttactacatcctgccactgaaaaaatcacaagtgatactgcaataagctttgttatcattttaattttcattgtatcatcatcctttcatgtatacataatacacatatagattgtatttatattattattttcttatacttgcttctcctgttatttaaaaatatttataagaatcataaattaaggctgtctatacaatgattctaacagaaattttttaatgaattgtggcgtaaatgtgtcacaaaaagtacattttaaatttttgtataaaaaagtgtatcatcttttaagaatcaacacttttaaaattaattattatatctatgaagagtaaacacaaagctcgttacatcttccctgctttcatcaatataaatatcttcgcctaaattattcattatttccttagctagtgataatccaaggccggatcctttttcattatgagatttatcacctttataaaacctttcaaaaataaattctgcatcttcagaatctattggatcaccattattttcaatacttatttttataatttcatcattccatgatccattaacttttacatatccatcttttttagtaaatttaaatccattatctatcaatatgaacataacctgcataattctgctttcattactataaaaatctggaatattcaatgcatcttctgttaatataaactctgcctccatatcttcagcaaatacttcaaaatattcttctatttctgtcattatcttttttccacttactacttcttttaaaatagccatttctcctgattgaagtcttgaaagttcaagcatatcattaattaacttttgaagtctctttgattctcttaaaacaattaaatagtatctcttctttttatcttcatcaagttctaagtcatcacataatgtttctgaaatagctcttatagatgaaataggtgtccttaattcatgagaaacatttgcaatataatcacgtcttgtttgttccagcctccttgcactttcatcattgtctgaaagtctttgagccagattatttaaggaatttgatagtatctttatttctccatatccatcacactctgcacgtgctgaaaaatttccaagagccatagaattagatacattaaccatctcaagtaacggttttataagttttcttgtaaaatagtaaattaaaatgataattaatagtgtagataataagctgcatatgaaaaatacaacataaaaactgtttactataactgaaaaatcacttgccaattttacagtgaaaatagttccaacaactctatcattatcttttattggaagacctattattatagacttttctacaatatgatttaaactttcaattgttgtaacttttccttccttaaaaactatgtctatatatggttgtaaatcttcctttatctcttcatccgtaaagaacctatttttctttatgttattatcgtcaattggtatttcattattctccaaatcatacgctttaattattagtctttcttcatttttaatttttatagttccattctttattcttgtttctgacgctatattttccattataggagtaagctcttttaactgctcattcaaaaaccattcttttattatgaagaaacctaaaatttgtcctatgctaaaagcaaccaataagacagcgctaataacccaaagaagtctttttaatagactctgtttcattttactacctcaaatttatatcctattccatatacagtttttattacccatttttcatcttcttcaggtaacttttttctcagcctttttatctgtgtatcgactaccctcgtatcgccaaaataatcatatccccaaactttatctaaaatctcttctcggctcaaaactctaccttcatttgttgcaataagatataatatttcacattcctttggtgtaatatctattttttctccatttatgactgtctcatatttatctagatctatatttaaattttcgtatgaaaatatctttctgttaggtaataaatcacttttactatttactctcctaaaaatggtctttattcttgcaacaacctctcttggagaaaatggttttactatatagtcatctgcacctatttcaagtccaattattttatctatttcttcaccttttgcagttagcattataattggaacctcacttatttttcttatctccttgcatacttctgttccaaaaattttaggcatcataagatctaaaattacaagatctacattttcttttttaaatttttctaaagcttcttctccatcaaatgctgaaatataaatcattccatcattttttaaatatgtaccaattgtttcatgaactgcctcattatcatcgcaaattaaaattttcttcatattactcacaacactccatacttatttgataatttattgtaaattgtattaaatacatatttggatctgatacattattttcaaagatataaattactttaatgtattttggtcatatgtctactttaattattcttgcttataaagtttaacaaaattatcattataagtaacctgtccgcctatatctgaaattccagattccattatccaattgggatttccttgcttcttccaccagcctgcatacatcataacaacattgtcacttattccatcatcaacaataagctttacctttattcgtcctttttgagattcaatataaacacaatctccacttttaaaaccacatttttctgccatcttcatattaatataagcctctgccttttcatctttatccatataatgctggctaaatagcgattctctaccatgagttgttaatattctaaagcagtttttatgatttttatcgtttcccttttctagcatttcttttaatatttcctcattaaaaaatatttcgaactttcccgattgagtcataaaattcttatccatccaaggaatactttcatgaattgtaatgtagttatctctaatatactctaaactaatttgtggtactatttcttttaatggctctatgacatttgttaaatattcttttttacttacccttggataatgctgaatatttaatttttcagctaatttcataaagaaataatattcatccattaagctgtttttaggttctactgctttttcaatgtacgtaatataaggatttgtcattgaactgaaaattaaatcttcactttctaaaactgttgttgctggaataaacaaatcacatatctgtaccgtatcagttaaaaactgatcaatgcacaccttaaaatctatagactttaaagactcctcaagagaattaaggtcaggaagctgattcaataaattactttttgtaattatagccatttttatattattctcttttataaatgaactcatcttacttacataaaaaattctgttatctgcataattttcactatgatacggatcagtatttaaaatacttgtgtaaactttgttagcataattaactccaccaccactttttccaatctgacctgttatagcagcaagtgtatcaataagcgatattgtattgcctccatgtgaatatttttgaagtccataaccaagcaatattgttgaataaagttctgtatatttttctgttataaaatttacaacatcttcatttacaccagctcttttacataatgtattcatatcaagattttctacataattcttgtaagcttgaaatccatttacatgttctgctacatactcagcatcaaacctattttcttctatgattttctttccaatagctaaagctaatgcaccatctccacctggacttacttgtacataataatctgcaagctttgctgtttctgttttgattggatcaattacaattatataacttccattctgcttagctttttttatcatctgcatagtatgaattgtagtatttgctggatttttaccccatactataattgttctgctgtttatcatatcttctaaacaatggcttcttacatcaccaaaattttgcttctgtgcagcaattcctgcactccagcatgggccacccttttgctttgagcatcctccaaaaaaattaaaaaatatatctccaatgctttttagaagactaccacttccatactgttcataataaagaattgattgtgctccatattcttctttgtactctgacagcctttctgcaattatgtctatagcttcttcaaaggatatttctatccactctccattgacttttagaagaggtttatactgtcttttaggatgatttgatcgattaaggtgcataagcccctttttacatatgaatccttttgtataaggatgattcttatctccttcaatttttataacttgattattatcaacataaacattaaacttacaacaatcaaagcaatctaatgtacatccaccacttaattttttcatatcacacctctatatagcttatttaaataatatattctttctttcaagccataattttaagtcatattatagcatgacatatctttaatttaaatctatatttatataattcatctaataggcaccaaatgatgattttataaatgtatttttattaataaaattatgtggtattctagtatcaaaatattaagtaaaggtggaacgtcaatgagtcttaatattcttattgctgaagatgataatctattcagaagtcttgtctgtgatattattacagaccaaggctatattccaattgaagcccgtaacggtcaggaagctattgataaattttttgacttaggtaatattgatttagtaattttggatgtaatgatgccagtttatgatggttttgaagtattaaaagaaataagagaacattctgatatccccattattatgttaactgcacttggggatgaaaagcatgaattattgggatttaataaaggtgctgatgagtatattggaaaaccatttagctatgaagtatttattgcaagacttaataatattgctaaaaaaataaaacatgatactgaaaaagaaataacttatggaaaaattatcattaatcaaagcaatcataaagtaatctctgatggtcttgaaattaaattaaatcataaagaatacacccttcttatttactttataaaaaattctggtaaagtcttaacgcgagaacagatacttaatagtgtatggggatatgattttgatggtgatatcagaactatcgatacacatataaaaactttaagatcaaaacttaaaacagaaggaacatatataaaaacagtacgtggatgtggttatatgattgaggttgaataattatgaagacaataaaaacaaaattatttttaatatttatgctccttatggctttactaattctaagtggaatacttttaaattctttgtttttagaacactactatatttataaaaataaagctatacttataaacacaagtcaaacaattaaagatcaatatattagcaacagcaacattgaaaattcctatgattctatcgatacaatttctctctcttatgggatagatactcttattgtagatgaaaattataatatagaatataattcttttgatttaaaaagaatgcacatgaaaaaattcatagacaaaccaacataccaagctatttctaattttaaaaatggattatcacaaaatactgttttatatgttagagaaaacgaaagcaaaaataaattagtttgtgttacaaatattgataatagcaaatatttaattctaaccaaaaatgtaaaaacaattgaagatagtgtacaaatcgctaatgagttttatctcattgcaggtttaatagttttttctgctggttctttatttatcttatttttttctaaaaagataaccaaacctattgttgagatgagcaatgttgctgaaaatatatctaatcttgaatttgataaaattgttcatgttaattcccaagatgaaataggtgcacttggagagagcatcaataagatttcatataaattaaataaaagcataaatgaattaaaaagagatgttgatagaagaaaaagttttttaaggaatatatcccatgagttaaaaacaccaataggaataattaagggttactctgaaggtttaaaatatggactggcaaaggataaaactaaaattgataaatactgttctgttttagtagaagaatgtgacaaaatgaataaattgatacaagaacttttagattattcactaatggaagatggattgattaaattaaatataactgattttgatattaatgaatttttaaatgatgcacttaaacgctttacccctattttagaagaacaaaagattaatttaactttaaattgtagtgaatcatatattttaaaggcagacaaagaaatgttagaaaaagcactcaataactttattactaatgcaataaaatatactgatgctaaaaaatctataattgtaacaagccagcttattgaagataatattcgaataagcgtctttaatactggaaaaagtatacccgaaaatgaactcaaaaatatttgggatgtatattataaaatagataaagctagaacacgagatgtggatagccatggaatcggtctttctttagtaaaattaatagctacccttcataatggaaactgcaaggctgagaatatagaaaatggtgtattattcttcatagaaatacctcttgttcattgtgaaaattaaattctatattttcacataaatttcacaaaagtaatttattattatatctgtagtcatgagattgcaaaataatagaaaaatttaagggagagattttatatgaataagaaaaaattattaggaactacattggctgttttaataggattaacaagttcagtaccagtttttgctgatactactacaagtaatacatctaatacaattacacaaacttccgataaatgtaaaactagaataggacataaaaaaataaacttacaactgagcaaattgctgaaaagttaaatatagatatcactggtctatcagaagatgaagctaaagctgctgttaaagaagctatggctgaaaaacatcttgctaagcttcaagaaaaagcttctgaattaggtattaatactgctaatttatctgaagatcaaatcagaactgctgtaagagaagctatgggtactgagaattctgaaaagcatcttgctaagcttcaacaaaaagctgctgaattaggtattgatactactaatttatctcaagatcaaattaagactgctgttaaacaaactatggataaaaaccttcaagaaaaagctgctaaattaggtattgatactactaatttatctgaagatcaaatcaagactgctgttaaacaagctatggctaaaaaccttcaagaaaaggctgctaaattaggtattgatactactaatttatctgaagagcaaatcagaactgctgttagagaagctataggtactaataaagaacgtagacaagcaaagactgaacaaactacatctacttctgtaagtaatgaatcattagctgatactgaaaattaattaataaattattctattcaatcttcattacattaaaatacacaatgtctaaaattcaaggggatatattccaaaataataagcatccccttgaaataatattttgctaaaaatctaaatatgtgctattttcaggtactccagatacagatacatcataaccttcatttaataagcttatggcattcatatcttctgatgaaagttcaaaatcaaaaatatctaggttttcttttattcttccctcatttgatgatttgggtataggaataacacctctttgcacatgccatctaagaactatctgtgcaattgtcttcttatacttttcagctaagcttattataagttcatttgaaaatatctttcccctcattataggactccatgccactagctgaatattatttttattgcaatattcaaacatatcttcctttgtgttttgaggatgtaattctacttgatttaccataggcattatttctgcacttttctttaattcttctaaatgccctattttaaaattacatactccaatagcctttacttttcccttcttatataaatgttcaaaagctctccaagtttcagaatttaacttatttggccaatgaattagatacaaatctatgtattcaacttgaagcttctctaaggatttgttaaaggcttcgattgtcttttcatacccatggtcatcattccaaagttttgttacaacaaatatatcttctctttttactttacttgttttgattccatttccaatcccctcttcattcccataaaatgaagcagtatcaatctgtctatatcctgtttctagcgcatatcttacaatactagcagtatcttcatagtttccagatttatatgttccaaatcctattgaaggaattttcacaccattgtttaatgttttaaaattttcattcataaaatataccttacctttcacattccattattcgtacaccgttttcttctgcaactattgccttggttgcaatattataaaatagagatgtatctacaattcctactattttttttagtttgtcattcaatactgatatatcatctacatcctcactattaaacttcaccaaaaaattatactttatcatcagcaattgattgctcatgtctgcttaatgttttatatacatcgtgctttcctactgtcataaaaagaaataaaatctcaattacagtcattgctgaaattcttgaaaaataatactcctctaaaaatagcttttctctagttgcagtctttatatgataattacttaactttgccaatggcgatttatcactatttgttatagctattgtaactgcccctttttcttttgcaatctctataacatcaatcagccttttagatgctcctgagtttgaaattgctattacaacatcattctctttcaaattatatgtatatgcaatttgagtttcccatattgtattagcaacagatgcaactccaacctgattaaatttatagcacccatctaatgctacaggtattgtatttcctactgctacaaactgtactattcctgcattacgcaatatctgtagaatttccttaaatttttcttcgtttattgtaagaattgtctgtttcatttcttcgattttattaaaaagaatattgttaagtgattccttaatattttcttcacttacatcacctgaaaccctagtatcttctttttgggactctgataattcttttgccaatgttatttttaaatgatgaaaccccttcatattgcatttcctacaaaatcttgttactgtagcatcacttgttccagctgcttctgctaattctgaaatggtcatttcaattaatttggttccatactttaaaatataatcagcaatctttttttcggcttcaaaaaaactgttatattcagcgtaaatagtgtcaataatagatttatctttctccattttatctcccttctcctaagtatatttattataattaatatatcacaaaaataatttttgtgatatattttttaaagaaaattattttcataagcctaatttcttttccttttatgaaaacttcatcttttgatttttattatatttaaaaacataaataaaagacttctcagtatataaccaaaaagtcttttatctcatttacttatgtacatttaattattctatttttttaacttaaatctgtttatcatagattctaatgtatctgcttgagctgaaagttcttcacttgcagccgcactttcttcagctattgcagagtttgattgtactacatcagcaatttggtctattccaccatttatttggtttattgacacagcttgtacctccgatatattacttatattatcaactaactgcacagcttcttctgtctttttaacagcttcttttaatgatactgctgtagtatcagcaattatcttacctttttctactgattttattgaactttcaatcaattctgctgtatccttaacagcctgtgaactttcttctgcaagctttctaacctcttctgcaacaacagcaaatccctttcctgattctcctgctcttgcagcttctattgcagcattaagagctaaaagatttgtttgttctgaaatactggctattgtgtttattatttctctaatgtttctagaagaattatctatttcctccatagctttcaccatttcattcattttttcattgctttcttctatttgaactcctagttcacttgttattacattagtttcttttgcatgcttaactgaattttgaactttttcatttacttctccaagtgacgcggttaattcttctattgcgcttgcctgttcagttgctccttcagatattgtctgagatgtctctgcaacttgctctgctccacccttaacttgtactgttgcttcttttatttcaaagaatgtataatttagtgattctattattttttgaatcgaatcttttgtagttgaaaaatcacctatatagtgctctaaacgactgctattgacattaaaatttccatctgataattgccctaagatttcattaatatctaaaacaatagttttcaagaaggaacatgtatttctaaaactatttgctaaaatacctaattcatcttgtgactcaaatttaatttcaacatcaagtatacctttttctaatttttttgctgcttcttctaattctacaatcggttttgttaatagcttaactaatccaaagaccatataaatacatgatattatacttcctattgaaattaaaattaaaactataaatgttatattttttgttgttattgcactatgatagtttctttctgcattattttttgcataatctcctatcttaactaaagtatcttgaagattatttagttctttttcatactctgaattataaagtgcaattgcctcttcctttttgttctcatttactaatttaattaattcatctcttatcctagtttgtactgctcgctcattttttaattgttccaataactccttattatcaaaattactctctaatttttctatattatctgtaacgctttgagtatatttatttgcttcatttatatattgtaccgctttattctgatcttctgttgttactgctaataatatgttttttacaactatttgtgtgtcttttcttatctcaagttgtaaaactgaatttacgaaaggtttgtcataaaaagccttgattttattacctgttatttgaagtgcaataaatgatgatactacagccaatataaatagtgacataatataaataaatgtagtttttaatttttcatttatttttttatctttaagatgcctttcaaaaaaatcaacctttgctttttcgttgtgtttttcagactgtccgctcatgaatttctctccttaatttgatagaatttatttatatacaaaaatttatgttatatagtatattataccatataaccagtttaaaatcacgctttttgttggttattgtatttttatgtgttatatgcttgtattttgtattataaagtacaactatgtaatcttttaaaaaagtttaatatatgcctattacttgtacttatcataatatatctttattatgatctaaaaaaatttcacaatattaaaaatattatatggttaaatttaaccctataatattttctatttaaatcaaaaaatcacctttttgttaattttgtatatcaattaatttaacaaaaagatgattttataataaattataacaagtgtatcacaaaacaattttttataagattaatcataattatcttttattatcttattggtcgttttgattctatacttttatgcattccaatagatttaacattaaaatttgatctgtactctgtttctgcccaaaatatattctcagcaacaagtgcttctggattaagttttactccatcaagaattatttccttaaatttatgatatccagcccgatcaattaaatggcctccatgaaggtactcaggtttataatcaagtgcccatgcagaaaatttctgccaatttccaaatacaccaagcacaacttcttcagttgcaaaatttataaatgtctttcccattctaggtgtttgctttcctgttcttccacctatcacaattctataaaatttttcaggctttcttgtccacgcacttgctggacatgctaatacacattcaccacagccaacgcaacagcacggatccttatcaatcaatccttttgaatttaatgaaagaactcgtgttgcatgatgttcacaagcttttacacaggcaccacaccctatgcatctctcaggatgatattccattcgtgtttgacctataacaccaaaatcttgcatatgtgctttagtgcaatcattgggacatcctgcaacagcaacttttatatgataatgagaaggaaaaataagtttttctattttattagccatttccttagtattaatattcccttttatacaatgactgttccctatgcatgccattatatttctcgcacctattgtaggatatccattttcagtaatttccatattacagttacatgcatctacttcaacttctttaaggtaatttgtaataaatttattaacttcattaatattttcatactttatacctggtatatcaaaggtttgtcttgttcctatatgaaaagttccatttccccatgtttcagcaattttttgaatatctttaagatattttgcattaacagttcctcctggtacacgcatttgaagcataaactctcctggaacctttgattgacgaaaacaatttattcttacattttttatattaatatcatgattcatatgtaaatcctcctaatctaataaagtttttgccttggtatagttaaacactggtccctctagacatacatatgtttcatctattctacaatgaccacatttacctacagcacatgacatttttctttcaaaagaagtccatatcttttcttctggaactccaagtttcaaaaactctaatgcagtaaagtgcatcatcattggaggtcccacaataactatttcataattatctccaaactcttctttaaatactttatctaaatgtgcagtaacaagaccactttcaaaaccatctactttttcattatcaagagtataaactgtattaaacttatcttcccattttataagctcatttttaaacaacactccatttgagtctttaaatccaaaaagaagatttaaactctttacatattcattatcatataaaaattggtttatcatacttcttacaggtgcaactcctgttcctcctgctacaaccacaatatgtttatctttaaatttatcaactggccatccttttccatatggaccccttaaataaatcttatctcctttttttagcttaaatatttcatctgtaacctttccaacagatcttattgtaaagtccatatacccgcttccaaatccacttactgatattggtgcttcaccaaatttaggaatagataattccatgaactgaccatgttctggtactatatcagtttcaactctaaatgtatattcatgtaaactttctttatttatacttattattttgcatggttttgaacttaatatattactcataattatctctcctttactatttcatccacagcatctgctactttgtttatagttgcagtcattgaaatgtgctgtggacatctatccgtacatcttccacatcctacgcacatatgattatctccaaatttctccttataatcatgtatcttatgaagtactttatacctcatcttatctcctgcagtttttctgaatttatgtccacctgccatttcatcaaatccatcaatatgacacgatgcctgaactcttcttctttcaccaatatttccttctgcatcataaataatatctcttgttgtatagcatgaacatgtgctacaagatattgtacaacttccacattcaatgcatcttccattaaattcattccacatagggtgattttttaatttttctactacttctttactatctattgttgggattcttacatcaaccttatttttttgaataaattcaagattaaaatcagatttattattagtagtaaaatatttttcaaattcaacatctttgatattaaaaagtaatccatcatcaactactctaactgccatttcgtaattatctgttttattgctattcattgaaacacagaaacatgtatcaaaaccttctgtgcattcaatacatacaaattttactctgcttcttactttcttataaaaatcatcctgaaaatttccattatgaagataaatcttatcttgtctttcttgtgcattaatatcacatggccttccaaaaatcagaatctttcttttatctccataactactctcctttatctcatcctcagtaaaataatacaaagtctgggaaataggtgttataacttcttttgccggatatgttgatttttcattaaatacgatttcgtctactttagttacttctgaatattttataatatccgtattagaatatctcccttgtttttcaaatctttttggcgcaaaaattctatattcttctattagtttgttaaataattcacttacttcattaaaagttaatttgtaacccattttgaatcctccctatttattacttttctataccactataatacgcttatttatcttataacaaaaataccttatttaatatataattaataagtaaatacttatataaaatatctattatcatatctaaattactatatatccttattaaaattttaattttgatatataaaataaggggctgtatcaaattgaaattttttaaattcaatttgatacagcctattcttataaacgtaaattttattcatgtatatatttccaaatattttattttgaaataacacaaataaaggataaacattattatccatattttaactatatatttaaaattacgaagcttgctgcttatgaagcagctcaccgttacgattttgaatggttttatggtacaatttattaacattataaccaaacgccattaacaaaaattcagtacgaactttaatatttccacgcataaaaaatcttctaaaaccataatcttgtttaataactccaaatgctccttcgacttgaattgatctgttcattcttaaaagtattcctttaggtgtagtgatgtttttaagtgaatttgttcttagacgcataaaatttttagccacatgtatttgttcattaccttttgctttcgtacatttactcttatattcacagccatcacagtcttcacattcatagatgctaacagtagtttcatatccagattttgtttttttcttttttgttccttttagaagcatttttttaccagatgcacaaatgtagtaatcttcatctgtgttatagtacatattttctttcttactaatatcactcttgaatttctttgtctttgacttttcataatttgcaggtttaataaaagcttcttgtttcttagattcaagatatgcataattttcttcactttcgtatcctgcgtcagcagttacggattcatatttttgatttaaattcttttctaatctatctaaaaatggtataaaagtaagctggtcagatctttcacttgaaatgtctactcctacaatatattcaccttctacccctatttggatattatatgctggttttaattgaccgtttttcatatgatcttctttcatatgcatgaaagttgcgtcatgatctgtttttgaaaaactgtttcgtccattaaaaatgctattgtattcattatatttattttgcttttcaataaattcattaagttgttcagtatatctttggaatttactttttcttttaccttttccataaacaaattcaatattattggcttcaatcataattctgatactatctaaaatataattagcatcttgaactgatattttagcattagtaataataagacataaattcaaatcatgattcatttttattaagctttcttttattttcttttgtagtctatcttcaaatttatcaatagattttttccaaacaaaagtatatcgatttgcagatgcttcgattttagttccatcaataaaaatatttttaaattgaatttcattaagttctctaagttttttcacaagttgattaaataaattttctatacaaccagctaatcgttcacgtctaaatctatctatagaattgtgtcctggtggtagttgaccttgtaaaagccatttgaaatttatatctcttttgcatgccttttcaagagcacgacttgaatatattccttccatatatccataaactataattgcaaacatagttttaggtaaaagtgctggatttctaccaatagtagagtaagttctatttaattctgaataatctaatccctccataacatcataaagcactcttactgaatcactatcagatataatattttctatatttattgggaaacctatttgatgcataggtataatattattagtgttcatattaatattatgcgcaaaaaagagaattcaaatttatgaattctctttttttatcggctagtatcaaaattgttttgatacagccccttattctgcttagcaatacaccgactatatgatttttatcttagttaatagaatctaaagaagcttatcaagttctttaagtatactgttaactataaattttttctgctcatgtcttgtatctatcggaacatttatcttcttacttactataggtttttcatcatattttatggaaaaatatacttctccctgaacactatctttattatttatatcaacattactaagggtccctgtcactccaattcctatattactgcccatttttattttgcacacttctgccatttttacagctgtttctgaagaatacactccatatgtttttattgtctcttctgaaactcccatggctattttctgcttattagagtatgttacaaaacctccatccgttatattagatgctccttcaacatctgttataacacttattaaaaatcctccagtacagctttccattgttgttattctaattttcttatcaatcaatttttttactatatctacattaatcatattatattcttcctcctataattactataacctaaatcatctctactttttacttttataaattcattatattacaaatgataccataacttcatatattaaaattttatttttctaaggtttttgaatacacccaattatgattttctatatcccttccctttaaagtaacttcattaccatttacctctatataaattccattatcacaatcattatctcttcttcttccattttcctcctttgaatcgttaactagtgtataccctactgctcctgtataagccatagtaaatggcatgttttccttaatagaatcttctccaaactctttatgggtatgtgatgaaaaaatgataacttctggataactacttaatatgtcattaagttcatcagcttgccttacaccaatccaagtccttccaaaaaaatctacagttacaggttgatgaagaaatacaaatattggttttccagtttgataatcttcatttaatttttcttttagccatgatagttgctcttccgaaagagatgcctgtgtagtgtttaaatcttctgaattaatgttatcacttcctagtgaaataaagtgatatcctttgatccaattatcatgatatactttttctgtttctgaaaattcaagatacttcttagtaaaactatcaatatcttccttagagttagtatccatatcataattataaaattcatgatttcctatattttttattatagtttctggtaattttttagatttctttataattgaattttttaaagaagtatattgtttatctactccctgatctacattatctccatttaatatcaatgcatcaatattagaatttatactataaaaatcatctatagctttttcaaaattctctgtattatcatgaatatctccaagaaccacaaatgataaatcagcattatttgtagagtctttattaattgacacttcctcatttaattttgcattttcaacagtattattctgtacactacatccaataaaaactatagatattattaaaataagtaaacttattttctcaattctttttatattcatttcattctccttttacaaaaatctgctattgccatttttcttacaatattaatagtaacacttggagttaacttcaatgcaaatgttttttacaaaattataatttgaaacagactttaatcctataaccctaatacacaatttatatttttaaatgaacctaatcatctcataaattcttattttaaataaaataaaattcactagtatccctataaattttattgggatttccaatgaattttattttaggttctaaaaacctatcttaactctaaaaaacaaatattaatttgtacacctatttactttttaatgaccatatattaatatcaacttctgtatttccatccgcaaaaaaacttatcccattgcttttttcatcagtaaatattcttgatgtaaatacttcttcaccatcattaataaatatttccacagatgatgtatctacaaacatttggagccttaaagtattgcctttatagtcacactttctttcttgtccatagactactgcaaaatcttttcctgatttacttctatctagcacaagtttcttattttctatatcataataaaatagtgtttcttcactatctccttttctaaatttaatccctacacttctacctttaatatttttaaactcacattctagctcatatgttctttcataaaatttttctatattaatatcttcattattaagtatgtatgatttacttactttataagatcttaattgtttaagttctcttattggcttttgaattaatttatcattatttaaaattaactctcttggtatcgtaagacagtgtgcccatccattttcatcacttggatactctatttcaggcaatcccatccatccaattaaaattttccttccatcattgctttctgtagtttgaggagcatagaaatcaaatcccctatccaattcaaaaaattcaccatgtgaaaactcacaattatcaaagtcaattttatttcctattaagtatccagattgaaatatatttttatacttatccccttctggttgtaatccctgcggtgaaaatacaagaacccccttattgtcatattttaaataatccggacactcccacataaatccattacctataaaatcgctctttatttcatccttataattccaattaaataaatcatctgattcataaaccgctattgttcctaaattatcatattttctttcagcacctattaaacaatagtactttccgttctctttaaataccttaggatctctaaaattatcagtatataattttggtacatcgtcaataataagttgtttattttgtatattattctctacatccataattgccatacactgatatggattccttatccatttttcatttcttgtatttcctgtataaaataaatataatttctcattttcaactattccagttccagaaaatacaccatgactttcaaaatgttctgttggaattattccaacaccacaatctttccaattaataagatcttttgatgaaacatgataccaatgctttattccatgaacaggtcctaatggaaaccattgataaaataagtgatattctccgttataatatgtaaatccatttggatcatttaataatcctgttttaggttgaatatgaaacttctgtctatatggacatctgttaactttatcttttaattcattcatttcttcatcacttgcctctaatattgttctatatctttcttctcttgtccattctttcatttttccttctccttatattgcaaatagaaggcattagaatagatctaaacctcctatttatttaaatttatgcctttttcttgttcataaaattggctaatatgattgtagaaactactgctacactcatagatattgccattcctataatatagttaaccattgaatcaggtcttatggatatgatacctggaagccctgcagctcctggtgctaatgctaaaacctttgtaaacattatgtatgctgctgcaactcctgaacctatcattgcaccgaagaatgggtaacgtaatttcaaattcacaccaaatattgcaggttcagttattcctaataacgccgatatccctgatgctgaagcaattcccttcatcttatcatcgtttttaagtatgattattacagctaaagctgccgctccctgagcaacatttgacattgccgcaattggaaaaataaatgatcctcctgttgttgctatatctgcaagtaactgagtttcaactgctgtaaaactatgatgcattccagttataactatcggtgcatagaagaatccaaatatagctccacctattggtcctaatacattaattaatcctactaaacctgatgttattgtattaccagctattctcataaccggtcctatagctacaaatgttaacaatcctgttataaacacagtaaataatggtgttaatagattatcaagtactgaaggtataaatttatgcaatgttttttctgtttttgctaatacatatgaagatgctaaaacaggcagtacagtgccttgatatcctactttaagaatagataaaccaagtatattccaagatggtacagttccttcaataatagccgcaggataactgtatccatttaataaatcaccatgaatcataagtgcacctatacatgctcccaaatatggattaccgccaaaagtttttgtagctgaaaatcctaaaaagattggtaaaaatgcaaatccagtattcgcaaatgtattaatcatttcagctaaatctttaaattgtggatatgcttcaattaatgactttccttctataaataacccttgagaagttaatatattatttaatcccatcaataatccagctgcaacaagtattggaagtaccggaacaaatacatctgctaaagatttaattaacctttgaaatggatttaatttcttatcagcttctgcttttagttcatccttacttccttcactaatatctgcaatttttataaattccttatacacttcatttacagttccagatcctaaaattatctggaattgtcctgcattattaaaatttccttttacaactggcatttcttcaattgccttaatatctatctctttatcatctttaacaactagtctcagccttgtagcacaatgagctgcacttattaaattttcttttcctccaatatattctaagatttctttacttatttctttataatttctactcatatctaactctcccgttatatgaaaaataaattttgtatgtatttcttcgccagtgtgaaacgtttcatttttactgtaattaaatattattacgttttcataatatagtcaagaaatttttttaacaaaaatgaaaaagatttcaccacaagttttaatagtgaaatctttttaatatttaaattctatttagttgtatagccttttataaaacttattggcaaaattattttcttttccacgctatttttttcgattatttttattaaagcagatactgattcttcagctatactttcaataggttggcgtattgtagaaattgtaaatctatcttttgctgatgatcttattccatcaaatccaataatctgaacctcatctggaatctttataccaaatacttcgagcttatcaataaaatctaatgcatatctgtcagttatagcaaatactccatcaatatttatattatttttaaaatttttctcaacaaattggtctaataacacctcaaattcctcatctgatccatataattcacaaacattataattaatattattttcattgcaataacttataaatccttcttttcgttttctagtatcattatcaattttagatcctcgccctatataagccaagtttttgcatccagattcaactaatttttgagctgccagtttacccccttgaaaattatcactagagacgtatgtaatattttttgaaaagtatctatctatactgacaaatggaatattatctgaaacatattcatctatattactatatgttattgcaatgataccatccatcttattttgttttgccatagatatatactctatttcactttctttattttcttctgaattacatataatcattttcattcctgcttttcttaaacatttttctatgttataagcaagttcactaaaaaatggattccatattgtcggtaaaataactgcaactgtatttgttttattaattttaaaacatcttgcatatatattaggttcatattttagcttttttatagcattttctactaaaattttagtttcaggcttaacagatatattgttaataaccttagacacagttcctactgaaactccagcttctattgcaacatctttaatagtcgccatctcgttacctcctgaatatttttctataattttaacatatagttatacttaattaaaggaatatagaaattttgcataaaaataaccactcatttaatcaatgagtggtcactttgcatccctattctggatatataagtctttcatcagaaatattatctaaaacctcacgtacaaatttaccagcaacataacgtgccattggtaaattcatatcaagataatttccacaatcttttgctgctgcccctggaacttctccttcaaatccagcaacaaatttatacatttcatttattaatgaaactatatcttttgatttataatcacctgccaataataagtagaaaccggttctgcatcccataggtccaaaatataccactttttctttatattcttcattgtttcttaaaaaagttgcacctaaatgctcaattgtatggatctctgctgtattcattactggttcgcgatttggagctgtcatacgaatatcaaatgtcgttataacttgtccattgatattatcctttcttgagacatatattcctggtaataatttaatatgatcaattgtaaaactagctattttctgcaatttttagtacctctctttcatttttatcaactttctttaaaactctattactatattttaactttggccatcctaaaagtataaatataataccaaatataagcattaatatggaataccaattatataccattatattcgttggtgtaactccagtcaatcctgctgcaactaataattgaccagcatatggaagtaatccattaaatgctgatgaaaatatatctaaaatgctagctacacgtctcctatctataccatactcatctgcgatatctcttgctataggacctgctgcaattatagatacagtattatttgtagttgcaatatccagaagactcactaatgctgcaatacttagctcacctccttttacactcttcgtattcttagttagtttttcaagaaggaaatcaattcccctaagtgttccatcagtgcaaccattccaccaacaaagattgtaatgatagccatatcttccattccaatcattccatcatgaattacagttaatgactgaagaagcgagaaatctccatgtatcactccaattattattccagaaataactccaaaagacataacttttacaacatttaatcccaaaattgataacacaattatcaaaatgtatggaattatatttactatattaaatgtataagatgtatcctctataactgttgcaggcgaatttaaatatagaaatacaatatttaaaataacagctggaataaccataagaatattaattttgaacttatctttcatttccacttcctgtgttcgtgttgcagcaattgtagtatcagaaataaacgaaaggttatctccaaacattgctcctccaaccacaacaccactaacaagtgcaacatttattcctgtctttgaagatatatcaattgctattggtattaatgcagcaactgtccccattgacgttcccattgaaaaacttaaaagacatccaattaaaaataatccaggtaatatcatgttggatggaagtattgccaatccaatatttacaaccgaatctactgcatgcattccacttgctgtcccataaaatgcgcctgctaatatatatattaatattatctgtaccaatgtgtgctctcctccacctttacagaatatatctactttctcttcaaatgttgttttaccattttcttttctgttcaataacagaccaatgcctacagcaattaaaactccaaccattaatggcatattatcaaaacttcctgtaaaaattccaatccccatgtaaagtgccaaaaatactattaatggaattaatcctactatactcccctttttaatcattttataaatcccccttttttattactataattcaaatcggattactatgattttattgtaaaactataaaacttataagtattcctaatatgttagccataatgtatattatctgataattctttatataaaaacaaacgccagagaataaactctggcgtaaacatgcacaattaatctattctctcatctttcagttaaatataataactgcaggaattagcaccgtatatataataaatgacattacatattggttgctgggtttcatcgggccggtccctccaccactcttgataagtttctataggattgtcttacttttaaattattatatagttgtttatattaaaagtcaacactatattaccatatttttctcttgaaattatagtaatataaattttctttttatgattgaaaaattaccccaacaggaatataatggtatatgcaaatcattcgcaacaaggaggggctatgaaaataaaaattgaacttattttaggtttattagaatcaggaaaaacaaactttataaattctatgctagaaagtgatgaattttacaatgaaactatcgttgtgattcaagatgaatttggacaaactaatatcaactatcctaatgataaaattagcaaaaaaaatataaacttaataacaatagaacataatacagatgatgatattaatgaaaattacataaaagatattatcattaaatattgcccagaaagaatatttatagaaacaaatggtatgaaaaattcttcctatattttaaaagtattcaataataatgtactaaaaaaactgtgtattattgatgatattgtttcaataatagatgctgaaacctttaatctatattatagaaatatgcaagatttacttgtttcacagatatttaacagcgaaaaaataatcttaaacaacttgaataaatttaataaaaacgaaattactaatattatttctcaaataaaaaatataaatgaaacagcatctattatggaatattcagaatttgaagattctcctgattactcttacttagaactttatgataataataaaaatatctttacttttaaaacttatatttttatatttttaattatatttttctttacagctttaagtgctttttcattgttagatttttcaatatcatctcaatatatgactacacttaataagttctatactgtttttataagtattttaattgaaggaatcccttttattcttcttggaagctttgtatctgccttaattcaaatttatgtatcaaaagaatttattataaaggtatttccacataatatttttttatcgtgtataattgctgcttttgctggtatagtatttccaatctgtgattgtggaacaattccagtagtaaagggctttataagaaaaaaagttcctacagctgcatgtataacttttttgctctcagccccaatagtaaatccaattgctattatttcaactatgtatgctttccaggatatgaaatccgtagttatttatagaatactttctggaattattattgctattttaattggtcttataatgcatttttttacaagagataatcctaatattctaaaaaccaatactgatcctctaagctgtgaatgttctatatgtagtgattcgtatgaatatagtaaagcatcaattgatacactaagaaatatattttttcatactagtgatgagttttttaatattggaaagttcatgattatgggtgcatttatttctagtatttttcaaacaattgtatcttttgatagaaatctatattttccaaatgataatagaacttctcttttaataatgatattattagcattcttactttcagtatgttctacttctgatgcgtttatagccaaaggatttctaaaattattttccttaaattctgtaatgggatttttagttgtaggacctatgcttgatataaaaaatactttcatgctttttggaaattttaaaaagacctttgttttaaaactcatattttgtatcgttattatatcttttactgttcttattaattttaatttttcataattaagtataattataaaaattatactcatatttcatatatgaaataatcttcataggaggtgaaaaatgaaaaaatttaattttgatatattcgcaaaaataataatacttataagtttttctcttttctatcttaaaattcttataagtaaagaaattttattatacgttcatccacgtattataccttttacaatattaggaatctgctcaatgataataatggctatatttttaatatcatcactatataaatcatataaacgtacatttaaaattgaaaaatatattgcatttattattccattaataattatacttatttttcaaatttctactttaaaatctaatgctaaaacattagattttaattcagataataaatcaaattcagtatcatcatctaataatgctgaatatacacctgatttatatggtggaaaaacagaaagctatggtgatggaacaagctctcataataaattggatatatgcgataacataataaatgtaaattccaaaaattttgtatcatctcttgatgagattattagcaattgcaatgaatatgaaggtaaaactatagaaatttctggctttatatataatgataagaaccttaaactaaatgaaaatcaatttataatagcacgatatatgatggtgtgttgtgccgctgacatgcagattgcaggacttcggtgccagtacagtactaatcaaaattcttttgatcttaatacatgggtaaaaatcagtggtaaggttaaaattgatacttatgaaggttcttatgatcccttaatactaattgataaaattgaaatagatcctaatccagatacttcctatgtatatccttattgacaaaacttttattaaaatttcttttgaataaaaaattatcgctgataaaatcaattatcagcgataaaataaaacatactatatttttttatacattataaatttgctgtccatagtccatgtaagttacaatatgcttttgcactaataacttcttcagcaattttaaatacagcttctggtttatcttctggagttaaaaattttctatatactttattttctgtatttacttcaatccattcaatataatgttgttctgtcattggatgttcaacgcttcctacctttacaataatttcatcaccatttttttcaactgctggaatatgtttttcaactgctgcatctactgtattttccactattaatctcataggctttccgcaacaagaaagagttccgcctcctccatgagtaacctctactataattccacatacatcacatttataaacatctttaatcttagccataaaagactcctccttcataatacacacttttctattttattatatataaatttttttattaataattttctataaaaacttcaaaatatccttgtggatgctgacatgctggacataaactaggagcttcttccccttcatagatatatccacagttgttacatttccacaatactgattctgattttttaaatactgtattgttttctatgttttctaataattttttatatcttcgttcatgtctagattccacttctgaaattcgattatatatttctgctatttcttcaaatccctcttcttttgctatttttgcaaaggctggatataattctgtccattcttcattttcaccttctgcagctgcttttaaatttttagctgtttcttgatgaaatgaaactggataagatgattgtatttcaatagattcatctgaaaaatcttcttttaataatttataaaatctctttgcatgttctttttcctgttcagctgtttccataaaaatatttgatatctgaacatagccttgtttcttagcaatacttgcataataagtatatctagttctagcctgacattcacctgcaaatgatttcattaaattttcagcagtttttgtaccctttaaactcttcataacaatcctcctacatagtgtttatttatataatatataagctttattccatataaataactcacatagaataaagcctaatatatcttcttttactatatattaacacataattctatttttttctatataaatctcactatttttattaataaacatatataatttaatcaatattttttaacattttataaacataaactaataaaataattttaatttttagaaataatctttaatcctaatattccaattattataagtattatgcatactattcttattatatctaagggttctttaaataatattattcctagtattacagtaccaactgtaccaataccagtccatattgcatatgcagttcctaacggaagtgtctttaacgctactgataaaaaataaaaacttccaatcatacctaatatagtgataatactgggtacaaattttgtgaatccctgtgaatattttaatcctactgcccagcaaacctccaataatcctgcaataaataacataatccatttcatatattttacacacctctcatataaaaataaaaaaagcctaggaaatatttttacatatctcccaggcttttatccttccgtgaacacattttactgtgcgttttctcttggacctgaccagctataaactgcggaaccctagaaaacttatctttataattaaattatattttaatcgattaaaattacgaatttatactatcatattaattaatttaaatcaactatttttatttaatcatattatataacttcaacacaattattgatattagaaattctacttattttataaaaattaaagaagatgtctaaattaatagacatcttctttaatctttacttatgctgtcatgagaacagatttaagaatgttagttttaaagtcctttttcgtagctttctaccattctcttaaccatttctccaccaacgctaccgttttgttttgaagaaaggtctcccttatatccttcagcatagttttgtagtcctaattctgaagctacttctgttttaaatttgtttaaacctgcctttgcttctggtactaaagttttattactattataagatgacataatagttacctccttaatatttgaattattttctacactaatatattatccaaactaaaacttaatactctataaaaatattggcatttataacatatatatattctattagatttttattgtctattataaattttttacaaacaaataataacactactatttaatccaagtagttcctaactatattcgtggcttgtaccatatttttaagacttgctttataacctgttttgcatatcccaaaaactccctaccttctgatgatattctaattcccttatttgatcttataaatatatttatttttatttccttttctaactcttttattgcatttgataagcttggttgcgctataaacaatgcttttgctgctacactcatagaccccctttcagctacttcaattacatatttcaattgttgtaacgtcatattattaacctctattcttctaaagtattaaaaaatatattctaaataaaatataaatttaatatgataactaataataaataaagtaaaatataaaaaaagcttaagatatatccctcaattaaaggcactatcctaaactcgctttttatcattagatttatttttaatatataaactaaaaaattgctcaacaaatagtctgtgtattagttaacgaaattacaatagtaatacacagtcttcaatttatctccctatctctcgtaggtcatcaataaatctaactctaagcaggttttctgactcacgtatcacagctctaattttccttcccaaaatttctttcagtggatctaataaatgagaactcctcgcatacagttgcgggacagtacaggattttcacctgttttcctcttacgcatgaacaatatataaattatcatccaacacttacagtattatattaaatttgtttaattttagcagttaactttatttatgtcaaatatatttcttaaattgtctaataatataaaacttatatcttaaaacttaaattattaaaataattaataattatcgtgctatgagcaataatattatatacatacagttattttttgtactataataaaaagaaaataatgaaaactatgtattaatatatatttaatacaaatcgtaatagtttatggagaaaatatgtttaaatttattgaaaagtatgatataaaagcagcaaaatatataaattcactttatcacagcaaaactctagataatttcatgaaatttttcacttatcttggtaatctgggcttactatggataggaatatctattgtgttcatgttaagtcatcaatcaagaaaaagggagtagttcttatttctgcacttctccttaccacaatattaggtgaaggtattataaaacatatagtaaaaagaaaaagaccttttataaaaatgaatttgtgtgatcaattaataataggtacacctagcacttattcatttccttccgggcatactgcatcatcatttgcagcctctgcagtttttcttgcaattaatagtagaataagcattctaattttgttaatttctacttgcataggattatctagaatatacttaaaagttcattatctatctgatgtgattggtggcgcaattcttgggttattatgtggcagcatcacagtatctttatttaatatagtatagatataaatttaaaatcacctaaaaaagccgtacttatttataagtacggcttcaagttatctatgcagcgttatttactgttttttcttctgatgtttttaagtaaattttttcatatattttatcatatacaaagcaaaatattgctccgaatacattacatgcaatacgccaaaatactgctccgaatatacctagaactggtactgctgataaaagtgcaccaaaacaatttatcattatttgatattgatatgttgctgcaaacccaatagcaattcctccaaataaagataaaaacattctatattcttcaggtattaataaaaatgtaatacaaaatgtaactgatccaaataaaatatataaaggtctatttttcaaacggaattgaagtgtttcttgtttctgctgtatatatgataaacatgcaaatccaatccaaataactcttggaatatttagaagtgttcctaaaaacattcccccacttatacctagagctaatttaatctgccatctagtacgttcatcagcaaagctcacttcttttaatacatctataaatgttttttcatacttgttttttctctgcttataatagaaaattccacttactaaaaccccaccacaaattagagcataaattctacgtataaatgactcagtagtagttgctgatgttcctaatatgagtatataacataaaactatagttgaatgatttgaaaattttgtatcattacatgttgagactactaatgtaattatgcatataaaattaactataaaacctataaaaggattagtcattaatactactaaaggtcccataagatatattaaaaatacaccaaataaagttaatgttgactgttttacattaaaatttaaatttgaaaacctaaatgttaaaattagaattactgtagacactccaattacactattttcttctccaaatatttttgtataagtactaacaaaaactatacaaaataacatacataatatattttttagtataaacgcccatatatacttgtttttttcttttttgttttcagcattttttatcatcggcttcataacattagctgataactgcattgcttgataaaatgtcatactattcctccaatcattatttatttttctggttaagttattctataaacttaatattttattttaattcttcaaattgaaattaatttttgtacttaaatatagtttactttgtaaactaattttaatatagtattattcttctgtcaatttaatattacttaattttttataaaacttctttgaaatataaaatataatcaactctgtacaaattaatttgtcaaagttaagcgattatttgtttatactttataacaaataaaaaaagccttaggtaatttaattttatacctaagaccttatatctacatatgaactttaatctagattttaattatcccactaacttccatgaatcatcagttcctggaatagattgtgtccaccattttgcctcataaagttttcctttatatactacaatatctccgcctacacaagttattccttcgtaccaatttacagatccatcttcatttggaattatttctttttcccacacatctgacttacctggagtatctccttgagtccaccactttgctgtatatttttcaccattataaattactgtttctcctcctaaatataccttagttgaatcatacgtattttcttcatctggctctaatatatcttcttcctcaactgttatagttctctttgctgttgcttttaatccttcactatccgatacggtataaattaattcatattttccagcagtatttgtatcaacagttcctgatacttcaattttatcagttaagtctccatcttctttatcacttgcgcttataccttctaatgcatcaaatgcctctgaaagttttatactcttatttaacactccataaagtactggtgcagaattttcttctggctctaccacttcatcagctttaactgttatagttctctttgctgttgcttttaatccttcactatctgatactgtataaattaattcatattttccagcagtatttatatcaacagttcctgatacttcgattttatcagttaaatctccatcttctttatcacttgcacttacaccttctaatacatcaaattcttctgatacttttatagtcttatctgatatacctctgattactggtgcagaattttcttctggaatttcttcatcattagctccaaacttcttaaataaactagtatgttcatatggacttactattcccttatttgactgagccatagaatctctatttatgcaccacatagatgtcattcctatttttctatctattgcatgatttacaactaattcagtccattcagctgtaaatataggatgtgcttctccctcaaatcctactgatggtgttgtaccaatttttctataagcctgtgcatcacttaaattaatatctgcatacttcttaaaatattcttttaactgatcctttgtactatctactgctcttaatgatgctgtgccataattttcacctggtaataatgtagacggcccataacacatagtcataatatttactaattcaacatcaacaccttgtgataaatatgcttcaaggacatcaagctgaacttgagttaatccacttggtaatactgctaacgttaatactacatcaacccctgtttcatcttgaactttctttattgctttggcattctctatattgtgagccttattagttgcacttccaccttctatatctaaatcaagtcttgttaatctataaccctctatgatttctttgtacgtattgtataaaatatctacatcttgagttgcttcccaaattgcaacaccatttagtccacctaaagatattgttacatctccaccaatatcccttatatctcttatggactttttaatcccttgatattgagagttgtctgcatatctttcacttaatacatcgaatcctccccatccccagttaactttgccatttgatattccacctgttgattgaataaatcctaagttaaagaatttcacacctgtatcatcatatattttctttaaatttaatgctccattgtttgaaaattctccattattccaggctgtcatatctgcatacggtgtattaacctgtgatggccattctataccttgtccaactccaaagtctgagttatcttcttctggtggagttacaatgttttcttgtactgttatttttctaatctttgtggtatttaatccttcactatctgatacactgtaagttaagctataaattcctgcttcctctgtatttacgcttcctaatacttcaatttcatcagttaaatctccatcttctttatcacttgcacttacaccttctaatgcatcaaattcttctgaaacatttattgttttatctgatactccattaattactggtgcagaattaactcctggaacttcatttccatctgtttctccataaatagtttgtctatacatctctggactatcatcagacatacgctgaactatttcaatactttctattttagcatctccagataatttaaaagtatatgactgtccctgttctatatttttaccttcccatactgattttaaatcaactactgtatatccattttcatatgtaacagttccagatgtataatctcctctgtttaatgctttatctgtctttatatacagtttaggagcttttatagtttctgcacttctttcaactgcttttaatacactattattttcttctgacttttcattattttttattgttatttcgtatcctgttctgtcagctccccattgctgctcatatgtagtaactacagcttctacatccaattctgaagaaactatttcatttgctggtaacttttcatttccaaaaagagcctttttagttgcatttgttaattcgtctcttttacttccactagttggtgcatcttgtgatgccatccatccaatcataccacctaaattattttcttttacatatttagctttttcttcaattgatttaacattatcatatgtgaaaaactttcctgttgtttcatcataaagataaggtgctttagcttcatcatcccaatattcctttaatcctggatattgctgctttaatttatttatacttctataagaccagcatccagatgcccttccactatcaccatttgttaaaggagcttcatttatagctccatatgatggtgtctgatcagcatcttttcctgtcatcttagcttgtccaaacaatcctggaagatctttattctctcccttatctacattatcccatcctctagtataataagctgcacctattacaattttctctggttctgcaccctgtgctattagataattaactgattcatcaattgataaattatttcctgttagaggttcatttgaatttgcatataatccagtttgatgtccacttacatcatcccaagctcctcttaagtcatatgtcattatattagcaaaatcaactacattaaataatctttccacatctattccattatcaactttagcctttggtgctggaagtgctactgtaagttcataatacttatcaacttccattccttttttatttaaagcttctcttaattcttccaataatgtaatataattttgtttgtcctctggtcttgctttagttgttccttcatcattcttattgtcaaccaaatcagcttgtcttacttctcctggaaactcccaatctaaatcaacaaaatccatatttgtatattcaacaaattttactatattgtttataaaatttgttctagctgttttactagctgcaacgtctgaaaaatctcctgacttagaccatccacctactgatatacctaactttagattagggttttctgctcttaattcctgtaatgcaattaatattccagcatttggggcatcccattgtactccagtttgtcctactggtgctcctactgctgcatctttatctgtaaaaattaaatctccatttgcatcaaaatccataaatgcaaagtttaagtgagtcaactgatctgctggaatatctttaggataaaaatttccttgccctccccatattgaccagtctccataatacattacattacgttttccatcagtattatttatatttctttcaattgtacttcctttttcaactgctatagcctgtaatgttgtcgcacctgttgatgccatcattgttaccattagtgatagcgccattatttttttacttttcatattcaatctctcctataaaaattaatctttgtgaaaattaacccttaagtattgaacatactttaggcaactggctggcatagtttaaaactttagcccctctagctttgcgtccttaaatttctttaagtttgcctttttctcttttatctatctactttacaaatatgagtatatattgtgaaatatttaatgtatataccttggtaagttttgatatattttttgtaagttttaattaaatttataattagttgtatttttataaaatcctaatgtataataagtaaaaaataggtcaaaaaaggaggattgcaatggtaaagataggattatgtgacgataatgctgtttatattgaacaactatctacaattttaaaaagtatatcatattctagaaatatggatatagaaataacctcattcaaatctggagaagatttagttaatttttgttcatctcattccaactatttcgatatattatttttagatatcttaatggatggaatcaatggtattaatgcagctcaaaccattcgaaagatatgttctgatatttatattatatttgtaacaacaagtaaggaatatgctctagacagctatagtgttaatgcttatggatatatactaaaaccattctctgaagattttatctcagaaaaatttttagaattatacaacaaaataaatttggatagaaaaaatgtaatatatgttaaatccaatcaagatatatatactcttcaattgaataacattatatattttgaatcaaatttaagaaaaattactgcatatacaaataatggggaaactattaccttttataataaaatgtcaaatttagaaactgaaataaaaactagtgtttttgtaaggtgccatagaagttttttagtaaacttaatttatataaagaatattgttggacttgatgttataaccattgacaataaatatattcctattagcaaaaagtatttgaataatattagacatgcttttacatcttatataaaaagtaaactttaaattgtaaattagaggtgatagaaatcaacttatcttatttttttattatgttactgattgttcaatctttattatgttatacatgtacagctatattgaaaactaatttcaagaaaattgtactacatgttatttgttacagtacattaatttctatattatttttaagtgtattttctaataaattagatttattaaaattttctttatatattacggttacttgtatattgttttatttattctcaagcaaaaaaaactttaaattgtttctattaattttaaagtcatattatattttttattgtcatttattcttatattcagcttatatgaaattatttcacataataatatatatatcttaatgaatttgaaatatggattttttattatattaataatatcactacttttatatacttcatgcgaaatattatctattaaatttattacacttgaaaaacttgattatattttatcttctataaatataataattccaatatctatatttgtacttctaataagtaaaaattatagtttattttacataataaatttctcaagacactcatatttagttagtgcagtttttttaggtgctacattattagaattttattttgctatttttgcaataattttaatatcaaaagcatatgatgcctctttatataaatataaaaataaaattcttaaaatgcaatatgatttgcaagtaaacagttttcgtcaattagaagaatatcaaactgatataagaagaatttctcatgatattaataaccatcagacaattctatataatttaataaagaatgaaagttatgaggatgctttaatttatctagaaaagtttggctcaggatttagtaatgtaaagtatgaaatactaactaacaacaaaattctaaatactctatttttaaataagaaagatatgtgtaaagctaataatatctctttagaattacatataaatattcccaaaactctatctatttcagattttgatctttgtataatagttggaaacttatttgataatgctatcgaagcttgtaaaaatatagaatcttcaactaataaatacataactataaaatcaaaaatcataaataacaattttgtttttgaaataaaaaataacttcaatggggttcttaatgctactaataataaatttttaacctcaaaaagagatccattaaaccatggtttaggaatatataatgttcaatctactatagataaatacaagggaatttatgattttcaagttgaaaatcatgaattttcagcctttattagaattccaatcacttaaaaatccaccactttaaaactttttaaagtggtggattaatttttattttttctttttaagtactattgttactaatgcaatacctgtcaatggtagtgctaccgacattgtcattaaattcatatttatatctgcataattattataactatcttcacttttaatattatctttttctaattcaagataatcctcatcttcctcttttgattctatctccattttactacattctacctctgatttttcttcatcaagaaaaattttatctggatttatcttagtaataagaagtctttcctcaacctttataggttcttgttttattttatcaatatcttcttgacctaaatcatcaattttcttatcctctgattccatattcgttccaaatatattattaattatttgtttaccaaaatcaaaaatattattttctgtatcatttaaatgagtgtctaaattattctcttctataatactctccttattatagtcttcatctgcctttgtaatatcttctttgttcttatcatatttatccttatcttttttattactttccactgtttgattgttattgttatctatcttatcaagcatagatataatagattcataagattccttatcattcttattaactcttatttctataaaaaagtcatttattaattcttctgtttttcttaagaattctattttttctgtaacttttaatatatacgctgtataatcttttgaatcttctcttcttattaattttaacctcttattctttttaagaacctttaaatatttatccattacctgtatcttttctttagaagtaagttcttcttttatacctacaataacaggttcttcttcttttattccttctccgcctaaaataataattccatccacaccttgtgtaatctctatttctggtatttttgaatctgtattttcttcaagattatcttcctcgaattcattttctgtttcttcttctttagatgtatctatatcctcatttccttctccatttggattttctgattgtgaattctcttcattatctaaattatcattgtatctgcttgcatttattatcatatctttaatttttatatatgaagtatcattcttctcaactctaatctctatttcactactatttaaatcgtttatattaataatatagtattcataattatcactttccgctttcttgtagccatcatttaaattccctagttcagataatttttttaagtaaccgcccattgcacttactttatcatctttactaatagatttatttacttcaacttgtaacaaatcatttattccatttacaaatgttctttgaataggtgttatattagttcctattaataattgacttatttcatcacttggataatcatcaatactgagcattatttctctacttgcaaaacttccatcaatagcatatgccattacctctatatttcccttatttatagctgttaatgttactttatttccttgtatagctgaatttattatattttcatcgccagtaaatttccattctatatcctttaccgtagcttcttcatttacatttgcttctacctcaatatctgcaccaacataaattattgaattatcatagatccattctataaaaacttcttcagccaaggccctgttatcctcagtattattatttaatatatatttttcctcatctttcacattagtttctgcatatgctactacatttaaatttacaacactgcttatgataagcaaatgtgtaagtactttttttaaattcatagatacccccatctttagttttatataacataaaatattgattttcaacacaaatatataccgctttaatacatatatcgtatactttcagaataattttattatataattaaatttttttatttttactcataaaactaatgtgttaaagatatgtacttcatcataataaaataaatattcaattgcaaaatacttttattacttattatccttaataattaataaaaacaaaacataagtaactctataatatcagtgttcttacgtcttgttttttaattttgtttatatacttattttaattagaaagctttttaaaatgcctatagctgcaagctctttgaacagtcataatttcttcttctcctttaaaatgccaaggattagttttagaatcattatatccatctattatatcaactgcatctatataaagttcttttgcattcatctgtccatacattttaggtggcagtacataaataggaatattaagatcataatgctttttcacaaatccatttacttcatatcttgtgtgtggacataccataattacatcatattcatgataaagcttgtttgcattcataaatggactaaaatccacactcatttctttctgaagattattttctattatttcacttttaactttcttaaccatagcactagatgaaaatccacctaaacagcaaatcaatatttttatcatacctataatacctgctttcaaaataattctattataaatattatatatcaggcaagcatccatgtaaacattatcattgtttatcttaatataacttcattataattattcaataatttaaattatttcttatttaaattatctatataagaaactgcagataatgctgctatatttccttctcccgcagcctttatatactgatatggtgcaccaacaatatcacctgctgcaaaacatccttgaagatttgttgtcatttttctgtctactttcacatggttttcatctaattctaatccaggtactaattgactaggagacacactatctcttaaaataaaaatgccatcagtttcaatctcagaatttttaagtattaatttttccactctttcttttccaattatttctactggtatatcattaattatttcaaccttttcatcaacttctaccttttctttatacataggtatataatagacttttgaagcaattgtagatatgaaattaacctcatcctcttcatgtttattatatgctattattgtaacaatcttatctttatatagtggtgcatcacatgttgcacaatatcctacgccttttcctaaaagttcttcttcacctttaaaaggtcttccaaagttgacacctgttgctagtattattgctgatgcttcatacatcttatcattagccattaatgtaaagtaatctcccattgcatatatattattaattttttcctctgttatacttatatccattgattccatatgctttataaactcatctcttatctgtgctccactctttccatagaaacccaagtaattatttatcttttctgcttttgttaacttattgcttaattctttagatccaaatataataaaatttttctttcttattttcgcattaagggctgccgatacccctgctggcccacttcctattatagccaaatcatatctttccatataaaaactccctctacactttaatttaacatattctcatcttgctcaataaaaaataccttataacagttcttctatatcttttatcatatctaaaggttctatatgtgattcgtatcttttaactacattcccatttttatccaccaggaatttagtaaaattccattttatactatctccaacaagatactctggataattttcctctgttattgaatatagcattttttctgtaatattttctttattgaatcccttaaaaggacacttctctgttaaataattaaataatggatgagagtttgagcctcttacatctattttttcagataagttaaatgtaaccccatagtttcttttacaaaaagtatttaaatcactattacttccaggtgattgttcagaaaactgattacatggaaatcctatcatttcaagaccttgctctttatatttttcataaattttctgtaaatcttctaattgaggtgtaaatccacatttgcttgcaatatttacaatgactattgctttatttctatagtcttctaataacacttctttgccacttatttctttatatttataatcgtatatattcatatttttcctccatctattactttttatatattaaactttgcaaaccttatattcttattttataaggttgtatatatctttcttaatacttgaaggttttgttatgggtgagtatctctttataacattaccttctgaatctattagaaattttgtaaaattccatttgatatctcttccaatcaatcctccagcttcgtttttcaagaacttatatataggatgtgtgttttgtccatttacatctattttttcaaacattgtaaagcttactccataatttctaagacaaaattcacctatttctttattacttcccggatcttgttttgcaaattgattacaaggaaatcctaatacctcaaatccattatctttatattcattatataattcttcaagctctgtaaactgtggtgttaacccacattgacttgctgtattcacaacaagaactacctttcctctatattcttccatgcttactttcctgccattcatttttgtcgcgcttaaatcgtaaaattccatattaacttcgtcccttcattttaatttacgataatatgatttgttaaaattaaatttttctcaattaattgatttaaaaaaatatttaagcttaattagacctttaataataatatctaaagtttccttcaattttgtagcttctaattcacccataccagaataacagaatattttttcaggtacttctaagatctcatctttcatatttattcctttttcagttagttctacaataactacccgatcattttcttgtgttctatagttttttatatgattttattgtatttatccatacatttcctttattgatttatctaaatttaattgtgtccaattaatatgtttattataataatgtttttctaatatgtcaatatcttaattttaaatcatatatcttccaatttaataaaaatttcaggtgaaatcttttattaaaaataagaattacagtttctatttattttcataataattttttgtaactttattattgcaccatatataataaataaactctgtagttcctctaataaaaaactacagagtttatttgattattcttttttattttcccacttttttctctctacgaatctccccataaagaaagcgaatataccaactccgatccctgtctgtacacagaataaaaggctttcaacttctcctggaagttctccatctatccatgtttccataacaggtgtaaaccatggttcatatgcttcaccatttatctcctcaaccatgacacttcctgcatcatcagatcctccaaactcagcaccctttaatgcaaaaagaggtattatagcaattgccagtgcaataattagtaatataataactgttttcttgtttttagtcattctacttttcctcctttaagaagccaagtcctgttaattcagattttgcatatgtttcaagtcctattataacaataactgtaagtattccctcgataattgcaagtggaagctgagtaggtgcaaatactcctaagaatttcactgctgatgcaaatactcctccttcaggtgatggataagccattgcaagctggaaacttgttatacaataagtgaatagatcacctagtgctgctgcaataaatacactaacttttctatttatttttaattttacacataatttataaagtccaaatgatagtagtggtcctgcaattgacattgaaaaagtattagcccctagtgttgtaattccaccatgtgcaagtagaattgcttgaaatattaatactattattcctaatacacttactgctaaaggcccaaatagaattgctccaaggcctgtccctgtcatatgagagcagcttcctgtaactgatggtattttaagagatgagattacaaatatgaatgctcctgccattgctaaaatagtaacagattttctatctttatcaagacttttctttattgataaaaatcctccaattaaaaatggaagacagataatcccccaccctatacaatacttagctggaagatatccttccataatgtgcattgcatttgctgccggagttattccaaacataagcacaagcaaaattgcaattttgataattttgttctgatttttcattttccttctcctttcaaaataaaaaagacaccttaacctaatgattcccactcattagaaaagtatcttatataatctctttaaataaataaaaacatgaaaacataattccattttttaagtaaattttataatatctttacacttaaaacatgaaattttatctatacttcattattattcattaaaaagattcatcctgtatatagtcatcgctcgtaactatatacatacgcttataaaaggcaggtattctgacttaggtttcataatcatatcttgtcttcccagaaaatccagtgacatatttttaagatataactcttccaatacagcggcgggaccgtaagggattctcacccttttccctattatcctgcggagaaatcacaggcaccttctataattatatttttgtccacttaatagtattactactataaatctgttatattttatatctaaatcataatatttgtcaatatgtaactttaatatttcaatctttattttttcttaaacatatatatttaattttattttgtagagtttttgtattaaattacacttaatatttattaaatatctttttaaattcatttatatttttaggatataagttatcattagttaatattcttttttcaatcagtgtttcatatacatctaacattatcggtcttttcaaatttgaatttttcaatattttttcatttttaaagatttcaagtggcgttccatcccctataataccaccgtttgaaaacacgactaccctatctgcccatctgtatgcaaaatcaacatcatgcgttgaaatcaataatgttttgttttcaagactaagctttttaagtacttcttctagcatttctgcatttagaggatcaagagcagctgtaggttcatcaaatataataacttcacttttcatagcaattatatcagctatactgactctctttttttctccaccacttaaataatgaggtggtctttctttaaattcagaaatattcatataatctaatgcttcattaactctttttatgacttcatcctttggaagcttcaagttcattggaccaaaagatacttctgcaagaactgtagaggcaataatttgattatctgcatcctgaaaaactattcctatatttttcctaagttcatttaaattcttttttgttatagcttttcctttataaattattttaccactcttaggtgttaatacaccattaatatttaaaaagaaagttgattttcctgcaccatttgatcctaatacagcaatcttctcacctctatgaatatttaagttaatattgttaagggtatttttttctcccatatatgaatagcaaagttcttttatctgtaaaattatttcttttatcttatcgtccatctaatcctcctattttgcaatataccatataaatatcaatatagaaaaatatatgcaagccaatacaacatgtatagtcttaactttcttttcctcttcaagaaataacatatcaccattatagcatctggattccattgcattataataggtatttgctttttttaaagatacaataagaagatttgatgccgtacttccaaatgaataacatgaagttttgaaatcaatatatccaagccttgactgtgctgaatttttcattttacactgcacatcaattaatataaatataaatctgtatatcatattcatcagttctattataattttaggtatatgtgcttttctcaaaactgaaattatttcacttgtatttgtagaaagtgtcatcatatacattgcacttattgcaccaaatgctttcattacaatctccattgttttcattatattctcatctgaagtatataaataaaatccacataaatgtaaattataatcacctattggactcatggatactccaaatgctattgctatacttccaagaatcataaatactactggaatactcattaatgacatatattcatgaaattttattccccccttaaaaatcgtaataaatcccatggatacaattattgctaatgatacatatatattatctgctattatacagattagtaaggttaaaaaagcaaatatcactttaaatgctggatttatctttctaagctttgacttatatgcataactatcaattttcctttccatacaaacctccttgctttataaatttctttcttacttcaatactatacttattcaatattttcacatccctctaatatactctaattagaaaacataaacgtgttaactttattattttaacctaaaacctactttgttcaaagcaatataatgtaaataactacattttctaaaataaaagatgccttatacgaaggcatcttttcatgttcatattactatattggattatcattattttgataattataatttaaaaattaatatatatctgacatttctacctctacttcatattttacatatgtattatcctgtagtctatgagatatattgtctacatatttttcactacattttggaatacttacaataacacttgtccccttttctttaatactttctatacttatattaccattatgaatatcaataatcttcttagcaatatttaaaccaagtccagaaccctctgtatttcttgaatatgatttatctactctttcaaatatgctaaatatatcctttaaatgatatttatcaattcctatcccatcatcttcaatagttatttttataaatttattatcatcttttatcattacctttatatttccattaattctgctatacttaattgcatttgataatagatttaaaatcattctgtcatataattctttatctattaatgaatataattcttcatctgaagtatcaaaaattaaattaagtttcttactattagcaaatgggaccacacacatagtaagatactcagttatttcaacaatattttcacatgtaaattcagtttttacattttctttctcaaatcttgttgtatcaataaaattatttataagccttgtaagtctattacaattctgcttaattattttattatattttaacaactcttctatatttgcagtgttcttaatcaaatcctgagtctgtactgcagaatatatcacatttacaggagttttaaattcatgagaaatatttgctagtacttcattttttacttcttcatgctttgttcttttttcataatctttataaattatattcttatcatcaattgtcttttttaattctaaaatcgtagcctctaggtcttctgattttttaactagatttttataaagatattcctgtggagtttttaatatctccaccagtataatttttactatacagtaacttgatagtgctctaattaaataatatataaatattagttcactactaatgttcatatatacatttaactctataattatgctaataatacttaaatacatatacatctttaaatacaacgccatagattctgtgatatcagttccacttttcttaattactcttaataaatatattttcaatagaatacaaatagaaaagcatattaatataatactttttatatacaagttatcaacttcatataatggtaaaatacttaatgcagaacatatatatattgtacatatacttattaataaggttcccgccaaaaatcttttagtattaatattatttttataattagaaaaacagtatattagatagcacgattctagtatagcagctaaaatctctatagaaatacaactattttcaaaaccattgtttatatgtatctgctttttaaaacatatatatgaaaatgatagcattccaactgataaaaaacatattgaaagatatctatataaattattaatatattttaattttaagctatacgttgctacggcacttattatatacaatacaaaacaaaaaataattaacacatctattatactcaagatatttaaaatactaaattcttctctaactatacttgagtacattatacaaaacaaaaaaataataccaataacttttaaatcatttttaatattcttcatagtatccctcttattttatatcgtttcccatattatatgttatcatttttttccaaaatatcatatcatttttttgaaattcttcataaaaattacttttgtttggttattctcacaaatatctattgtatatcctaaaatatattcgtcaaataatttgattgtctccaaaattattatagaatttttcttatatatatgatgtatataaaaaaacttctcatactctaatttagtataagaagtttttgatttataaatattaatataaaattatacatagattctattctacagtataatctgcatgtatctgcccttcaataagttcaccagttttgaattccttatttttaattttcttaattacactttcaggaagttcaatataagaaatgacaaattcataattctttttaatatattcatagttttttacaataagtttatattgttttaattcatcaagagcattaattatcctgtctctctttttataaatactttttgttgacattaatatagcatctgtaaatctttgaattgctattacatccttaaagtcttcactttcaagaaccatttttaaccttctattttgaagccatattgcaatctgctgtgcatcattacttaataaatcaaacacatctttattgaagttaaaagaactatccattattataagagttcttaaaaatccacctagaaatacttgagcgaactttcttccatctctttcacttatggatacttcaaaaagagtccctttaatttctcttccttcataattttcagattcaagacgtatgcttccgattttcaataaactttttataacagcatcagtattctttttgctgtcactaagaccaagttcagaaacaagatcccctatatacttatctacgcttttatccgctactatattatagaaatgagtataatagtgagatattattcttgtatccaaactattaagctgttttattgcttttagtaaagctatctgagtaattatatccagagaatccttcccttcttcaattcttaaatatacttgcttttcaagtttcataagcaatttctgctgattttccttattaacaataagtcgatcaattgtaccctcaagtgataaattatcatcaagaaattctttttcgtcatccttaagataatcttttttgtttgtagtatcaattgaaaaattacttagtacacttggtatagtaattacactttttgcgttattagtcagaaaatcataatataattttaaaatgtcgcttctaaatgctagagttatagatcttttttgaaaggtgccaatgtacttataacttgataaaagtgcatcttcattatccctccatgtatatagctcattaaacattttcttcttatattcatctatattattaacgccataaatcattacgaacttatctggctcatatacaccttcaagtactcttttataaaaatgctcagcatactctatatcttcactaagactattattgcttccatttacatatttattaagccatcttgtttttgttcttttaattgaatttgtaagatttttatatattacttctctcttacctgtatcttttaaatttgcaagatcattatccaaagtttcatagaaatcagtaaacttctctttttttactagtacttcgtaaacatttttaaaaagttttatcatatcttctttaaataatctatcatctttatccatgattctcaaatattcacctcactctgtactaattatatcataagtcatattcttttatttgtatacatctatctttattattctcacatatataaaactttttatatacataaactcgcaaataaatttattttttccctcactattataactttagctatataataactcatcagaacatgaatttatattaaatttttcacaaaaataaaagtttcgtgacctgtatttccgttcgcaaaggtaatattactaaaatcaccgttcgcaagggtaattttttttataattttctcaaaattgtcattagatattcttctaaattaattttttatcctaaaatcaaaaaattcaattaaaatattgctgatatttaatgtttttagctattaaaacgcaaaaaatcaaaaaaattttttctttttattgttcattatttgaacttttttttaagttcgtgaccaaaacccaccgttcgcgagggtaaaaaacaaaattcaactcctttttactattatttttattaaaaattgcgtttcgtgacttgtatttccgttcgcaagggtaaaaaatttatgaattttcaaaattaaactttccaaaaagagaaaaaaatctctgcatccaagtctgtaattgactttgaaagtaaattactaaaatcaccgttcgcaagggtaaaatacttataaacgtgataacttggttcacaagttacaaaaatcaccgttcgcaagggtaaaaattagcgttttgcaataattcttaatttcgtataaactaatcatagaattctataagtattgataataagccatttatactggttgttaagcctatacttgtaagtataatttaataatcattttaaaagcatatttattttaattacaatttattattaacaacatattattaaaatcgttatagaatttcttaaatctatatgtaactttataattaaatacaaaattattgtttatttaagaattaatatattttatataaaggaggtgaatttgaatgtctacaaaattaagtaatgagcatattactagaatatcaaaagattgcaacgaatataagatcttagatgtttacataattttagctcatatttcatcagaagttaagagtggaaaatacttaattcaaagttatagtagcaaaaaatctgatcttattaatatagttcataaatattgcccaaaagctgcatataaaacaattcataactgtattgaaaaattagaatttatgaatatattaatttatgatgagtctttatgtgcatggtgtcttaaaaatatggagaatatgacaaagtcaaaagatgaagctgaaactttagaagaaagagaaactttaactggttacactaacataagaaagttctttcttacagatgagttttttaatatgaaagcaagagaaaaaagagtcataatatatatctgtcaacttctagattcaaaagctagtagaaattataaaaatatatcaataaacttattgaaattcaatagtagttggcttaaaattctaaaaaccaaatgtaaatattatgccaaaaatactattgaaaatatgctagaaaagtataaagatatatttaatgatttttcctcattagttcgtgaaaaagatattgctcctaagactgttactagttttaagtttacttttacttgtgaatcattaaataatagaaacagtgaagaagatatgcttgaattgattaaattaaagaaccccaaagaatatgctcttgtaaaagataaagttgaatttgcacaaataactttaagtaaacagaaaataatgcatattgtaagagctatttcaactattaaggaatggttccttaaggaaagagttactcaactgattataaataaatatatagcaattcaaattcaccatagtcgtgaaaatataaaatcgcttcctgcttattctgctgcagtagtaaaagctgtagttaatgaatataatgactttaaagaaaagtttagtaagcattcatctgatagtcatataaataattattatgatacttatatagaaaatgatagttttagttcaactgtcaccgaagatattcaatatgcactatctatgcttaaagcagtataatacacatcaaagcctttaaaattttttgaatttaaaggcttattggcgttattaaaaaataaaaaaagagatgagagttaaaatattctcatctctttttttattttttctagttcaaattatatattctttcaataaatagtatttgagaatccataaatactatttttcttttataattttattacattattttcattattgtgtattttattactattaatataaatatttttgtaaagttgtttaataaattaaaaatgttttttaaaaatatatataagttatttaatatatatttaaaattatttaatattctataatacttgtttatatataaataaaacatataaaataatttattaatgttatatatttttataaaatagtcatttaaaatattattatagttgtataattttttttaatagttattttaaattttttaaatcttgtttaaatatattacatagatatttaattttttattaatgttcttaattttcttagaaaagatatttataaatttagaaaaattatttattaactcgtagtgctaaaagcattgaaatatctagcttaacataatatttcttctttcgataaactgtaagtatatatatatagtttgataatatataaatagtaagataacaatataaactgtaagataaaaaattaactaagataaatttttatataatatgtagataatctttaatgatttatattatatatatatttaacttagcaaaatattagaacatgaatactttaatactatttaagtacctaccccttaaactcacactacttctatacattttttattgaaataaactagttctatctagaagatatagattgcatttgttataatattcattataaaattaatacacattataagtatgtgtttatagtattaaattgatatttaacgaaagtaaaatggaggtgattttattttatgaatattacaaaaaagcaatttgaagaatttccaaaggtagattatatttttggtgaatatatgtataaatataaaatgcatatggataaagaatatagatgcttctctaaagatgatacttttattgatgttaaaaagataaaggcatggcagcattcatataaaattaattattacaacattatgctttttgataaatatttatatatgcaatataaggatactgatttttctataagagatattagggaaattcatattcaggaatttcttgatttttcatataatgtaatgaaaaataaacctattacaatcaatcagaaacttgtttcattaagaatgataatgaaatatatctgtaaatattataatgttcttccttataatattgcacttatggttccaaaattaaaaatagattctgttaaaccaacatcaataagttatagtgatataaaaaagattttatctattttgagagagaaaaattatggaatacgtgatgtatgtatatgtaaaattattatgacaacaggtatgaaaataacaagtgtttttaatatgaaggtaaatgatgtagatcttaataatagactattaaaatatgataatcttgggaaggagtttttctatcctattcaagatacattatataatgatttatgtagttatatggatttcagaagttctataaatcctaaatgtaataatttgtttgttaattcatctggcaaacctaagaatataagatcatttcaaatagcctttagaaatgctgttattaaagctgatcttgatgaagcatatacagcacaaaatttaagagcaagttttttatatgaaatgggacgaattcttaatgatgaaaatgaacttagtgagcttactgatcaaaaaattgtaaagcaatatatcgctctaaaggaaaatcattttaatgatattatttaatatgtattctccactgaatatgttttttctaaataaaaatatataatgctaataaaataaaagcaatagtaattgagtatttttaataactaattactattgcttttatttatgttaactaaaatgaatttaacaatattcaagtattttagttaatttttttatattatactttttctttaaagcttctatttctgcaataagagaatccttatattcaattggaacttttattgttatgcttcctaattcttcttcagttaaaagtgaggataatttacttttgttaactactccgctttcactgtcacaagcagattttatttttgaataatttttattcaaaattgaaatatcaaaattatttataatgtaatcttgatcttcaggcattagtttagaaatagcaacacctgctttaatgcttaatttagcattatctacggcattttgagcagtttcagttaagttgcctagagacttataagatataagctgtctgcttgtaatttgatattcatcggctataactgagttaatatcaaatttaagctttttctctaaagagtctttctttaattttctatatttgaagtttattgagcgagctttttgaatcgtagtaagttgtctttgaacccagtttgtatctactataatttctttggcttcttcttcagataaattcttgtctttaattactgcatgaattttagaatatttttctgaatcttggttttcacataatattttatatgcatgaactctattatgtccacttaatatcatgtatttaccactatcatcttttttccatacgataacaggttcttgaagacctatacttataatactttcaattaattcttgcatttttccagctggaagtctgtcatagaaattccaatcatctggtgcactatataaatcatctatattaacaagaacggaatcaagaccacttgaagcattaactaaatgatttactatactatctgtataattaggtgcatcagaagtatgtgatatgtcattgtcaacatgtgtttcatttgtattgctgctaaaaaagcttgatgcaattcctgatgattttttttcagtatttctatttgttcgtaaattaaaagtactattgttattttttttaaccataagtttatattattctcctattaaaactctaataattttaattgatcagattatactttagtaataaaattataatctaaattatctaagtcaacaaattttaagttactattttattatttttagtatttcttttgtaagtaacctgaattcattagatattcggcagttactgttgtatgcaagtactggcatacttccaacttgagcgttttcgatatttgtatcaactcttattatgctttctaataatatatctccatagttttcttctagccattcttgactttttttagttatgctttttcttgagtcataattgttgattacaagcttataatcaataaaatttggattgaattgttttgcatcatcaataaagtttaataagattcctactccctctaaaccaaatgcgccaagttgaacaggtactatacaataattagttacatttataacattaaagttaagtattgaaagacttggattagtatcaataacaacaaaatcataaagtccttcatttattgtattagttaaaattcttttaagtatgtattctctagcatttttagtaaacataagcatatctattgcagataatgctgtattgtaaactacaaaatccaaattttcatattggctattgattatacaatcctttaaatctaattcgttttttaatgcaattgcaaggtttttttcttcgtcagtttcaagattaaaagaatgtgtaaggtttccttgcatgtcagcatctatacataatactttataaccaagctctgcaagacagaatgaaaccgaacttgtaacagaagttttgccgactccacctttattactcataactgaaattactttagtgtctctgaagttttccatatatatttcatttatatctaattttagataagtgcagattttatttagtgaactcttttttggaataaaatctccagattccatttttttatattcttctaattgaatatttaattcatcacaaatttgtttttgtgttatatcaagttcatttcgtttatcttttattaatttgtaatataatttgcctttcaaatataatcactcctctaatgtatatattaccataaactaagaggaaatttaatgttttaatattcacttattcatattattttataaattattttcaaaaatgaaatttataaaacatagttttagagttatttagaaaaatattcatatatgcaatattttcatgtatgaaatagaaaattacaattaattagtaagttaatttatttataattatatcctttagttatattttttaatcatataaacctttccttatttgtatattttgaattgaaatttaattctaattcaaaaatttattaatatttacactgaaattatggttaagggatacgttatattactgttatatatacaatatataaaaatatatcatcaatataacattaatatatattttttataacgagaaatagtttagatgacttttacataaaaaaagtttctattatatttttagtatataaatactataaaattgttatatgagttatataacaattttatagcgattgtataacatttaaaattaaatttctataatctaaaacctcgtattcctatataaggtaaatgacaaagtaaattgacaattggaaaataatgtgataaacttaataaaacttaggatatattcagaactgggaaagcattttaaagttaatgtgaatacatactaacaaaagaattaagttaacataataaacagtaattaaattctaatcttaaaagagaatagcaattttgtgttctcatgaggaatagaatttttttgactttaaataatgaaatgactgataatttatatatttagtggaggaaagaattatatgaaaaaggaactttatattgcagttgacccaggttttgatacagttaaagttatagctaatggacaattttttaaatttccatttaatacagaaaagacagatgaaaaaagaatctcaaatatgacagtggctgatgattttattctttacagaaataaagataatgaaacatggagaattggacagtatgcaagagagttaatttttgaaaaaaaagatagttctgatatagaagataaaatgaaaagtttttattcagaaaaaagattcgtatcagatgaatttactattggattaagaactgctattgctatggctgttttaaggttgaatttatataagcatcttaaggatattaaaatttatattatggtagccttaccccattcagtaagagataactattcaactcaagttaaatcaatattatgtggtagtcatgattactttgtgaaaattggtaaagaggaagaagaagaatatacttttgtaattgaagaagataatatatttacagtaagtcaaacagttgcttcaattttaggggagacatctgatgatgaaggtaatattgatgaagataaattttattatttatctgatggacctactttagttattgatggtggattttatacaattggtgaagttgctgtggatcgtggtggaagtataaatgaagaaaaaacatttagcgatataaatcatgccatgaaaaatataaatatggaaattgctaaagagcttgaaaatcagagaccagatattaaatattatgtaattgaatatttaatgacaaaaaatgaaggtaaattgaaatatcttaagaatggaaaagctcagattattgatttgaatgttttaaaaaaagaaaagataaaagaaatgagtagtaggttcattgaaagtttaaatgcaaaatataataatttgttagatttcaattatgttcttgttactggtggtacaggtgcaagatattatgagcatcttaaagaatactatgttggaaaaggaattgttgaagaggacaggcttatcttaactaataatattttaaatggaaaaagatttgatattgaatatgctattgcggcaggtgcttacaagggattaaaaggaaaagttgcagtacttgtggagcagtaataaatgaagtcagaacgaataggattaagattcagtaaaaaagatgaagatataatttcatggtttttgatgcttagagaaaataaaatagagcagagctttgctgtaaaagctctgctaaaagctttttttttgcaagagaccataaatggaggaagtataaaaattcgccataatgtaaaaatggaaccaacatctatagcaattaatgaaatagatctaaatgatgatattattaaaatgaaaactaagggaataaagcttgcttcatttacaaaagatattataagattgtacattaatattagtgatatagataaagcaccacagatttcagaacttcagcaaattcatacaaagtataaattaaaatatttaaataacatagtatatgaacagtcacaagaaataaaagttaatattgaatcattacctcaatttaagaaaaatataataaataacataaaaaatgaaaataatatgatagcagaagagtctaattctaatgataaagatataaattcaaattatgaaaatttagtaaaagaaaaaagcaatatggatatgaattttcaaagtagctctaagattactttttttgatgaagaatctaagaatcttcaagaagtttcaaaaagtgaaaaggataaaaaagttaaaagtaaaaaaagaaatccgctacttgcacaaatttaatgaatagcagattatatgttatgatagtatatgaactataaatgaaaggaacatgtttatttataacataatgaattataagtatatgaatgaattaaaaaaatttgataatattgatgagtttgaaaaaatggattttgtacttttgagtaatgatgtaattagtaatacaattgataataatctacaaaaattactttttgcaaaaagaattacaatttcagaattatcaagaaaaacaggagtttctaaacaagttataagtagtagcatagttaaaaatacaaaaatagatcttgattctgcaattaagataagccgtgtattaaaaactccaattgaagatatatttatgttgaaaaaaaattcatgggttgatgtatatattgttaatggaaaaacagtttatttaaatatgaaaactttgacaatggttagtagcgaggaaaaaaatatgtatataaaaactcataaagtaaaatattataatccaattgatgattgtttatcatataaaaattaaatgaaaattataatgagctttttattaaagttggtaaaagaatagaacaattataaagatctatatttaaaagtgaactaagttcatttttgaaagtaatcttgcatataaatgataaaatcttagctttaatctatttttattattaaacatgcaattttaatttcaaaatttataagatatgaagatttatatatagtatgaattattaaattatatcatagaagtaaaaatatcttatctattaattaaaacagagaattaataaatataagtaaaagtatatttattactactggatgcaaaatttaaaataaataaataagctgtttatatagtataacatgtgtaaacagcttattttaaaatataattttttagatattaatatatattgtaacttataaaatttataaatattgttattatacctgaattaacaaaatctataaaaagacatccaacaatagggactacaaaatagggtgtatgaacaaagccatatctatttgtgagctcatccatatttgctatagcattaggtgttgcacccattccaaatccacatgtagctgatgcaaatacagctgcctcataatttttccccataactttatatgttataaagtatgcgaagagaccaacaagaatgacctgagcaaataacattatcataagtggtaatgctaaatcaaataattgccaaagttttaatcccattaaagccattgtaagaaaaaatgataagcttaatccacccagtgtttcaatttctttctctacaatttctttatcggtaaaatcatagatatttctaattattgcagctacaatcattgcaccaatatatgacggaaaggtaagacctgttttctgaataaaatctgaaacaacagatccaattcccatagcaataaacaaaagacatgctccattagttagcttcttaaatgataaaatattatgattttcttcattataatcgccaacttcagatggaggtttttcagaatattcatcacgaatagtttttaatttataattatgtattaatgctttagcaacaagtccaccgatgatacttcccattattagaccaaaagttgctgaagctacagagacagtggttgcacctgttattccaaggttttcaagaattggaccaaaggaacctgctgttccatgaccaccaatcattggtattgaaccagtacaaagacctaggagtggtgttaatttaaatattgaagctaaagttacaccaactatattctgaagtatgacaagtaatatagcaagacagagaaaagtaataaccttaattccaccttgttttaaaactttaatgctagcagtaaaacctatacttgtaaaaaatgcagtcataaaaatattttgtaatagtgtatctagatttattacacaaatattggttaatttaaatattagtattaatagtgcaaatgtaaatccgcctataactgaaggaggaatacagtattgtgaaagtatagaaaatttatttcgtatatatttgccaatatataatacgattgaaacaagagccatagtttcataaatattaaaatttaattccatatatacttttgtcctttcattagtaattattttttatataagataaataatgaattataagaaattgaaataaagtaatgaaataatattttcttaagaaaaggtataaaagcgcagtaaattagaaaattaatataacaaaagaaaatatatcaaacttatttagaatctatatgattattataaattagtatataaatactaataaacttagtactatatattctctatagaattagtttaaaatatacttaaatacatatattattttaagcaattttatattaattagactgtaaattctaataatctataattaagtaaaaagaaaatttcaagattactatttgtatatttataaaaattatctataacaaaaatataaatatttcatatattatgagagaagatgtaagaaatatgtattaataagcataaagaaaaatgtttagacaaaattgaaaattatatataatatttaaaatattaatagttatatattgtggaataattattgcttgaaaaggatgataaatatatcattagaggaaaaagagtattattttcattgttaaataatgtataaaaagtgcatgaaaaatattgaccagaaaatataacagtgatattatgtatttaatgtaaattaagtgcacttaaatttcattagtaaaatttatataggcaatgaaagggaaaagtattatagactacaattttcagagagagaatatcaaccggctgaaagtattcttaaatatgactgtaagaaaaactaccctggagctatggcttactagcttatagatttataagtgaaatgtcatcggtgaaaatcgttaatattattaagatgaattgaatttttaattcaatttgggtggaaccacggatatatgcattcgtcccaagctttgggatgagtgctttttttgttttataaaataattttgaatgtaaattatatagagtatttataaaggagagaaaattatgttaataaatattaaactaaaagatggatcaataaaagaaattgaagataattcaacagtatttgatcttgcacaatcaataagcaggaatcttggaaaatctgcattagttggagaagtaaacggatgtcttgtagatttaaactacaaattaaaaaataacgatgaggtaaatattttatcatatgatagtgaaaaagcagtagaagttataagacattcaagtgcacatattatggctcaagcagtaaagaggttatataaaaatgctaagcttgctattggtccttcaatagcaaatggattttattatgattttgatattgatacaccaattattaaagaggatttagaaaaaatagaaaaagagatgaacaagatagtaaaagaaaatcttaaatttgaaagaattgatgtatctaaagaagaagcattaaaaataatgaaagataatgatgagatttataaagtagagttaattaatgatcttccagagggtgaaaaaatatctctttataaacaaggagactatattgatttgtgtagaggacctcatatcccatcaacaaagtacgcaaaagcttttaaacttattagtgttgcaggtgcatattggagaggaaatgaaaagaataaaatgcttcaaagagtctatggaattgcgttttctaatcttaaagaattagagatacatcttcataatcttgaagaagctaaaaaaagagaccatagaaaattaggaaaagaattaaaattatttacttttgcagaagagggccctggatttccattctttcttccaaaaggagttatcttaaaaaattctctgatagatttttggagaaaaattcattatgaagctggatatgttgaagttgaaactcctattatgcttaataaaaagttatgggaaacttctggacattggtatcattataaggaaaatatgtatacttcaatgattgatgatgaagaatttgcattaaagcctatgaactgtcctggtggaatgattgtatataaatctgactcacattcatatagagattttccaatgagagtaggggaattaggaagagttcatagacatgaactttcaggagcattacatgggctaatgagagtacgtgcatttactcaggatgatgctcatatttttatgcttccagaacaaataaagtcagaaataaaaggggttgtagaattaattgataaagtatactctatatttggattcaaatatcatgttgaactttctacacgacctgaagattctatgggaagtgatgaagaatggcaaatggcagaagattcattaaggggagcattggatgaattaaatcttcaatatgtaataaatgaaggcgatggcgctttttatggtcctaagattgattttcatcttgaagatagcataggcagaacatggcaatgtggaacaattcagcttgatttccaattaccacaaagatttgaattagagtatgttggaagtgataatgaaaagcatagaccaattgtaattcatagagttatatttggaagtatagaaagatttataggaatattaatagaacattttgcaggaaagttcccaacatggcttgcacctgttcaagtcaaggtacttcctatatcagataaatttaataattattgtgatgaagtagtaaagcaattttatgaaaatggaataaggattgaaatagatcagagaaatgaaaagatcggatataaaatcagagaagctagaaatgagagagttccttatatcgttataataggagagaaagaagaagaagaaggtaatgtttctcttagaagtagaaagaacggtgatgaaggatccataaatgttatagatttaatagagagaattaataatgaaattaagaataaatatatttaaagtatattggattaagtttttttattgatattgaaaatatgatattgctcaatagttaggaagatttcaaaagtgaacttagttcacttttgaaataaaacttgcatttttatgaattatttatatccaatagcttggacgtacaatcataggtggaagttttgtttttaaatccccctttgcactattaatttgtgcttgagtaagaaaaatacttctagataagtctgaactactaaggtttgtatctcgcaaatcagcaccaataaaatcagcaccactcaagtctgaatatgaaagattagatgcaataagaagcgctcctctaaaatcagcaccacataggttatatttagtaagatctttgcctaaaaaattttttccttgaatttgttttttagaagttgataatgagttagtactatagactttgaatttttttcgaatagtttcactggtagtctttaagtagacattaactttatcacgataagattcaagatctaaatttaataatttatctacatcccaaagtgaaacttttatagtatcatcaataagagattctattttagactttatcttattattcttttcaagagtatatgattgaacaagataccagagcatttcatgaatttgtcttataattagaaaagtgtcaaacatctttgatgcagattgtggatcttttctccagcttattttattaaatgttttttgagctattttttgtccggcaccaaaacattcataagatatacatcccttaagtctttttttaaacagagtattatggatagaacatgtgaagtcctgttttaaatttatacatggcttacctgcatctttattctgtggaaatccatcacaagcagaaaagaataaagcggtacagcataaaccaaaacagttttcacaatgacactttaattctttactataaagttcatctattgtatatttcataacgtatcactcctatattgagaacatataattcttatgtagattaaatttattacataattatttaattataccataataaggaggaagtgataatatataaacttagagtatgtatgtgaggaattagattaaattattattttaaaataagtagaattatgaaaacttttataatatacaaatataatttataataaaagtattcaactaaaaaattataaataataaggatgtaataattatgaaggaagaaagatttacagaactagataaagatgatattaagagaattataccatgtagacagtataaatggcttgatgatatggaatcagaatatagtgaatatagattctttttagaaaagcttaaaagtataaaagatgtaaagtatattggaactagagatatggtttatgtggtttcatctgactataaatataaagatataaaatttacaatgatagtggatttggaatatgaaagcgtagattttcttgttgatgattgtaaaaaggtggaggatatacgaaatcttatagaaggaattataaaagaatgtatgtaggttattttaaatagatttcactaaagtatgattaactacaaattatactatgaaatagcaaaaatacagatatgaattaagttcatatctgtatttttttgtatatttatttactataaaatttgacatattatgattagataatactttgttgatttaatttattttacagttcgtggaatgaaactttcatatttctttcttaattcttctaacttatgaagtttttcaagtggttcatttgattttgaaatcccaatagcaacaattaaactttctatgaaaaatagtggacctactaatgaatgaaattctagaagttcacctcttgaaacgtaaaatgtaattatattatgattattaaaaggtttaatcaatatatctgtaattattatgactttacaatttatttctgttgcataatctagaattacatgagtttctggatgatagtggctaaataagaaaagtacgattaaattatccttcccaatgttaataagatcttcatataataactgtccagatggattaatactgtttatatttaaaccaaatctatttaatctaaaatttaataaagagcataaagattcagcaggaccaattccatgggtgaatattttatcagaagaaataaagtattcaactgctttattaaaatcagattcacttattttttctgcactatcttcaattaatgaaatagacttcttagcataatttttataataaaattcatcagagtctaaaatagatttaaatttagttgaaggacttgattgattatgaaagtctttaacagcttctttaaactcctttaaattggtataaccaatttttctccagaatctcgatactgttggttgacttataccagtcatttttgaaatatctatttctgtatataaaaaaaggttttctttcttagacaatataaaatcataaattattttttcattttttgtgaaatttatattttcatttaaaggcaaatacaagtgagtcatctccttaactatataatttataattatactaaaatgaataaaattattcaataataaataaatgtgaataattttacaaaacagtaatatgaacttaacaattatagtataagataaaaatataaagtttaggaggtatcaattaatgcaaacaattgaaagagaaagaagattaacatcaaatcaaaaatttatggtatttatgctatctatgactatttttggtcttgcagatttagtaactcagattcttccagaattatcaataggttttatagaaataagagtaccgtattttgcatttatagcaattacattggcaatattatttgatccatttactgtagccattggttcggcatttggtgctgtaatatttggtggattgttaatggggaactttgggggcgtaggagaaattgaaggatttttacaattatctgtagcaatatttcttgggggaatggctgtatctaatcctttaaataaggtgcaagtatttatagcatcatgcattacggttggatttgataaatttgtaggtggattagtagatgtagcaaaagtattaattggtcttgaaggtttagaacctgtatctggacttccagaaagtatttttataattcaaggagtagaatttttaaatgacttcatacttgcaggaattatatttggagcatttccagcaatgtacttagtacctaagttatatggaaaaattgaaccactattaggtatgaagccaagaaaagaaatgcctaaaatggaatggagcaaaatattaaatgtaaaagtaattttagtatctattattcttggtttgatatcagctggagctgcattcttaagtgaaatggatataaatataatagaatttgaattaggatttgaagaattattaggtggaaattttatatatgtagcaattattatttcagcagtattattatttggaatatggaggtattgtacaagcaaaagaaaagaacgtacaaattaattaattaaatattttaattaatcaccatgtaaatttttaattataagttggattttacatggtgattaaaattatttgggggatatgaatttaatgttaaagttagaaaatataagttttaaatatccaggtcagaaagaaaatacactaaatgatatatcattagaaataaatgaaggtacttttttagctatagttggttcaaatggtagtggaaaatcaactatgtgtaagctgtttaatggtataatacctaatttttttgtgggagatttagagggaaatatttttgttgatgatattgatacatctaaaagcaatgtagcaaaattatcttcaaaagttggatatgtttatcaggattttgaaaatagtatagtaaggcctagtgtatttgatgaagtgagttttgctgctttaaattatggcattgatgattataaagaaagagcccttgaagctctaaaaatattagatttagagtatttaaaagatgaatatatatggcagttatcgggtggtcagaagcatttagttgcgttagcaagtgttgttgcaactaaacccaaatatataataatcgatgaaccagtagcccagcttgacccacatcatgcaaaacaaacttacgaaaagctgaaagtattaaatgaagaacatggagtaacaattatagtaatagaacatcatactgaatttatagcagattattgtaaggaagttgttttgcttaacaagggaagaattctttggaaaaaatcagtaaaagatgctctgaattctgtagatgatcttatggcatcaaacatatttccaccacaagtaactcaggtggcatatgcattatctaaaggtgaaactggaaaccttccaatatgtttaaatgaggctgaaatattttttgaaaaaataaaaaataatacaggaagtttaagagaaaatcaattgtatacagaaaaggaagaaacagtatcgtttaatgatgttattgctgggtataaagattatagtaaaaataacaaaatagtgattgataatattaatttgaaacttttagaagatgagagaatagctatagttggaaacaatggagctggtaagtcaactatattgaaattaatatctaaattaattaagccatcagatggaaatgtgaaaattaggaataaagatatagcagacaagtcgccagaagaagtatgtaattcagtttcatatataaatcagaatcctgaagaaatgtttatagatgattctattgaaaaggatgttgcatatttcctaaaggcaagaaagagagaaaactatgaagaaattgttgaacagattttaaaggaacttggattatttgaaatgaaagaaaaagatccaagattattatctggaggtcaacaaagaagagtatctcttgctataggcatgggcatgacaccagaaataatactgcttgatgaacctactgcaagccttgacatatcttcaagaaaagaattacttaaaattctaaaattattgaataagtatattaaaacttcaatagtagcaactcatgatatgcagcttgttgcagactgggcttctagagttattgttgtaaataaaggaaagattatttttgatggtacaccacaatcattgtttaagagaaaagatattttaaatacagctaatcttgttccaccacaaatagttgaactaagcagaattttaggccttgaagaaattagccttagagttgatgatattttaaattatataaatattacggaggaaaataactatgaagctagttgataatatgactgaatttttgactgttgaaaatattaaatttgaaataatgagaatagcttatggcaatcccaattctattttgtccaaaatagatgctagggtaattataatatggtatttattttttagtttaataccttggtttataagtgatatacatatattactttcattgtttgttttaacagtagcttttagttattacagtagaataagtttatttgtagttatattgttagctttaagttttattacagagaatataacagtaagtataatgactttatttatgggtggaagtaaagatgtgtttatggccatgtttattgtttcattaaagcttttgataatatcattatctacagtttgtatatttacaagcatggatcctgaaattttaagtgatgcattgattaaatttggtcttccaccaaagtttggttttggtatatcatatggatatagaatgataccaatacttattgatgaatataacagtatttttaattcctttagattacgaggtaaaagacctgaaaataaaaagttctttggtgcaaacattatagcatattatcttaagattttaatgaagtcattttatccaatgattttaaatactgcaaaaagagtacgtagtacagttgaagcattagaaacaaaaggatttagtgagagtgcagaaaatccaaaggtgaaaaaattaaaactttcttatatgagaataaaaaagaatgattatatatttataatagtttctacaacattagttattttaacaatatgtattggaaatctattttaggaggaattgatgatgaatatagattttcatgttcatggtttattaagtaaaaaatctaaatttgatgaagagttatttttacaggctatagaaaatgcaaaggaaaatggactaaatgcttttgtattatgtgaacattttaatgcaaaggatatttatagcatccaaagttacttaagagaaaattatgaatatgagtatgatagatatatggtaaatgatttttctgtctttattggtatggagatagatattaaaaatggaggacatgttatattatgtggaaacagagataacatagaagaaattagaaagaaattagaagattatattacaaaaccaaattttattgattttgaagaattattagatatgggtgaaaaatatgaatgcttaatgattggatctcatccctatagagaaacacataaattatatcttcaaccaaaggaattactaaaaaggcttcatgctttagatttaaatgcaacagacatacattcaagaggattagaaattgttgaaaatgaagttaaaaatttatcacaggaacttaatatttcatatgtaacaggtagtgatagtcactatccaattcaattaggatctgtaagaactatattcaataaaaatatatccacagtcaaagaattaataaatctaattagagaaaataagtataaagttgaagtttctaaagctatagatttgaaagtcttttcagctaaaattactaaacaatatattaaagagaaaataatagaattagataataaaaaaatagatatttaactataaattattcaccaaatacattttatatagaaagcattctaattaaaatgtatttggtgaattttttgtttatatattaagctatatgaactttagagaaaaattataataaatataaattttcattgtgaattatataaactttacaaaaaataagtcgaatatataaataatatggaaatatagataatatttatttataaaaaaggatattaaaggagaaatactagtgaaaaaaataatatcatgtacattagcagcttctgtagcaggaacatctttagcaacaattaatcctaaagatgtacaagctatagagaacaatctagatttatctaattcaattaatgatgatttagttaatgttgaaatcgaaaatacagaagagattattgaaggtgagagtgataataaggaagatatagaagattcagaattaaaagatgatgaagtaaacgaaagtgagttaccaaaagaagagattatagaagataatacagaagaaaacaagaagaatcaggtgaaaaaaatgaagataagacttctgaagaagaggatttagttcaagatgatccaaataaaaatgacgacaatgaaaatggagaagttgcagatgaaatagaagataacagtgaagaaatagttgaagaagattatatattagacgaaattaaagaaaatatagatgattctgaaataaaggttgttggaaaattagaattagatttaaattttgccatgccactagtaaattcagatgatttagatattttagtgaaattacaaagaggaagcaatactataggtataatcgatttatctaagggagttgttgaaatagcatccaaagaatatgaggatttaagtgaaaaagctgagactaaaaacagtaagttaaaaagtaagaaatcaggtaataatgaagagggaaaattagagtctggtattacatataaaatagataaatataattatcagagaaaaactttaaatgatgatgaaagtatttattatgtaaaagttacatttgaaggacttgaaagagatatttattcaatagatgtttctggatcaggttatagagaaacaaaagtagataatattgaaataatggattattcaaagagagtaaaactaggaaattcactttcacaaacaggatataatactgctttcttggctggagatattaatggagactctataattgatatggaagattatcaattggtttttgataaaattggaattaaaaacactaaaacagatttgaagaagtatgatttaaatagagatggaaagatagatgtagcagatttatctgttgtatatgaaaatataggaaaaaatcaagaagaagcaaaggttgagaatacagataagattatagatattaatgaaattaaactagaaactaatgcagaacttaatggaagtacattaaatgacatattattaaataataattctgtagttaagttaggaatgaaagatggagaaaatccaagtgaagaaaatccattaactatatttttggatttaagttcatcaaaaagaagaagtaaagaagatggaatagaaatggagcagattgtaataaaatcaccagaaaatgaaagtgatgatggtgcaggaccgtcagaaggttttattatatatacagatgaaaatggaaatgaacatagagtagaatttagtgataccaatgaagaaataatgacgatatcatcaaataacgatattataattgatttaggaaagcaggtagctgtaaaggaaatatctataaatgtaacttctaatagaggtaataaaaatatatctgaaatagctaaaattgaattcttgaataatgtatataaggaaattccaaagccagatatgaatataccagtaataaagacccttgaaacatcaacagaaatgcatgatgaaagaataactatctcatgggaaccagaacctaatgttacaagttatgaagtaaaatatgaaaaattaaatgataatggtcaagtaataaaaacaaaaaaacttcaaacaaacaaaactcatttaaatatactagataaggatataagcccttatgatttttatagagtaagtatacaatcattaaatggtgactggtctagtggatatgaagaaaagacagatgatcatactggttatgatggaaaaccagataatgtagatagtgatttcaatccaatacagagttattacaatggagataaaggaagcgtaactgaagttcaggtaattccattaagagcacctgaagttccaagaaatctaagtacagctcaagggtataaatcatttactgtaggatgggagaatcatagacaagctagagactttgatgtttattatagaaaagttggtgataacttatgggttaaggctaatgaaagggatgaaaatggcaatagattgatagtttctgaaactagttccgaagttactaatcctaataaaaagaccttgataagatctcatagctatacaataaatggactagaagataatgcaaattatgaagtaagggttactgctacgaatcatttaggtactagtaaaatgtctgaaacatatcttgcaagtacagtttctatcgtagagcctgcaatgagtcaatataaattaataaatagaccaacgtcagaaaattcaataggtacaaaacatataattaatgttactaataagcttgatgaagatggatggggaaaaaatgatagtgcattatcatatgattctaaatatgcattagtagatggagatttttctacatcatggaaagttagagactgggatactggagcagtttatggttcaaaccgtggttctataataacatttgataatgaatatgaaattggacaaattgctttttctaaaacattagaacaagggtatgatggctggagtaataaagttaaaataacttattgggataaagatggagcttcaaaatctgttaatgcaaaatctgtacaagcaaaaagttctaatggacaggaatattatgttgcaacattagcaagtcctattaagactaataaaataaaggtagatacagcaggttatggatctcagacaatatctgaattaagattctatgaatatgacagtttaagtgatgatattgcaggattatatagtgatgatttaaggattgtaataagagatggtgttaagcagagtgatttagatagattatatgaaagattaaatactaaagatcctgtatgtgatgagtatcatccaaacagagaaacccttttaaaagaactagataatgcacagaagttatttaatgatcaagaagtatcagccaatataactacattagatgcaagtataagaactgataacataggaccatcacttggtatggaaaattcttatcagtcattaggatcagttgcaagaccaaatgctttaaaagccacagaaaaagaaaagataatagtttatatgggatcgacagatagtaatacaaaagttgatatagcatttttacaaaattatggccaaccaggttcatatatgtcaaaagtttatacaatatcaccaggtgtaactgaaatagaaattccaaccattttttcagctgatgttgaaaagggtgggcaagttatggcaagagttacttcaggaagcacaggtgctacagtaaaaattcgtttaagtggagtagatgaaatacctcatttaaatgttaacaatataataaatgatacttctaaagtgaatgaagttaaagaaaatataagaacatacataagaaatttaaaaacatatgtaaatgaactgccacaaagatatccagaaacagtaagtgatgaagataagataaataatatttataaatatgaaaagactacttcagtattaaatacaactgatattgaaggtgatagattcactcttactttaccagcaacagaaattcttgcaggaatagagcagggattaagtggaaatgaggaggaagaagtagaaagagtatataatgcacttttggcatgggaacaggaaatacaagttgggtacgctaaaaaaggtgtatttgaagaagtaaaagattttaataataatggagaaatagattcagaagatgatgtgtatttcaattctaataaggcaccattaacaagattaaatgtaaagtatcaaagaatgatgatgggagcagctgcatattcatcatcacatcatataggtgtaggatttggagcttcttcatatatgcaaggaataccttataaatttgatgaggatggaaatgtgacaaatccggatgaagctagattatatggaacattaatgggacatgagattggacattctatggatatttctaatagaatctatccagaaacaagtaataatttattagcatctataacccaaacaatgctcaatgaagataatcctcttacatcgggtgcaatgaatactttatatgaaaaagtaacttctaatacaattggattatctactaatagaagtgtagttcttggaatgttgtggcaaccatatttagcatatgaggataatgatacatataaaatgcttattacagattttgatgaaaatacttccaatgattcatattttgctaaattaaatagagcttatagaaatatgagtgcagaagaaaaggcagatggagatagagatcagtacctaattagaatgacatccaaagtagcaggtagaaatttaagcagtttctacatggcacatggaattattccaaatgcgactacgagggcatatgtttcacagtttaaagaagaaacaagaccaatacaatacataaatgatgaagcaagaagaatgaggatgtctaaaaaggcggatatggaaagtgatacatatttaatagcctcatttggtaaagattcaaatggcaataaggttaccgatggatcatatgttaattctaaggaagtaaaaattgagttatcagtagacaagagtgaagaaaatattcttggatatgaaatttatagaaatggtcttccatgtggttttgtaacaagagataaagataagtctgtaactgtctatactgatactcttgacagtttaaataatagagtaattgaatataaagctatagcttatgattacaatttaaattcaacaaatgaagttgaacttggtacagtgaaagtacgtcatgatggcggagttgcaaaaagcagcatagaaatatcttcaaatactataagtgtacatgaggaaaataacgacatacattcaagctgttcaaacgaagatttaaaatatgctttagataatgatgataatacctattatgaaggaagaatgtttgcaaatggtgagtacaattcatctgttcatgaatctgtaatgaatcctaacaataatccgtacataattcttgatacaacagaattaaagactcttgttggtataaaatatacagctccaactgaagaaaaaggtctaatatttaagaaatcagggattgttgatagtgcactaaaaaaattcaaaattgaagtaagtaaagatggaaatgaatggactacggttaaaacttttgataaagagccattaagtttaagcggagaaaacccaagcgcaactatatactttgatgctgaaggagtaactggtggaacacaattagcttcttataatgtaagatatgtgaaaataactgcattaggaactaagcaaatttcagcagctgaacttgaacttataactcctccaggtgacaatattgaaataggggttgcagtggataatattaattatgaaaatggaattggattattaaaagaagattatgcatatcagcttgataatcctgatactgaagaaaatgaattcagaaagattccaaaaggctcagtaataataacaggtgaatatcgtggtaatcctgcatttaatgtacctttagtattaaatcaaaatgaagagcatatagcagataagtataatggtttattatttgcacagattcctgataatggcgatttaaaagaaatatcagaaggaaattgggtttattgggtagagccagagtacttagatcactttatgaaagaaaataaagaaatatttgcggaattatatagaactgatactgcagatgcatcagaaggtggtcaaagattagtaagtgatacatttaaagttacagttccggaaattttaccagaaataactttaaatagtgctacaggatttagagcatcaaaaagcttagtaactatgaagatagatgatactttaataaataatataagtgaaaatagataagaaatagtaaactttatatgttttgcaatgagtaggataaagattgtatagatgtacagtagcttattagcttttttacatctatgtatcaaaactaagcatcaaaagaaggagcaatatatgaaaaatgttaaatcaaaagtaaaaatatttgttttaggtgcagcagcttcaactgttatagcaagtgctggtcatgcatataaaactaatgcacagcaacagaaaaatttaagtgacaatagtatagaattaaatgttgaaaaacaagatagggatacgattaaaatatatttaagtaattttagtgatctagcaaaatcacttcagttaagtgtaaaaatcgatgacggaaatgttaagtttaatgaagaggaaataaaatggcttgttaatgggaagatgataatgtacagacacattataaaattgacagtaaaaagaaaaccatagattttataatagtatctgatgaagcaataaattcggatagtggagtaattgaaatttgtgaaatagatgtgtctaaggatgaatctattatagataagttatttaaatctaatgattcaagctatagagttgttccaaatgaagttgatggagaagtatatagttatgtaacttattctactaataaaaggattagtggagataatatagttaatgcaagtgatgataaactcactattaatactaaacctgttataagcttgaaagattcttattccatagttgaaaataaaattatactttcaaaaggagcagtatttaatatcaaagattatgtggaagcatttgatgctgatggcaacgaaattgatgatataaaatatgatggaactgttgataataagaaacctggttcttacaacatagtgtgtacagctactgattcttatggtgataaatctatactagaagcaactgttatagtcgaggaggttataagtggaaatatagctaaaccaattatatccggaactgaaaaagctgcagaaataattattggacaagattttgatttagaaaaaggaataagcgccaaagattatatgggaagaagcttaaagctttcaataacaggagaatatgatattgaaacagctggaatatatacattaatttattctgcaacagatcgttttggtaatactacaaatgcagatagaatattgaaagtaaaagaaaaagacgatgactctgatttaggtgacaataatgatgataataatgaagaaaataaatatgagattccagatgaattaaaagatattataaatgttaatatagtaaaacctataagtggtaagggaaccagtggagagccattaatagttgaagctaataataatgcatcttcaatagaatttgtaagctttatgagcaaattagataaatttgatattaactatggaaaggttacagaagatgagaattataaaatccttacattaagcctttcaaatagagagtcaagtatcaacttagaatctgctaatttacaggatatatatttaactataaaagttagaaaatctaatgttgaatttatgaatgttttgaatgatttcataaaagatcatggttttgaagatacaggaagttcaggaggtggatcaaattcaggcggtggttcaggtggttcatctagtggaggatcaggaaatagctcgtcatcagattctgaaccagctgataaagagaatagttcaggagaattaaattcaggaaacagttcatcatctgaaactaacaatggatggataaagaatgagaatggaacatggtcttatactaattcacagggtataaaagctacttcaacatggatatatgatttaggattatggtattatctaaatgaaaacggaattatgaaaacaggttggcataaagatatagatggtagctggtattatctaaataattcaggggcaatgaaaactggatggtataaagatatagatggtaagtggtatatgttaggtacaaatggtgtaatgaaaacaggatggtatagagatacgaatagtaaatggtattacttaaataattcagggaatatggttactggatggataaaagataataataaatggtactatttaaatgaaagtggagatatgcagtatagtggatggaagaaaattaatggtaaatggtattacttctataataatggtgaaatggcatcaaatactgtgattaatggatacaaagtgaatgcagatggtgaatggatttaaaaataataaggaattttattaaactagatattatataaaagtatgaaatattaagaataagaatgcgtaaatctgaattaaggatttacgcatctttttgtgtcaatattttttcaggataatttatttagaaaagaatgtgcttgtttattaactaaaaatagcagaaaggtattttcaaagataaatcagttttgtgaaaatttaacacaaatttagcatttattaacttgaattagatgtataattttatgaagtattattaatattatattaaattaaatgagttatgaaaggcatgtctgattatggaatcaattaaagaaaagaagaatatttcaaaattaactttaggtggggcacttgtagcattaggagttgtttatggtgacataggaacctcaccactttatgtaatgagatccgttataagtaataatggaggtttacagaatgtatcagaaaactttattttaggtacattatcattagtgttttggacacttacccttttaacaacaatgaagtatgtactgcttacattaagagcagataataatggggaaggcggaatattttctctattcgcgcttgtgcgtaaggaaagtaagtaccttattattcctgctatgattggtggttctgcattacttgctgatggaatgcttacaccggctgtaactgtaacttcagcagttgaaggattaaggctaattccaagtcttaataatttttttcacagcaatgaaaataatattttaataattgtaatatgtattttagctgttttgttttttattcagtatcttggaacaaattttgttggaaagttatttagtccgataatgttagtatggttttcatctctagctttttttggattaattaatcttaataataactggggactacttagagctttatcgccacactatgccatcagtatcctttttagttctgaaaacaaagttggttttttcatactaggaagcatattcttagctacaacaggagcagaagcactttattctgatttagggcatgttggaagaaagaatatctatacgacatggccatttgtcaaggtatgtttattgataaattattttggtcaaggtgcatggttattatcagtaaaacaaaatagtacttttattaatgcagaagatctgaatccattttttcagatgataccaaattcacttttattgtttggaataataatttcaactttagctgcaattattgcgtcacaagcgctaatctctggatcatttactcttgtttcagaagcaattaaattaaatttatttcctaaactacatactttatatccatctgaatctaaaggacaactatatataccttctataaataaggtattatgtttagtatgcataggtattgtactttattttaaaagctctgaaaatatggaggcagcgtatggacttgcaattacagtgaccatgctgatgacttcaattttattgtttaattacttattgatgaaaaagacaccatttattatttctttattaatttttatattctttgctacttttgaatgttcattttttattgcaaatgcttcaaaatttagtcatggaggatttattactgttttaattgcttcaattattttattagttatgtttatttggattagaagccattatattaagatggaattgctagagaatgttcaaatttcggattttaaggaacagttagataatttacgtaaagatgaaacacttcctaaactagcaacaaatcttgtgtatttaacaaatagtacttgcactaaaaaaatagagcataagattatgtattcgatattagataaaaaacctaaaaaggctgatgtttattggtttgtgcatatttgtgttaccgatgatccttatgaagcaagctatgttgttgacacttttggtacatcttatattgtaagaattgagctaaatcttggatttagagtagagcaaaagttaaatatctttttaaggcagatttcaactgaactagttgaaagtggtgaaataaaacttcaatctagaatttatacaacacttaaaaacagaatagttggtgattttcattttgtattactcaaagaacagctttctcataaagcagagttaaatttctttgattcaattgttcttagactaaacttatttattaaaagatttactgtttcaccatcaaaatggtttggtcttgatactagcgatgtttacatagagaaagtacctttatttgttgataatagtaacgctgattttttaataagaaaatatatgtctatgaataaaaaatgatgttaattatctgaaatagttaaattatattttgtaatagcctaaggattttaaggttctagtgaagaaatttaaatgaaggcagaaatattaaatgacaggatgaataaatttagataaatacattaagacagggaatggagaaagaattctgtatagaattctacgacattccctgttttatttattttattaaagaattagtttcaatagagttaactttttaggtatgttatataacataatccccttgatgatattttcattaaattagttaaaaatatttttaatacaaattaattggtaagtcataatatttttatagtagtataatgagttttgttacaaaatatgtgatgaagttacagtattattgtatataattggttaatatttgtttagaatattatagatatataaaaaaattaaataattagtggaatttaattagatcatgtgttattatttcttaaacgtgtaatatttaataatttaagggtgtctttattaaattagggggaaatttgcaaataacaattttattttaaagtcaaagaattgggggaattttatgaaaaatttactttatatttggaataaattaagtttagtaaaacaaataattataggattgattaccggtattattttatcattaactattcctgaaaaagtaaaaggaataagtatttttggaaatttatttgtaggtgcattgaaatctgtagcaccagttttggtattatttttagttatgtcagctatttgtcaacataagagtggaaagaaaacaaacatgaaatctattatagggctttatgcagtaggaacatttcttgcagcaattatagccgttgcagcaagcttcatttttccaataacattaacactttcaggaggtatagataatgtaagtccaccaggtggtgttggtgaagttcttaatacattaatgatgaatgttgttgacaatccaataagagcattaagtaatgctaactatattgggatattatcgtgggcattgatacttggatttgctttaagaagttctgcagattcaactaaattagttatatctaatttttcagatgctgtttctaaagtagttgaattaatcataagatttgcacctattggaattatggggcttgtctttgacactatttcaacaaatggcattgaatcattacttggttatggacaattacttttacttttaataggatgtatgatttttgttgcattagttgtaaatcctctaattgtatatataaatatacatagaaatccatatccacttgtaattaaatgtttaaaagaaagtggtattacagcattctttacacgtagctcagcagctaatattccagttaatatgaaattgtgtgaggatttaggattaaatagagatacatattcaatatcaataccattaggatctactataaatatgggaggagcagctgtaacaatttctgtattatcacttgcagcagctaatactcttggaatacaagttgatgtaggaactgctttattattaagcttattgtcagcagtatgtgcatgtggtacttctggaatagcaggaggatcacttttattagttcctttagcctgtagtttatttggaattccaaatgaaattgcaatgaaagtagttgcagtaggatttgtagtaggtgtattacaggattcatctgaaacagcactaaattcatcaacagatgttttatttacagcatcagcagaatttgcagaaagaagaaaatctaaaaaagaatcacttaattaattataatgctttaaaggcattataattaattcgaaacaggtattggacatatataattagtagggttaagatgtaggtaataaaatttatctacatctttttattataaagaaatattcaaatatgatttagatgaaagtttgttaataaagttattagaatggggatattcttatagattaaagtgttgaaaaattacaaagtaaatataaaaatataggaattagataattaagactaaacttaaaagaagaagggtgagaggggtatgaaatatattaaattaggaaactcagatttaaatgtatcacgtatatgtcttggatgtatgggatttggagatgcagaaaaaggaatgcataaatggacattagatgaaaaaaaatcagcagagattataaaagtagcactagattatggaataaatttttttgatacggctgtagcatatcagaatggtactagtgaaaaatacttgggttcagcaataaggaaatttgcaaaacgtgaagatgtagttattgcaactaaatttttacctagaacacaagatgaaattaataaaggtgtaagtggaagagaacatataatacagtctttagatacaagtctttctaatcttggcatggattttatagatctttatatatatcatatgtgggattacaatactcctattgaagaagtaatggaaacattaaatgatgttataacagagggtaaggtacgttatataggaatttctaactgctatgcatggcagcttcaaaaggcaaatatgattgcacaaatgaatggttggaacaagtttgtatcggttcaaagtcactataatcttatcttccgtgaaacagagcgtgaaatgacaggatgctgtattgatggaaatattgctatgactccatatagtgcattagcatcaggaagattagtaaaagattcatcagaaacatcggaacgtcttgagaaggattcttttgcaaagggtaaatatgataaaacagcagatgttgatagaataataattgaacgtgttgcagaaattgctaataagagaaaaatgacaaggatacaaattgcccttggatggctgcttactaaagttacatcaccaattataggtgcgactaagatatctcatgtagaagaagctgtaaaggccatatcagttcaattatcagatgaagaaatagcttatttagaagaaccatatgtaccacataaattagttggggttatggcaaaatagagttacaaaaaaataaatatttatagagattatattaatttaataatctctataaattttactttcttgaacgcttaaattcaagaggcgtttttccatgtgtttttttaaacatctttataaaatttccactataattgtagcctatctttttagatatttcatcgatgctcatgtctgttgtagataataaattttcagccatagccattcttattgaagttgtatactgacttatagacatatgatattttgcagaaaatccagctttcaacttttgttcatttagaaataccattctacttaaactttttatggtaggtggatttaatgcttcttttgttaaaatatcataggctttttgtaaagcagcaacatctgaagatgttaaattaatacatctatttttacctattttaatatgaccatgatttatctgatttgtaaatatgttttgattagaagaagctatttcagtattgagtaaggaaatacattctaaaattttactttctaaatataaaggtgtaagactgaaggattcagccatacttctgagtttttgaattattttggctatttcaataggaagatagggataagtataattagtaataaaactattgaaatctattatgtctggaaagtttggttttaggatttcatcaaagtattttttataaattgttatttctgcaccatgaaaatgttgtcctttcttccatacctgttttcctttcaaagatttttctgcaacaaaaaaagaagatgggctaaaagatgaaactgaactgttttcaatttcaaattcagtttctccagtatatactgttccaaaacgtattaattcttcattatgattgaaatttagagtgaaatttgatggaattgtataatcgcctatgccaaagtcataatattttttgcgggtatatttaataaaatatccaagttcgggtttattttcatttttataaattatgcaatttttcattctatatggggagaaggttatttcttttagaacttgattttgaaagtcatttgttgttttacatatcatactattattcctgctttcttttaatagtaacgtacaaaatttatttaattatgaaaacttttaagaattattaagttaaattaggataaaatatttttagaatttttattatatcataaataatcatattaggtgataaaattattaaattagatgtaaacattgaaatgataatgaatatcatatacaatttgtcgtagctgataagaacagaaaactataataatatatagttaaaagccagttatagaaaacttatggaggaataaacatgaagaaaaaattatttaagatattagcagtttcatgcatggcagttatgatgtttgcaggatgtggaacgaataataattcaagtagtaataaagaatcacaaaaaactgtaacagttacagacgtaagaggagaagttgaaatacccgaaaatcctcagagaatagtagatttaagtggaaatagtgatattttatccatacttggttataaagttataggtacagcaaacagcgatgcttatgattatacgaaattcccatcatatttggaagacacattaaaaggagcagaaattttagggtacagcatgcaggatactatggatgttgaagcagttatgaatttaaatcctgatttaataataatatcaacagttcaggaaaaaatgtatgatacattaagtgagattgcaccaacagttatgattcagcttgaggccttaaattggaaggatgatgtaaaggcttttgctaaagtgtttggaagagaatcagaggaagataaatggatttctgattatgaagcaaaggctaaggaagaaggagataagattaaatcagagtatggtgaggatacaacatatctttcattcttagctagtggaggtcaattctttatttttgatggtgcaggatttggaagtgtactatatgatgatatgggtcttgaaaagccagaaggtatgccagctcaaagtgatataagtcttccagttgtaacttatgaaggtcttgcatcaataaaatctgattacatatttttaatagcaacagacgaagatttagaacagcttcaaagcaatgcaatatggaacagcattccggcagtgaaggaaaatcatgtaatagtgttaaaatcatcaccatattttaaccagggatatagtccaattggaagagaattattaataaatgaaataggtggaatgttaaatgaaacaaagtaagaaacatacagcactatttataagttgtagtttgttacttctagtaataggaatggttctggcagtgtgctcaggatccgttcctattagtttttcagacatttttaacagtatatttaattataatgaaacacttcaacttatgctagttaaagatgtgagaattccaagggcactttgtgtagtgtttacaggaggaatactaggagcaacaggtgcaatgattcaaggcgttacaagaaatccaatagctgagccttcaatacttggtgtaagccagggagcaacacttgtaatatcaattttttatgcagcaggaattgcagtgaatacaaaaaatgtaatgatagcatcttttataggggcattaataacaggaattatagtacttatgtttatatcaaaaaaggcaaataataattcaattgcaaaaatacttttagctggaactgctatgagcacatttttcatgtcattaactacaataataggattgttatcaaatcaatctcaaatgataggattttgggtggcaggaggatttagaaatgtatcgtggagtgacttcaatcttgtagcagttgttggaattttagggttactggcaggtgtttttttatcaccaaagataaacatattaaatcttggagatgatgttgcaataggtcttggagaaagtcctgaaagaataagaattataactcttatagcagtaataccaatgtgtgcagcagctgttgcagttgggaaaaatatagcatttgtaggacttataattccacaaatagtaagaaaaatattgggagaagattatagaagaaatataccatgttcatttttacttggggcagttcttttaatttatgcagatattgctgcaagaatgatatttaatccctatgaaacaccaataggagtatttacagcattaattggaataccatttttcatttcaatagcgagaagggagagaggataatgaagaaaaatagattcaaattagttttaataattttatcatctttattaattatctcttttggaattacgttgtgctggggaacatataagataggtccattagaagttataaatacatttcttggaaatggaacaaaacttcaaaatacagctgtgctttccataagacttccaaggttattagtaggagcttttgttggaattgcattatcaacagctggaggagttttacagactataactaaaaatgatttggcagatacaggaataataggtataaatgcaggtgcggcagttgcagcagtattgtttattacattttctactggaaattattatagtgaacttggacagctttcaatatttatacttccgctaatggccatcttaggtgctggaatatcatcatttgtaatatatattatgtcaagcaaaggtggaataagacctaaaaggcttttattgattggaataggattaaatgcaggactaaatgcatttataactttttttactttcagaggaggagttggagattacaacagagtattggtatggacctcaggaagcttatggggagctggagcagcttatgcaaaagtgattattccaatagtaacgttgctttatgtattagttttattaaacaataaaaagttagatgttttaaatctttcagatgaacttgcattatcattaggacttaatttagaaaaggaaagaaaaaagtttttatgttttgcagtaatacttgctggatgtgcaacagcatttgcagggaatattggtttcttaggccttatatctcctcatattgctaaaaaattggttggacattatcataagaaatttttaacaatatcagcaataataagtgtaataataattcttttggcagatgcagtttcaagaaatttattctctccaattgaaattcctgttggaataacggtatcaatatttggagtaccatattttatttatttaatgatgaaggagaaataattatggaagctatcagtgtacgaaatttaagtatatcatatgaagataacaatataattgaagatatggatttatctattccaaaaggaatgataactataataattggttctaatggatgtggaaagtcaacgcttctaaagactatagcgagaatcaataaacctaaaaatggagatatttttataaacaataaaaatataaagaaaataaaagaaaaagatatagcaaaggaagtggcatttcttccacagggaccagtatgtccaagtggacttacagtaagggagcttgttgcttatggaagatttcctcaccagaaacttataggtggccttaacagccatgataaggaaataatagattgggcgattaatgagacaggattaagtgattttaaagacagagaagttgaaaatttatctggaggacaaaggcaaagggcatggattgcaatgactttagctcaagaaacagatattataatgcttgatgagccaacaacatatcttgatatgtcttatcagcttgaggttcttgaagttcttgaaaaacttaataaagaaaagaatattacagtggttatagtacttcatgaactcaataatgcctgcagatttgcaaacaatatagttggacttaaaaagggaaagataatttgtgaaggaaagccaattgatgtgattaataaaagtactttaaaagaaatatatggaataaatgcaacgattacaaaaagtgaaaatggggagtatccaatatgtatggaatatgaacttttaagggaggctccatgaaaaataaaaactttataataattgtaataggacagattatatctctttttggaaatgcagttcagcgattcagtatgtctttatatttactgcattttacaggaagtacagcagcttttgcaaagatacttgcaatatcaactataccatatataatttttgcacctattgcaggacgtctttctgataaaataaataaaaaaagataatgatttatttagaccttttctgtgcagcattaattggaggttatgctcttattctgttaaacggaagggatagtgagtttgtagttggagctgttatgtttatattatcaatatgttatacgttatatggaccagcagtaacatcatctatacctcagatagtaaatgaagatagactcacatctgcaaatggaataataaatcaggttggatcagctgtaaattttgttggtccaatacttgcaggcgttttatatggattagtaggtataaaactcatagtaataataaatgcattaagttttcttatgtcagcaatattagagttatttctggatatacctgatgcagaaagcaaaactaataatgtaataggaaaagataaattatctgatgattataatagcagtgataggttattatcttttgaatttgttaaaaattcatttatagatatgaaaaatacatttatgcatttaatgaatgaaaataacattatacttggaataatagtttcatatgcattagggaatatttttttagttcctatattatcaattgttgcaccatacttcataaatatttatttaggactaccttcagagatttatggaatagtagagggcatatgtgtattagggatgatatgtggtggtttctggataagtataaaaccagagatgttttctataaaaaaagtccattatacatatgtgcctatgattttaggtgtcgctttaatgtctgttatagtatttttaaaaataaataactatgctatggcaggattattttcactttctggaatggcaataatgatgtcattatctttatctaatgtactaacacttacttttatacaaaaagaaatatcaatggatatgcttgggagtgtatcagcattatcaacagctgtagcaactataagtgttgcaccagggcagttactgtttggtcaggcaattgatagtggaataccgattggaatgatattattaataacattatgtgcaaacttttgtcttgtattatttattagatggaatgtaaggaagttgaaataaaattagattgtaacatatggtggaagatataaattacatatcttccaccattatttctatcttaacacagtattgattttcatctttcgttgaaagttcatttagtggatattcttcataggcatcactacacatacgtaaattatttttatctataaatttatataatttttcgtaaaggtagtcagattctccataagcacatcttccataaaaaactgcatacttcccttcaggtttataggaattttgatcatgtatagctttaaaataatattgatttgcatataaagggtttttattttcaatatcctttttattgataatagcaccaagtggataacctatatcaattccattttcagcagcaaaattataaaatgaaatagcagcctcatctaatgagtcattagaaattattggccctaaaaaaataggctctttctttttatattcgatatttatactattgtctttatatttaacagcatcctctgccatgtcaacataaagttgcataacttctaagatacgtttaagtttttttatctcagttaatatatgttgcttttgtgagctaaacaaagaaaacatttcttcaggagtacgtatatcaatgtatcgttttatttcttcaattccaatcccaagttctctaagggaaataattaaatatgctgtagttaactgacttctagtataatagcgataaccattctttccacgaaattctggtgacaataatccaatttggtcataatatcttagattttcacgtttaataccagtaagagcagaaaattctttaatttgcatattagatttgtctttcataaataacctccaattttaaaatacactattgacattaaagttactttaagctttataataccatttgaaataaactttagcaaaattacttacataatggaggtaaactatgaagtatttaaaactattcctaaaagaaagtaagggtaaagtaggaataacattaattatgcttttgggacaatctgtagggatgttattaattccatttttgatagcagggattgtagataatggaattttaaagggtgatattaatgagattatcaatataggtggacaaatgatattagtacttttaataacaacggtggcggcagtacttggaagttattattcagctgatcttgcggcagtttttgggtactacatgagagataaaatttttcgtaagagtcaggagttatctattcatgaatttgacactattggagtttcttctatgattacacgtacaacttcagatatttctaatttgcaacaaacttttggattgatattgcaacttatagttccagcaccacttattattatttcatctattataatgacaatacacactagttttgttttagccttaataattattttatctgtggtaatattcatgatttttgctagtttagtacttaagaaatcaatatttatttctaaaagagttcagactaaattagattatatcaatcaagtaataagagaatgtattactggaattcgtgttattcgtgcatttggaaatgagaaatacgaagaagatagagcaggtaaagcttttaaaagttatgctacagatatgataaagctaaataagatatttgctgtattaaatccaacaatatggcttataattggcttatccatagcttctatagtttggataggtggagtattttctatgaatggaacaatggaaattggtcaaataactgctgtaactgaatactctattattacattaagttatttgatattagctacaacaacaagtgttacactacctaaaatgaaatcatgtcttgatcgtatagaggaagttttggaaattaatttagaaattcaggatttagatatggaaaagaaatataaaaaggataattatgcagtagttgaatttgaaaatgtatctttcttttataacggagcagaggaaccagttataagaaatgtatcattttcatgtaataagggtgagacaacagcaattattggaagtacaggttctggtaagagtactattgccaatcttattttaaggttacatgatatagatgaaggagaaattcgcataaatggtgtggatataagatgcatttcacaaaaggaattaagagatacaattggttatgttccacaaaaagcatttttatttagtgggacaattgaggataacttaaaaatgggatataaagatgcaactaaagaagatatgaagagagccttaagtatttctcagtcagattcttttgtagataaattacctgatggattaaaatctgaagtatctcaaggtggatcaaatttctcgggaggacagaaacaacgattatctattgcaagggctcttattagatccgtaccaatttatatttttgatgatagtttttctgctttagatttaaaaacagattcaacccttcgtaaatcacttaaagaaaatatgacagaatcagctaagataataattgctcagcgagttagcacaattatggacgcagatcaaatcattgtattagatgaaggaaaactggttggggttggaaaacatattgatttaatgaaaagttgttctgtataccaagcaattgctaaaagtcagatgagtataaaggaggcttgattttatgaagaaggataaaaagaagaagaaagatacaaaggcgtttagtgaagatattcctaaaaatacaaagaaggccattaaacgactaatggaaagattaaaaacacaaaataaaaagttgataattgtaggtatattggtattgcttagtagtgtattttatgcagttataccactgatggttggattagctataaataatctagtatatgcaattagtaactttgataaatccgaaagtgttgtatccatagtaacgcaagcattagctatgccagttttaactctagtaataatatctatgattaatagttttctttcttatattcaacaatatatagtatctagtgttggtgaaaatttaactctatcattacgtaatgatattagtaaaaaaataaataagcttccactgaagtattttgattcacataaaaaaggggatgttatgagtagagtaactaatgaccctgaaaaagtatcattggtaatgcaggttggatttatgcagtttatttcttcatgttttacaattatacttacaattatttcaatgattatattaaatttaaagttatctttagtaatctttatatttattggaattagtgctattgcaacaaactatgtatcaagtttaagtcaacgttattatgcatataattttgatgctatggggcagttaagtggaaaaattgaagaagtgtattcagggaatcgtattataaaaatatttaatcagcaagaggatataattcaagaagttactgaacttaataaaaagcagtttgaagcaaatagaaaggctcagtttgttgattttgctatatatccaactataagacttctaagccaattgggctttgttgcaaccgcaattataggtggaataatgacacttaatggacagatttcattaggtgcaattcaggcatttttacaatatgtaaatcaagtttctgaacctattactcaggcttcgtatgttattatgtctctacaatcagctattgctggagcagagagagtttttgaattattagatgaagaagaagagattgcagatattaaaataaatcaatctttatttaatgaacataatatatctagaggaagagtagattttaaaaatgtaaagtttggatatacagatgagaaaaccttaataaaaaatctaaatcttgaagtaaagccaaatgaaatagtagctattgttggtccgacaggtggcggaaaaactacattaattaacttgattatgcgtttctatgaattaaatggaggatatatatcaattgatgggattaacattaatgaaattcctagaaataccttgagaaggcaaattggtatggtacttcaagatacatggctatttgaggggacaatagctgaaaatattgcttatggtaatagggatgctacccgtgaagaaataatagctgctgcaaaagctgcttgttgtgatcattttatccgtacactagagcatggatatgatactgtaatctctggggagacatctaatatttctcaaggacaaatgcagcttttaactattgctcgtgctatgttaacaaatcccacaattatgatattagatgaagctacttcaagtgtagatacaagaacagaagtagaaattcaaaaagctttatctagacttatgaaggataaaacaagttttgtcatagcacatagattgtcaactatccaaaatgcagatatgattttagttgttaaggatggggatattgtagaaagaggaagtcataataatcttatagaacaaaatggtttctatgcatctctttattatagtcaatttgaagtggcaaattaaatcaaggaaaagcaacagataatatgagtctctatatgaaaagtaaatattatattttcatatagagattaatatttataaataaaactaaagttttaatggtcattttttctatactcggatggagtacatttcttttgttcacgaaaagttttaacaaagtaacttgtatcttgaaaaccacattgagcacctattttagcaatagtttcgtttgttgaggttagaaattcaacagctttttgaatacgaaattgctttagatactgaataggaggtattccaattatatttcgaaaacatcggagacattcgctttcactaatcattgcagtatctgctatcatagaaacatttatttgatcaggataatgatcttgtataaactgaagcattaattttaggcgattactatttcttaatactttttcagagggctgccttgatataacaggatgataagcagataaatgtaaaatgagttcggatagtgaggagcgaacttgaaattcgtatccaaatggttcgttagcgcaactgttccaagctgattctatagcatgagttgcttttttatgccatgcttctgaactatcaagatgtatatgttttactattggatttgtcagcaaaggttgaacataattatgccagaatatactatcaatgcttccaccaataagacgagggtgaaaagtaatggaatggagatgacaaacagaacaattcatgctccatgcagcatgaagtataccagcatttataaatataccttcaccttgctttactgtatatttttttgttccagcagcaattaatgcagtgccttctgaaactataactgcttccaattcatcatgccaatgccaaggaacgctttttttaatcaaatcatcatcatagcaggcaacaggaaacaaaactgtaccatgttctattagttctcttccatgttcatttgttgtggtattacataaagataaagccattaaatcctccaatattgacggtattattatataaaatagctgattttattatatgtataataattttttgctgatataattatacttaaaagaaaggggaaatacaatatgattcatttacttctagcagttatttatttatcattcataagtcttggtcttccagattcattacttggatcagcatggccggctatgtacggtgaatttggggtaccggtttcttatgcaggtattatttctatgattattgcggcaggaacaattttatcaagcttacaaagtgatagactcactcgtaaattaggaacaggaaaagtaacagcaattagtgtagcaatgacagcagtagctctgtttggattttcttttagtaattctttctggatattatgcttttgggcaattccatatggtcttggtgcaggaagtgtagatgcatcgcttaacaattatgtagcattgaattatgcgagcagacatatgagctggcttcactgtatgtggggagttggtgcttctcttggaccatatatcatgggatatgcaatgacaggtggacaagggtggaattcaggttatggttatattgcagtattacaaatcgttttaacaattattttaatctttagtttgcctctatggaaaaatagaacagaagaaaaaaacgaaaatagtgtaaatgcaaaaacacttacactaaaagaaattataaaaatttcaggtgcgaaagagataatgattacatttttctgttattgtgcattagaacagacaactggactttgggcaagtagttatttaactttacataagggtatatctgcagataaagcagcaagctttgcaagtatgttctttattggaattacaataggtcgtgcatttagtggttttattactatgaagttaagtgattcaaagatgatccgtttaggtcaaggagtagctgccattggtattataactttaatgcttccctttggagagtatatatcattaatagggctgattatgattggtcttgggtgtgcacccatatatccttgcattattcattcaacaccagaatattttggtgcggataaatcacaagcaattattggagttcaaatggcaagcgcttatataggaacattattaatgccaccaatttttggtcttattgctgagtatattaatgtatcactatatccagtttatctttttatagtgatgatttttatggttgttatgcatgaagcattactacgaaaaaagaatatttaaaatatcgatttagacagtgatagtctttttatattaaaatttataataatatataaaattatatattgttcatacaaaaggtgaaatacttggtgaggtattatttacagtttagagatatttagttaacagtctaataaatataaattaataactcttattttaaaaggtttataatttatatctatgctttcatgaccatgaaattttaatatataatttgatgaaaataaaaaaattatacatatatattgacagactatgtatattagtgatatttttggtaaggtacttttaaattagttcagcgaaactaagaaaggaagatgatattattatgtatgataaaatttcaaaaagtggaaaagacagtatagatgtgaatgaaaaaatacctttagttaaggcgattccattaagtatacagcatctatttgcaatgtttggagcatcagttctagtaccacttatatttaaaattgatccaacaacagtattattttttaatggtataggcacattgctatatgcgtttataacaaaaagaaaaattccagcgtatttaggttcaagttttgcatttatttcaccagtacttttattatatagccaaggttatgattttcaaacaatacaaggtggctttgtaataactggaatagttttttctttgatagcagttattgtaggatatacaggaatcggttggataaacaaattatttccaccagctgctatgggatctattattacaataataggtttagaattagctagaagtgcagcagacatggcaggattcccagtaggaggaagtaattcaccaacaatgaatattacttgggtaattgtatctatggtgacattagttacagttattttatgtaatgtacttttaagaggatttttaaaagtaattccattgttaataggtgtaattgttggatatattacatcatgctttatggggcttgtagatttttctacagtaagtaatgcaagcttttttgtattaccaaacataaaagtagcacactttaatattaatgcaatacttacaatattaccagcaacttttgtggtagtagcagaacatgtaggacatctaaaagttacaagtagcatagttggaaaagactttatgaaagatccaggacttcataaatctctacttggagatggattatcaactataatttcaggaatgtttggatcagttccaacaactacttatggtgaaaatataggagttatggcattaactaaagtttatagtgtatatgtaatttgtggtgcaggattaatatctgtaatcttaggattttcaggtaagatgtcagctcttataaccacaattcctacaccagttattgggggagtaagcttcctattatttggtacaatagcagtatcaggattaagaacttttatagaagaaaaagttgattttgctaaatcaagaaatttaattcttgcatcagttatatttattgtaggtctaagtggaattaagcttacaataggtgcatttgaaattaaaggtatgggattagctacacttgtagcaatagtgttgagcattagctttattatatttgataaacttggcattatgaatgaaaaagaataaacttttataaagataacagcattaagatgtgatatgaactgataatatatatttgatatgagagcagttcaattctcttaatgctgtttatttgttatatatgttattattagttttattattaaaatatatatgtagatgaaaactagaaagtaacttataatataatttactacttagtatataaaattaatgttgatagaaatgttaggtaagtaatacatttataaaaattaaaagtataaaaatatcatataagtacggaggagtatatgaataatataaatttacacggattaaaaggtagaatagttagaaaagaagattatgattatgatgaatgcagattatcatggaacagagctattgattcatatcccaaagtaattgtttactgctcaaataaagaagaagttgcaaataatataagatggtgcatagaaaatagtgtgcaatttagaataagaaatggtgctcataattatgagggatattcaactggcgatgatattatagttattgatttgagtagaatgaacaaaattaaccttgatgaggaaagtaatattgtaacaatagaaggtggagtacgcaacagagaagcatatgatttcttatgttcgaaaggatatccatttccaggtgggggatgtcctacggtaggaattgcaggtcttacacttggtggaggctggggatattcaagcagatttcttggtcttgcatgtgatagtttaatggaaatagaatttattgattataaaggcaatttaataactgctaatagtaatataaatgaagatttattctgggcaagcaaaggctgtggcggtggaaattttggggttgttgtatctatgacatttaagcttgcagcaaaagtggaaaatgttacattaattgatcttgaatataccaatctagcaactcataaccaggttactgtaataagaatgtatgagaagatgtttaataatcttgataacaaagctaattttaagatggcagtttataattctaataaaaaaggaagaggaataaaaataattggattatattatggtgaggaaaaagaagcaaaaaatatattaatgccctttataagtttaaaatacgataaaactctaaatttaacatatacgagtatattagaagctaatagaataatacaggatagtcatcctgattatgaaaaatataaatctacaggaaggttcatttataaagaatattcagaagaagaaatagaacaaatattaaatcttttgaatgattcagcaaatggaagtgtttatactgctataactttttatggacttggtggagctgtaaaagataaagacaaagatgagagcgcatttttctatagggatgcaaaatttataatgggatttcaaagtgtatttgaagatgataaatataaaagagaaaatatagagtggtttttagagaagtttaaatatattagaaacataacacaaggatcatttattaattttcctttaacagaacttgaaaattatcatcaagaatactatggaaataattatgaaaaattaaaacgtattaagtataaatatgatccatataataaatttaattttgaacagagtatataattgatatatattaatagttatttatagtttaatgagtttatattcaaaaatctaaataacttaatgtttctaaaaataaataaattttaaataacaagcagtttagtatttttgtaataagtaactaaactgcttgttgtttttagtacaattgattaaattatgatattagcatttcaaacaagaaattactttttcattttacaagatatggtttaataaatacttgacttaaagttaactcaaagtgctaacattaagtttatattatgaaaataattttaactaattattaaaatgtgagttattacaagtattaatgctttttaggataatcaatgattatatattattacaagcaagcgttagtatataaaattaaaaatcaaaaggagatggaagtattttgagtaaaaaagaggtaatgattttaacaggggctggacaaatcggtatggcaattgctagaagaatggggtatggaaaaaagatagttattggagatagaaatataaataatggacagaaaattagtgaaatcttaacgaatgctggatttgatgcagaatatgtaaaaattgatatatcatcaagagaatctattttaaagcttatttctaaatcaaaggaatatggtgatataacaatgcttgttaatgcagcaggagtatcaccaagtcaggcatcaatagaagatattttaaaagttgacttatatggaacagcagttttactagaagaagttggaaaagtaattgcaccagaaggtgttggagtaacaatttcaagtcaatctggacataggatgcagcaacttacagcagttgaggatgaacaacttgcaattactcctacagaagagttattaaatctttcaattttaaaacctgaaaatattaaggatactcttcatgcatatcagatggcaaaaagatgtaatgaaaagcgagttatggctgaagctgtaaagtggggagaaaaaggtgctcgtataaattctatttctccaggtattgttgttactccacttgctattgatgaatttaatggaccaagaggagagttttataagaacatgtttgcaaagtgtccagcaggacgtccgggaacagcagatgaagtagcaaatgttgcagagcttcttatgagcgataagggtgcatttattacaggttcagattttctaattgatggtggtgcgactgcatcttatttctatggatcattaaagcctaatagggatacaaatacaaaataaggatttctaaacttgtctttttacagactagtttacgtgatgaagttagtcatattctttatgcttcgtgagtaaatgttttagaagcataaggaacatgactttgaattatttgtacttattactttaaaaagaaagatttctaataatttaactggtcgataaatagagctaattcagtccgactggctaagtttagtttttcaaatatttttgttaaataattttttatagttccttccgtaagaaataattcattacagatgtctttattactttttccttgcccaacaagtatagcaacatccatttctctttttgtaagaagatttagtttttctttgttataattaattgccttatttggagaaagtttattaaattcttttataatctttgaggctacttcaggattaagcagtatatttcctgcacaagctgtttttatagctttacttatttcatcaaaaccggcgtcttttaatatatacccatcagcaccatttctaattccagtaaatatgtattcatcttcattaaaagtagttaatattattattttaatatgactaaatttttctttaattattttagttgcatctacaccattaattattggcattctaatatccataagaattacatcaggatatatatttttttttagaagttcaataagatcttgtccattatcaacttcaccaattactgttatttcattatctaaacttaaaatcatttttaaaccttcacgaactattttttgatcatctgctataataacgtttatcatattttatttcctttcactaatttcttataatttatcttgattttaaattctctattgagaaaatagataaaagaatttgaattataaacttatattggaatgaaaatatttatgcaaaagcctaaattagtattgctaatataattagttgttccacctaaagcctttattctattatcaattccaacaagtccatttgatttaacaatattattacatacaactccattattagtaatcaaaatttctaaattatcattacttcttaatatttcaatatcaatttttgttgcatttccatgcttaagaccattagttatagattcttgtatagtagtatacaatgaagctttaatagaattatccagatcatcgatagatttgtttatgtaatagttaatttttatatagttaaataaatgaaaattactaataagtttttttatggcatcagtgaaatcttgtatttcaggttcagatttcataagagtaactgtatttctgagctcagcaatacttgattgaactattgcttttgattgatgtagaactttttttagattaatatcatctttattagatattttttctgcaaactctaaatacatggttaatgccatgagtgagtgtcccaatgaatcatggagttgttgagatactcttgatcgttcttttaatattgtaattttttctatatttgcagcatattcgaatagcttggtattagctacagtcaattttttattaagctgttctaattcttctttttcaacttcaatttttttctgattatatagcataccagttataccacaatatgcaaaaaaattaattgttataaatattattgttgttctaatatcttggtgagtaggaattatagtagttattaaaaaatataaacttgcatgaatacccaaaaaaacttttagtatatttttattgaaattaaaaaaatcaaatataagacaataaatgagtgcaatagaatttacatgttttacataataataaattatcatagcactacatacatgaagaaacataagtatatattcatatttaacattacgtattaatttaaaattcataagatattcatggaaaaacataaaaatgcataaacagaataaagcaatcattagaagataatcattgcgatagtcaatatagatcaatacaaagagtgaaaacaataataagatttttaatcctaaaaaaatttttaattgagttttcatctgataataagcacctactttactataaatttctacatccattttatgattatattataacatttttcaaattataaattatattactaaagtcatatagattatataactaaggtaactattatctaaagaaaataatagatagaatttaaatagcatagaaaatgtaccttatatatatattaaaaattaattcataagtaggaggaagaaatgaaaaaagtaaggaaaatagtaatatatgccttagtagtagcttttttattagtaggaacttttatagtgaaatttatatcatcaaattctaagactgataatgttatggcatcagagaataagctttcagttgaagtgtataaggcagaattaaaagatagaatgtcaggagatacatataaatctactttagaagcttatgagcagggaataataagtagcaaaatatcagcaaaagttaccaaagtagtggttgaaaatggtcagtatgtaaatgaaggagatacaatagcagttttagatgatcaagacatacaaaacagtataaaaacagcaacagctcagttagaggtaaatgaaaagcaagttaattcagccgagcagcaacttaattcaacacagacttctcttgaaaagcttaagattaatgtagatgatgcacagcgtaattatgatagagaaaaggccctttttgatgcaggagcagtatcacaatcagagttggacgcttcagaaaaagctttaaatacttctaaagctgattacaattcaggacaagccaatatcgaaatatcaaaggcctctattgagagtgcaaaagctagtgtagaagctcagaaagtaaatatagagaaattacaaaatgatttaaataatgtagtcataaaggcacctataagtggtgtaataagtgagaaaaatgtaaatgtcgggcaaattatcaatcagggtgcagtactagccaaaattaatgatatatcatatgtatttgctacgattcaagtaccacaagagaaaataaatgatatagaagttggaaaaccagctgatgttactcttgaagataataatacggttcataatggaacattagacagcatagatttatcgggtgattctacattaagagtatttaattgtaaaatcaaaattgaaaatagtaataaagaattattaccaggggaatatgcaaaagtaaatttctctaatactgaaaataataataaagtaattactataccagtaagttctttagctggtagtgaaggagattactatgtttttataaatgataatggagtagcttctaaagtagctgttgatattggtgatgcagatgaaaataatgtagagataacatcaggagttaaggaaggtgatgaaataatatgtacaaacatgagctcacttaaagatggttgtaaaattgatgtgatttcaaattctgatgatacttcaatacaagatgctgataaaaatagtgaaagcatgacatcaaagtagggggcatggcagatgaaaatagcagatataagtataaaaagacctgtatttattatagttataatgattacactcactattttggggtttgtttcatataaatcactagcattaaatgacatgccagatgcagatttaccttatgtttcagtaatgataactgaaaatggtgcaacacctgaagaaattgaaacaaagataacaaaagaagtagaagatgcagttcaacagatttcaggagttcaaagtttaacttcaacaataaattcgggctattctcaaacaacaatagaatttgaccttgggatagatccttcaactgcagctcaagaagttagagataaaatttctggaataagaggaaatcttccaacagacattaatgatccaattgtttcaaagtttgatatgtcagctagtgccattgtatcaatagctgtttatggtactgatgataatcagaaagcatctgactttgtagataatacgttgaaaaataaactatattcagtatctggagtaggatcaataaatgtatcaggtgaagatacaagagaaattcatataaaattagataatgataaaatgttaaaatatggtcttacagcaagtactgtattaaatagcattaaaactgataatacggatcaatcttcaggaaaagtcagtgatggaaataatgagatatccattactacaactagtaaaatacaaaaaatagaagatttcaaaaatatagtaatagaaaatgttaagggtacagaagtaagagtaaaagatgtagcaacagttgaagatggagttgaagaaagaactagtcaagcctattacaatggaaataaagcaattggtattgatgtagtaaaacaatctggttctaatactgttgaagtagccaaaggtgttaagaatgtagttgaagaagtaaagcattcattaccagagggattaagtattgatattgtctcagataattctcaatctattgaagatacagtagatgatgttatgaaaactatttatgaaggttgtattttagctgtaattattgtatttttatttttacatgaatgggaaagtacaattataagtgcattttctcttttaatttcagttataactacttttatatgcctaaagcttatgcattttactttaaacacaatgtcattaatgtccttgtcacttgcagttggtcttttaattgatgatgctatagttgtaatagaaaatattatacgacatctgcatatgggtaaaaggccttttgaagcagcaagggatgctacttcagaaattggttttgcagtaatagctacaacttcagcagttattgcagtatttttaccattagctatgataagtggaatgataggaaaatactttatagaattcgctttgacaattgtatttagtatggctgtttcattgtttgtatcatttacccttgttccaatgatggcttctaagatgctaaaaatatctgatgggagaaagagtacaattataggaagagcttttgttgtatttgataaaaagtttgaatatgtttcagaaaaatattcacatcttttaaaatttcttttaaataaacgagttattgtattaattgtatgtggagctatgttttttagcagtctattacttataaaatctttaggatttaatatgttaccaacaacagataaaggaattataaatgttaaggcagatttcgattctggaattactctagacaaagcaatagaaaaaactaaaaagattgaagaatgcattgataaatatccagaggtaaaatatatgtattcaacagtagaaaatagttcagcatcagtttcaattacccttgtagataaaaaagaacgtaaggatacctcaaaggtaattgcacagaaaataagtgatgatttaaaatcactatcgggaatggaagtatatgcatcagcatcatctatgggtggatttggttcttcaaaagatgtaacttataatattgttggagatgatagagaaaaagtaattgcatttgctcaaaagataaaagaagaaatggaaaatgatccacaggcagcagatgttggaattaatgcgaagacaggtattccagaagttaaaatggttgttgatcgtgataaagcagcagacttaggagttaaaagttcagatgtagcaagtactcttaatacatttttcaactattctactgtaagtaaatatgatggtggaaaagatagatatgatgttaaagtaatgcttaaggatgatcagcgtaagagtatagaagaccttaatggaatatatgtttcaggaacaaataacaaactgattccagtaaatcaggtaagtaaaaaagttattggaagaacatcttcatcattgcacagatataataagcaggcagaagtgtctctttcatgtaatgtaaaaggaaaagcagcggggactttccaaacagaatatttaaataaaataaaaagtgaactaccagatggagtttcactatctgttggaggaatgaatggtacaatgcagaaaagcttaagtagctttggattatgtgcacttttatcaattgtatttttatatttggtaatggcagcacaatttgaaagttttgtagagccaatggcagtgatgtttgctctcccacttgcaatgataggagcaataatagcattatttatatgcagaagtgaattaagtattatggctttgatagggattgtaatgcttatggggcttgttgctaaaaatggtatattacttattgatgctgcaaaagagagaatggaaaatggaatgaatagaaatgaagctttggtagaagctgggtttgtaagacttcgtccaattattatgacaactttagcaatgattttgggtatgctacctacagcagtagctacaggtgctggaactgaaatgcgtaaaccaatggcagaagctgtaattggaggactaatcacttcaactatacttactttatttgtagttccaattgcgtacacattacttgatggattgaaaagaagaattttaaagatgtttagtaaaaacttgagtcctaaagatattcataaggatttagaattacaggaagagttgaaaaaatgatattaaggacaatcttaaaattaggaaatgagaaataaaatattataaagttattttgataaatagccttttacatattatgtgaagggctattatcatatttaagtttataataatatggatgacaacttctattaaaatataatttttaataagtttgacatcaaactatttgtgctgtatgattagtttggcaaaaaactaatttattaacacatacaaaggagaaatatgatgaatgttttagaatcaatatattcacgtaagagtataagaaaatttaaagatgaaacagttcctaaagaagacatattaaaaatgctttcagcagctgcacaggcaccttcaccaaagcaccagcaaaattggaattttgttgtacttactaaccgtgaaataataaataaaatggctgagattgtaacagaaagccatgaaaaaataggtgatcttgcaaaaactgaaaaagagaaaaaaattcatatgagtgtattgaagtattatacgtgttttaaaaatgcaccagtagtaataatggtatatgggtctgaatataagatgatagagtataagatacttaaagaaaataatgtatctcaagatatactggacatgctagtatcgcctcaatcagctgcacaaggaataggtgcttctgttgaaaactttatgttagcagcaacagaaatgggatatggaacttgctatatgactggaccaactcatgctaaggataaaattgaaaaattaataggttttaataaacctgaatataatttaatgtctatgatcgccttaggagttgcccaagatgaaactccagctaaacctcctcgtaaaccaattgaagatatagtaacatttatagaataaatgattagatgaaataaaaatgtctcagaaatgagacattttttatttttcagatctaaagttggaattaagctttttaagtaatcttagaaattcttctttttcttcttttgtaaaatctttataagctgtttcttttacttgatctgaaatatgattaaaagtactttcaatttctctagcttttggagttaaacttatatatgtaatacgcttatctataggagacttttctttttgtatatatcctaaatctataagtttatttattaatggagtaactgtcgatttatctttgccaattttttttgcaatttctttcattgtaagttttctatcactttcataaagagaagtcaaaacgttgccatgtgtgggaattaactcagttaggttattttctttcaatttattttcaataaattttatcatattagattttgttctgctaataaaataaataatatatttatcgttcattttaatctccaatctaaataaaagtataattgtatcaaaatctataatatcatatttagataaatttttttagttattatttataaatataaaattatgaactttatattatgaatattttagtagaataggaaattaatgcaacatttttttatctgaattgtattacatataggaagtaaaaataagaatattaagggaagtgtaaaagttatgaaaaaattaatgataggattattaacagttgtaacagttacaggaatgacagttcctacatttgcaggtgatatatatagtattgattctaatttggagcaaagattagtatcaactaacatgtctaatgaattaggcaataatgtgactataggtggtaaaaatataaatataggtaatcttaatattttagtaaacaaaggaaggattatggttccattaaaagctacagcaaaaagtttagggtttaaagtagctataaataaagataataaaagtgcaaatttagacaatgctgatattaaaacacaaattcaaataggaattgatttatattattatgaaagtagtaaagcaattggaatgacagcaccagaaaaattaggggcagaacctatattagttgataataatatatatgttccaataaaaatgtataatattcttcttaatgattctaatgcagtgggtagtttttgggcaaaaacaaatgatggacagtgggtttacgttgataagggagaacttgctataggctggaaattaatccataataaatggtattttatgaacagtaatggaatcatggaaaatggatggatacagacaaatggaaattggtattatctatatgataatggagaaatggcaattgatactatcacaccagatggatataaagtagatttaaatggaaagtgggactttggaaaaaaagtttcaattgatgagattaaaacaggaatatcaagtcctatagaagaatttaaaactatagaagaagctcagaatgttcttgattttaatgttacatttcctaaagagattccatcacaatatgatattgaatatataagcactatttcaaaagaactgtttcaaatttgttatactgatggaaaagatgaactgttatatagaatgggacaaggtgtaaataatataagtggagactataataattataagaataataatattgtagagatagatgataaaaagatcaaattaagtggaaatgatgattttataaaacttgcaacttggaatgtaaatgatatgtcatattctatatcatcaagtaatggaattagcaaggatgaaatgattaatataattaaaagtgtaaaataataaaacactactatgataatatatagctaataaagtgacttatttatataagatattataaaaagttataaagaggtgaaaagatgatttctatattaattaagaatcatcttttttagattgccctgagactttcgattgaatgttatcaattacatatttagcaaggtttaaaacagttcaatgaaaataaattaaaaattgtaaaaaatctattgcatcataaaaaaaaagtgatacaatgtaatagtcaataatgaaacaagaaataaaagtttctaaattagattacaagaaaataaaaatatttagcgtgttactgattcgatcaggcataagcttctggaaataaaatgtaatagaataatataatatttatttgttatatcacatgttttgcacaattttacaaggtattataatcttttttatgagttgatttagtgtacaggtgttgtgacgaaattcaaatatctatttctttattttattttatttcggaatgcttatgcttttttgtatttgtaacaaataaaaaaataggaggtataaaaatggtaggaattattcttgctagtcatggagaattcgcaaaaggcattttgcaatctggttcaatgatttttggagaacagcaaaatgtaaaagctgttacgttaatgccaagtgaaggacctgatgacttgaaagcaaaattgaaagacgcaattgcatcttttgacaatcaagacgaagtcttattcttagttgatctttggggcggtacaccattcaaccaagctaatgctctatttgaagaacataaagacaaatgggcaatcgtagctggtctgaatttaccaatgcttattgaagcttatggagcacgtctttcaatggaatctgcacatgaaattgcagggtatatcttaaattcagctaaagaaggagttaaggttaagccagaagaactagaaccagtagatactggtaagacttctactgcttctaatgctcaatctaatgcaggtgcacctggatcgtttgaatatgtgttagctcgtattgactctcgtttacttcatggtcaagtagcaactgcttggacaaaaactgtgcaacctacaagaattattgttgtgtcagatgcagtagcttacgataaacttcgtaagaatttaattcaacaagcagctcctccaggagtaaaagctcatgttgtaccagttgatcacatgattaaacttgcaaaagatgataagcactttggtggacaacgtgcaatgcttctttttgaaaatccacatgatgtacttagagcaatagagggtggagttcctctaaagacaataaatgttggttctatggctcactctatcggaaaggttcaacctaacaaggttcttgcatttgaccaaaaagatattgatacatttgcaaaaatcaagaaagccggaatcacttttgacgttcgtaaagtgccaaatgattcaaaagcaaatatggacgaaatcttaaagaaagcacaagaagaattaaataaacaaaaataatttaattatttgaaaaaaaggaggattataatcatgactttaaatatgcttcaaattatattagttattgctgtagcatttctagctggtatagaaggtattttggatgaattccaattccatcaaccattagttgcctgcacattgataggtttggttacaggtaatttagtaccatgtttaatattaggtggtacacttcaattaattgccttaggttgggcaaatataggtgcagcagtagcacctgatgcagcattagcatctgttgcatctgcaataattttagtacttagcggacaaggagaagcaggagtttcttcagcaatagctatagctattcctctagctgttgcaggattattattaacaattatttgccgtacaatagctacagcattcgtacatttcatggatgcagcagctaaagaaggaaatttaagagctattgaaatgtggcaagttgcagctatttgtttacaaggtatacgtatagcaattccagcaggaataattttaatagttggtgaaggtccaatatcttcattacttgcatctatgcctcaatggttaacaagtggtttagcaattggtggtggaatggttgtagctgttggttatgcaatggtaatcaacatgatggctacaaaagaagtttggccattctttgcaataggttttgtagtagcaactatttcacaagttacacttataggacttggagtaataggtgtagcattagctcttatttacttaacacttagcaagcaaggtggaacaggtaatggtggaagttcaaatacaggtgatcctctaggggacatcattgataggtactaagaaaggagaggaagaaacatggcaaaagatttaaaattaacaaaaaaagatcgtatttctgtttggttccgttcatttttccttcaaggttcttggaactatgaaagaatgcaaaacggtggttgggcatttgcaatgattcctgccatcaaaagattatataaaactaaagaggaaaaagccgcagcattaaaacgtcatttagagttttttaacactcatccatatgtagcttcaccagttcttggtgtaacattagcattagaagaagaacgtgcaaatggggcgccagtagaagatgcaacaattcaaggtgttaagattggtatgatgggacctttagcaggtatcggagatccagttttctggttcactgttagaccaatattaggagcattaggagcttcacttgctttaactggtaatattcttggaccaataatcttcttctttgcttggaatattattcgtatggcatttatgtggtatacacaagaatttggttataaagcaggttctcgtattagtgatgatttatcaggtggtatattacaagacgttacaaagggtgcatctattcttggtatgttcatcctaggagcattagttaatagatgggtatcagttagtttcaaaccagtagtatcatctgttaaattaagcgaaggtgcattcatagattggagtaaccttccagctggagcagaaggtattaagcaagctctaatgcaacaagcatcaggtatgtcattaactcctgaaaaagttacaacattacaaagcaacttagattcattaattcctggacttgcaggattattagttacattactttgtatgtggttacttaaaaagaaagtatctccaattgctattattcttggattattcgtagttggtattgtattccacttaattggtttaatgtaagatttttaatttagcctaggctgttagcctgggcttttgttaacatagattaactaaattaggcaaaaagttgttattgtacttaataaaataacttttgagatatgtattactttttaatcaactttttaacaattgatagaagtatataaaaaatatataataaaaataaatgtatgcataggtagaaaagaggtggattaaatggttcaatcacttaatacaaaagtagatcttgtaattgatgcaacagcttttactggattatcggattatggaaaaatcatgattggtgacaaaggatttgaattttataattctcgtgatcctcataaatttgtccaaattccttgggatgaggttgattatgtcatagcatctgtattgttaaagggtaagtggattccaagatatgcaatacaaacaaagaaaaatggtacttatacttttgcctctaaagacgcaaaaaaagtacttcgtgctattcgaaattatgttgattcagaacgtatggtttcttcattaagttttttagatgtggttaaacgaggagtaaaggctattattaagaagaagtaatctgatttttattaagtaaaaaattaaggaatttgctattgggtagtgagttccttttttatttgtaattttttctttattaaatagaaaaaaatgaatgttttataataataaaatttaaaatacttaatgaagggaattgtgcaaaatttctaagagtaattatataaagtaaaaatataataaaaattttaaatatccgtaagaaaaaagttaaaattaaaaatagatatttatgtaagatttaactatagaaaaattagggagttgaatcttatgaatataatattaaataagttatttgaaccaataaacttaaaaagtgtagttagaatctttttaataatactaatgtcaattggtttaatcagtggatttactataaatgcagcaatgtctaaagaaaaatctgatgaggtgcatggagagatagagaataatgatgatgtaaaaaactttatggataattactttaataaaaatatggaaaagtattctgtaccaggagcatcagttgttgtggttaaggataataaagaagtttttaagatgggatatggatatagtaatttagaatctaaaagtttagtaaatccagacgaaacaatgtttccagcaggttctgtaagcaagttatttacagcaacagctatcttgcagttatatgaagaaggaaaaattgatttggacacaaatgttaatgattatataaatccatataaaattagcaatatgtataatgaacctgttacttgcagaaatctattaacacattcaagtggacttgatgaagaaagtgaactaaatttatctactactgacgttaattcaataaaatcacaggaatattattttaataatcatcctcttaaggttattacagagccaaatactatttgtcgatattcgaatattggatataatattttaggctatatagtagaaaaagtttcaggtatcagctatgaagaatacgtagaagaaaaaatattaaagcctctaaatatgagcaatagcctagtgcgattaaaaaatagtgatattgctaagggatatatgtataacgatgataagtatagtgaattacctttttcatatcaatatacttcaggttcatcgggaataattacaacagttaaagatatggaaaattttattattgcaaatttaaatgatggaaagtttcaaaacaatagtattctaaaacctaaaacattgagtttaatgcatgaaaaacaattttctaattcagatgctttagaaggaatgggatttggattcattagaagctatagaaatggtcaggaaataataaaacatgaaggtggtctgccatcaggatacacaactacattatttctaattccaaaagaaaacttaggaatatatgttgcaactaattcattaagtggacttccatttgattttgaagaagagtttttaaattatttttatcctcatagtaataattttaatatagaaaaaattaatagtagtaaagattatagtaaatatgaaggaacatatagaagttatgatggaatatcaaaaactaatattatgaaaatggctgtattatttgatgatgatatggaaattaaagataataaggatggaacattaacattacatgaaacaacacaaagtaaggaaagaataactactaaacttatggaaatagaaaatggagtatttttaagggaagatggaaagggaaaatttacttttaaatttgataattatggaaaagtaacatatgcttttaatgatataagtattaattcatttgaaaagttaaaattttatgagcaaagcaaatttattattttatctataggaattatagctattacatttatcataaatataatgttatttgcattatcatttattaaaagaaaaaataaagtatataaaaattcagaaagaactaaaattatagaaattcttaaatatgccaatatatgtattgaaattttttatattataggagtgctaggagttattatttcaacattagagatgtgcttaaacagtgagtataatttaagctatttgctttactctcttttaactatgttaattatagctactataattgttattgttagtttagctttatcaatatattctttaataaagaaaaagggcattataagacaaagactctattatatgtttttaaatatgatgaatttagggtttatatggtttttgtgctatttcaattttctagggtataaattattttaaaatattatattaatttagttttatataataagagatgtactatttcattgtgcagtcaaatactgtaaaatattacgtgagattgaaaaaataggggatgataatatttttaatgtgctaattatagatgatgaagttgaaatagttgaacttatggaagtatatttagttaatgaaggttataaagtgtttaaagcatacaatggaaatgatggtattaatatagtaaataaagaaaagatcgatcttattgttttagacataatgatgccagggatagatggatttcaaatatgtatgaaaattagaaaagattataatataccaataattatgattagtgctaaaagtcaagatatggacaagatacaaggtttatcagttggtgcagatgactatatggtaaagccgtttaatcctatggaatttattgctagagttaaatctcaaataagaagatatgtatatttaaatgaaaaaaatgattcaaataatgatattgatactattaaagtcaaagagattacaataaataaaaagaatcacaaagtgtgtaaattagggagagaattaaaattaacaccaatagaatatgatattttattattactagcaaataatttaggtaatgtatttagcgctgaacaaatatttaaggaagtttggaaagaaaaatattttgaagggaataatactgttatggttcacatgtggagacttagggaaaaaattgaagaaaatccaaaagagcctgctataataaagacagtatggggagttgggtataagattgaatagtaaaagtataaagtataatataattatgaatctttttcttagtggaatacaaggttttttggttgccatagtgatatttatttcaagtttagggttattacatattctatctacaaaactttatgtaagttttgctaatatgtataacaatgacagagaagttgagataattttaatgttaattatttttcttatatttatattatcagcatgttttatatttataaaaaagatgaataagattacatgttatattgaggaaatttctgaaacattaaatttagtagcaacaggcaatatggatgcaactgtttctattaaaagaaatgatgaacttggagttttagcaagtaatgtaaataagatggcttataatataaatgaactaatgaaaaaagaaagggaatgggagaatcaaaagaataatttaattactaacttatcacatgatttaaggactccattaacttcgattcttggttttttagatttaatagaaaaaagtactaatgatgataaacaaataaatcattattgcaatattgcactagaaaaagctaaaaaattaaaatattctatagatcagctttttgaatttaccaaaataaataatgtagatttgaaattgaataaatatgaaataggagtagaagctttaatagaacaagtaactatgggatttataccagaatttgaagacaataatatggaatatagaataatatcgaaaagcaaaggattaaaaataaatgcagatccaattttactgggtagagcatttgaaaatataataagtaatagtattaagtatgctaatgaagggaaatatttaaacataattatagataaagaaagtgataacgctataattaagtttataaactatggagacgagataaagcaagaagatttagaaaatttatttaatagattttatagaatagaaaaatcgtgcaatagagaagaaggtactggactaggtttagcaattgtaaaaacattagttgaatgtcattctggagagataaatgttacgagttctaatgaagaaacagaatttgaaattaagataccaatttattaatatttattttacaaaaattaaagaaataggcagatatcaaattatattgatgtctgcctgtttaaatttattgttgctttataaatgataaaattataactgtagctataatacaagttgttcctataaattcataaaaggtaaatggtgcatttaaccaaatgacagataagaaagtagctgataatggctcaatacaaccaagtatacttgcttcagttggaacaagatattttaaactttccaaataacaataaaatgctataacagttccaaaaacaattataaatataagtgaaagtacagatgacaaagaccaagttccaacaaatttaaacggtgagtgtataaagctaaaaaataatccaccaataagcataccccatccaaccacagctgtagagctaaattgcttgagtagtgaaattggctgtaatgtgtatattgcagaacaaatagcagaggaaattccccaaaaaagcgctaatttagataagcttaatgaatgtatatttccccttgtaattataaaaaatgtacctaccatagctaaaattattgcaaacatttgttttaaagtaggcagctttttattctttacaattaaatagcatgtaattattacaggagataaatattgcaatatagtagcagtagcagcatttccatggctaatggctgcaaagtaagtatattgaacacctagcatacctaaaatactaaataagaaaagatttatgcgattattttttgacttccaaattatttttatatcattatcagaagatatatagccataaagtaatagaatagttccggatgataataatctaataacgacaagccattctggactaaatcctttgttttgaaataagaactgagccactgtgccagagataccccagagcatagttcctataataactaaaaaaattcctttagtgcgtaagtttaagttcatatgtatttcctccccttaacattgttgtaagatataattatcaatgttaatctgtaataattttattaataatttgaagagttggcaatgaatatattgatatgaattaaaattatattagcgaggaattgaaaaatacattatttaaatatctcatggaatctaaaattttaaaataaagtttaatttaaaattaaaaaacttcttatttataagaatatgtaagtaacattattataaataagaagtttttattatttaaattatcaataaaaagcatttaggtaaaaattataatttaaacattatatgaagataagtattcttttaaatttattactgatttagatatattgttttcagatatcgtcatagattcattgtttttagctaaatcatctatacttgaatttagaagactggaagttgtcagaatttcaccaatatctatagaattattactaatcatatttgataaagaagttgctgaatcattaatagttttaattttattaattaattcatttatgaaagcattttcttcgtttatataaaaattaatatcttcaaaagcatcacatgacatacttattaaatgtgaatgatcttttatattttcaacattttcttttgtcttatccatcatttcttttacagacatatcaacgttagttgtaatattggaaattgttttaacaaatgttgtagtaatatgagctagatttccgatttcttcagctactacagaaaagccttttccgtgttcaccagctctggctgcttcaatatttgcatttaaagacaataaagtagtctgcttggcaatattatctatagaagaaagtacactattaacttcaagtgtagaactatttacatctacaacaatatctttaagtgtatcaatagattctgaaatattattcattgcattttgaaggtcctgcatatcagaacatccattttgtgacatatctaaaattaaattaaatttatcagaagcatcagtattaattgatttagtatcagaaagtaaatttgataagttatttgataaagatacgatttgatttattgacttgatccaatcattcattgataagtttatattagatattgaacttatttgattttgacatatactatttaaaacatgggaattattaatattattttgtgattctaaagatatttcgttagagatattttttagatttaaaatcaaagttctcattgaacaacgatgataatctaaactttttgctatattagagagttcatcatttcctttaacttctattggtgttattaaatcacccatagataattgctttatagagctttctaaagaccttattggaagaattaaaaaaataattattcttcttactaagattatagtaaaaaatattagtagtattaaaaaagtaatatctagaaattttaatttattaatagaggatataatatttatgtttagactattatttgattgtagttctaaagctgatgaattaataaatatagtgtttattgtataaatgttaaatagaaagaagctgatcagagccaaaattaatggaataattgaggaatagataagcttggtttttaaagttgaaaatcctttagtcataatttaattcactattataaaaattaaaataaatataatagtgtaatttcactcctttatttgtatattttacataaagtatactataaacaaaaaaacatatcaataacaattgataatcaatatcgatataaataaaaatgataactaataacttgagatattgaaaattatttgcatttattcaaaccatgtgataaaatggtaacgaattaggagttaaaaaattccacaaggaggtttttaatatgccattaatgttagcagataaaaattgcgatttatgtatcaaaaaaattaaaggtaatgatgaaacaaagaaattccttaataatttagggttcattgttggtgaaatggttagtgttgtttctgaaatgggaggaagtgtaataataaaagttaaagatacacgagtggcacttaataaggaaatggctttacgcatagtcgtttaatataatactattattatataaggagatataggttatgaaaactttaaaagatgtaaaatgtggacaaagtgcaaaagtttttaggattcaaggtgaaggaccagtacgaagacgtattatggatatgggaataacgagaggatgtgaagtttttgtacgtaaagttgcaccattaggggatcctattgaggtaactgtaagaggttatgaattatcacttcgtaaagcagatgctgaaatgatagtgatggcataattttttttaaattattaatgataatgatattcaataatttatgaaaaatatgcttatttaaaaggtgttttcaaataatgaaaatactaattgagtaaaaaataagggggaagacaaatgtcaattaaaataggtcttgcaggtaatccaaactgtggtaagacaacaatgtttaatgagttaacagggtcaacacaatatgttggtaactggcctggtgttactgttgaaaagaaaggtggaaaattaaaaggtcataaagatgttgagattgtagaccttccaggagtatattctttatcaccatatacactagaagaagttgtaacacgtaattttatgattgatgataaaccagatgccataatcaatatagtagatgcatcgaatatagaaagaaatttatatttgacaacacagatacttgaactgggcataccaacagttgtagctctaaatatgattgatattgttgaaaaaaatggagataaaattgatttaaataaattatcaaagttattaggatgccctgttgttgaaacatcagcattaaaaggtaagggaataaaggaagcagcagctaaggcggtagagcttgctaaaagaaaagaaaaagtttattttgaagttccatactcaaaagaatgtaatgatgcaattttagaaattgaaggatttgcaaaaaataacatcaatcaagatggaattgagcctagatacattgctgtaaagttatttgaacgtgatgaaaaaataatagaaaaattaagattaaataaagatagcttaaatacattagaaaagataattaaaaattgtgaagatgctgttgaagatgatagcgaaagtataataacttcagatagatacgaatttattggcgatattgtttcaaagacagttaaaaaaggaagcacttcacatgaaacaacatcagataagattgataagatagtaacaaatagatttttagctcttcctatttttgcagctataatgtgggcagtatattatattgcagtaagctcagtgggaacaattattacagattggacaaacgatacattatttggtgaaataattgcaggtaatttaggtagtctgcttgaaagcttaaacgtagcagattggttgtatggacttataattgatggattagtaggaggaattggagctgtacttggattcgttcctcaaataatgcttttatttttacttctttcaattcttgaagactgtggatatatggcaagagttgcgtttattatggatagaatctttagaaagtttggtttgtctggtaagtcatttatacctatgcttataagttcaggatgcggagttccaggaattatggcaactcgtacaatggaaaatgacagagatagaaaaatgacaataatgcttacaacttttataccatgtggagctaaattgccaattattgctctatttgcaggtgctttatttggtggagcatcatgggttgctccttcagtgtatttcttaggaattgcaatgataattttatgtggaataatattaaagcaaacaaaattatttaaaggtgaaccagctccatttgttatggagttacctcaataccatattccaagtttaaaaaatgtattattccatatgtgggatagagcaaaagcctttataataaaagctggtacagtaatctttgtggcatgtggtgttatatggttcttaagttcatttgattttactctacaaatggttgatacaagtgaaagtatgttagcatctattggaaatgtctttgcaccaatatttgcaccacttggatttggtaactggcagagtgcagtagcctctataactggatttgtagctaaagaaaatgttgttggtacatttggggtattatttggaatagctgaagcagcagaagatgatccaactcttatgcaaaatgttgcaagcttattcacagtagcaagtgcgtatgcatttattgcatttaatatgcttaatgctccatgctttgcagctattggtgcaataagaagagaaatgggatcatggaagtggacatggatcactttagtattccagacagggacagcatatcttgtagctttagtaataaatcaagttggaagtttcattggaggatatggaagtttaactggagccattatatcagttatggtggtaatatgcgtaattgcagttgttctaattgcttcaagaacttcaaattcagaaaaagataaggggcaattaagttacagtagatagttttttacacaacttataaaataatttgaataaattaagtaaaattagatagaataaattaatgataacaaacctaataaaacataagtaattaaccaaagaatacccaaaagaagatttgattaaattattgaaaatctttatttgggtattcattatagctttaaagtaaagattatatttaaaataagaatgtttaatatatataatttgattatagatggggaggatgatagatatgtcaactataataataggaacattagttataggaagtatgatttatgttgctttcagacaaataaaaagtgctagaaaaggtgaaagttcttgtggatgtggctgtagtggatgctctaaatcgaagtcatgtcatgagataaaaatagaaaaataattatttaagtaatatagattaaatttattaaaagagcttttttaagctcttttaattttttactctcatatgttttataaatttaaaaagtaatataattatttccatgtgtgatttataagatattttttatttaaacctttacaaaaaaagtgttgacataaaaatggacgtgtcatataattaacttaaccgataaagtaaaccggttaaataggagaggtgaaagatatgagcaaggtttgtataattggaagtattaatatggacatgatagtttcagtagatgaaatgccacaagttggtgaaacaatcattagtgaaaacttcaagctagcacatggaggaaaaggtgctaatcaagcagttgcagcaaaaagaatgggtaatgaagttcatatgataagtaagattggtaaagatgcatatggatatgaaatattagaaagtttaaaaaacgaaaacatagatgtaagtaaagtttttcaagataaatgtaagccaacaggtacagctataattacagtaaataaagatgggaataattcaataattgttatacctggagctaacatggcgatagataaatatgagattgaatcatgtaaagatataataataaatagtgatattgtagtagcacaatttgaaacaacattagatgcaacaatagaagcatttaaaatagcaaaagaaaatgatgtaattacaattttaaacccagcaccagcaaataaaatacctgatgagttacttaaatatacggatattataattcctaatgaaactgaagcagcaacattaactggaattgaagtgactaatttagaagatgcagaaaaagcagcaaagtcatttttaagtaaaggtgttaaatactcaataataacattaggtgaaaagggagcagcattagtaagtaacgaaagatctgtaatagtaccagcttataaagtaaaggctgtagatacaacagcagcaggagattcatttattggagctttatcagcaaagttagataagaaaaatgtaaactttgatactttaatagaagcagttaaatttggaaacaaagtttcatcaatagtagttcaaaaagaaggggcacaaccttcaataccattcataaatgatatagaaaatatttagaagaaggagaaaataaatgaagaaaataggtattttaaacggtgagatttctgaaataatatgtaaaatgggacatacagatcttttagctataggtgattgtggtcttccaataccagatgaaactaggagaattgatttagccttagcaaaggatattccaacatttatagatacattaaaaacagtattaatagaatttgaagcagaagaaattatattagcagaagagataaaagaacaaaatcctaaaattttagaagaagtatatgaaatattcaaggaagttaagattacatttataactcatgaggaactaaaattaatgactaaagaatgtaaagctgtaataagaacgggagaacagactccgtatgcaaatataattcttaaatcaggagtgattttttaaggaggaagcgtaaatgaaaaataaagttccttttcttgaaatgaaaggtataacaaaaagtttcccaggcgtaaaagcacttgataatattaatttaagtgtttataggggggaggttcttgcacttatgggtgaaaatggtgcaggaaaatctactcttatgaaaattctaagcggagtatatattaaagacgaaggaaagattctcattgaaggatcagaagtagatattaagaacgtaaagaatgctgaaaaactaggcatatcaataatgcatcaggaattaagcgttctgcctaatttgacagttgctgaaaacgtattcttgggtaatgaacagtatgacaaagtaactaaaaaattaaatagaaaagctatgaatgaaaaatgtagagaacttttagcacagataggaagtactgtaaatcctgaagactatgtaagggacataagtattggtgatatgcagatgcttgaaatagttaaagctgtttctaaaaattctaatgttatagttatggatgaacctactacagcttcttacagatactgagacagaaaaattattcgaagttattgaaagacttaaaaagcaaaatattgcaataatttatatttcacatagacttgatgaaatatttgcaatttgtgacagaataaatgtattaagagatggaaagtatgtgggtgaagaaaacgtttgtgatataactaaagatgatttaataacaatgatggttggaagaaagatggaggatcagtatccatatgtaataccaaagaatataaagccattattaaaattgaaagatatctgcttagatggagtccttaagaatgttaatttagaagtcagagctggtgaaattcttgggattgcaggtcttatgggagcaggaagatcagaaacagcaaaagttattttcggtgaatatagaaaaacttcaggaacaatagaaattgaaggtaaagaagtagatataagatgtccaaaagatgcaattaacagtggaatagcatatttatctgaagatagaaaaaaagaagggcttatattacctctatcagttaaagataatatgacattagtatcattagatcagcttgaaaataaaactatgtgtattaataaatctagagaaaatgaaattgttgatgaatatataaagaaactatcaataaagacaccaacaagaaatcaacttataaaaaacttaagtggtggaaatcagcaaaaggttattatagcaaaatggctattacagtctccaaaggttcttattattgatgaacctacaaaaggaatcgatgttggagctaaaaaagaaatatatgatgtgttaaatgatttaaaagcaatgggaaaagcagttatcatgatttcatcagatatgccagaagtaatgggcatatcggacagagtagttgtaatgcatgaaggtgaaatatcaggtgaacttggaagaaacgaagtgagtcaggaaagaataatgaaattagcggttggagaacagaacgcttaaaaaggtagggagatggagaaatgactagtaaacttaaagagaacttatttaaaaataaatctatatttggattaattggattatgtatagttataagtataatatcacctagatttttatcagtagcaaatttgagaaatgtatttactcaaatttcagttaatgcagttatagcaatgggtatgacatttgtaattttaacaggtggtattgatttatcagttggttcaatagtagctatatcaggtgcgttatcagcagcattaataaaatcaacaggaagtatatggattggtttattatcagcagttctaattggtgcagttgtaggtttaattaatggtttagttatttcaaaaggaaagttgcaagcttttatagcaactttagcgactcaaacaatttttagaggaattacgtatgttttcacaggagggaatcctatatcaggattgacagatgagttaattatactagctaatagcagaattcttggaattccggtcttagttatagtaacaataatagtattaataatttgtgcatatttattaaatcaaactaagtatggaagatacatttatgcagtaggtggaaatgaagattcatctagactttctggtataaatgtagataaaattaagattcttgtatacgttatctcgggtatagcatcaggtatagcaggtgcaatagtgatgagtagaattggatcagcagctccaacagcaggaaatggatatgaattagatgcaattgctgcaatagtaatcggtggaactaatttaaatggtggagaaggttcaatctggggtacagtaattggtatcttaataataggtgttttaagtaatggtttaaatcttatggatgtatcagcattttatcaaacaatagtaaaagggttagtaatattatttgcagtattaattgataagaaaagagctaagtaatagcatattatttgataagatttgaaagatatttgataatctaataaaaaattaattaagtaacaagttcaatttctattacaaaatattatgaaaaataaatgaggataaggtggaggagatattatgaaaaaagtatttaaatttttatcagtagggttaattgcagggataatgacaggaacatttgcaggatgtggttcagctggaggcaatacaaataaaattggtatggttgtttctacattagataatccatttttcgtaaatttaaaagccggtgcagaagataaagctaaggaacttggatatgaattaatagttgtagactcacaaaatgattcatctaaagaattatcaaatgtagaagatttattacaaaagggcgtaagtgctttaattataaaccctgttgatagtgatgcagctaaaagctctgttattaaggctaacagtgaagaagttccagtaataacggttgatagacaggcaaatggaggagaagttaaaactcatatagcatctgataatattaaaggtggagaaatggcagcagaatatataaaagagaaacttggaggagcaggaattatagctgaacttcaaggtacaccaggtgcttctgcaacacgtgacagaggaacaggattccataatattgttgatgctgataacaatttaaatgtagtatcatctcaaccagcagattttgatagacaaaagggtcttactgtaacagaaaatatgattcaatctaatcacaacatacaagcaatattcgcacataatgatgaaatggctctaggcgcagttaaagcattaaattcaggggggcttaaagactgcatcgttgttggttttgatggtggagaagatgcaataaatgctgttgactctggtgaattatcagcaacaattgctcaacagccagatttaatgggtggtatggctgtagaatctgctaaaaagataaatgaaggcgaaagtgttgaaaaagaaataagtgcagaattaaaactatatactggaaaataatatttttacaaatataaaccaatataataagttaagaaagaggtattaaaaatgaaattttttttagatacagcaaatgttgaatatattaaagaagtaaatgaaatgggagtaatctgtggagtgacaacaaatccatctttagttgcaaaagaaggaagagactttaatgaagttattaaggaaataacaggaattgttgatggaccaattagtggtgaagtagtaagtgaagatgcacaaggaatgataaaagaaggaagagaaattgcagctattcataaaaatatgatagtaaaaattccaatgacagcagaaggtcttaaagctacaaaagttttatcaaaagaaggaataaaaacaaatgtaacattaatattctcagcaactcaagccttacttgcagcaaatgcaggagcaacttatgtaagtccattccttggaagagtagatgatatatcaatggtaggtatggatttagtaagtgatatcgcagagatatttgaaattcatggaatagaaacagaaataatagcagcaagtgtaagaaatccaattcatgtaattgatgctgcaaaagctggagcagatattgcaacaattccatatgaattagtaatgcaaatgttaaagcacccattaactgatcaagggttggataaattcaaagcagattgggaatcagcatttggaaaataataaataattagagataaacaattgtcaatgaaaataaagaatcattggcaattgtactttataagaaaagttaaaaaatagtaagtaaaataatgaataaatttgcaaaatgattaagattttaagtggaaaacatttgaattacagcagtaagtggaggatataaaaatgagtagagatttagatataaaatgtattaatgcaataagagttttatcggcagatgctatacaaaaagcaaattcgggtcatccaggattaccacttggatcagcttcaatggcatttactttatggtcaaaaatgaatcataatggaaaaaatccagagtgggataacagagatagattcattttgtcagcaggccatggttcaatgcttgaatattcattattacatttatttggatatggaataagtattgaagacataaagaatttcagacagacaggtagtttaacaccaggtcatccagagtatggccatacaaaaggtgttgaaataacaacaggaccacttggacaaggaatatgtaatgcagtaggtatggctattgcggaatcatatcttgcaaataagttcaataaagaaaaatatgatatagttaatcactatacgtattcaattgttggtgatggatgtcttatggaaggtatttcaggggaagcttcatcacttgcaggaacattaggacttggaaaattaatagttttatatgattcaaataatatttcaattgaaggaagtactgatattgcatttagagaagatgttgcgaaaagatatgaagcatataattggcaggtgataaaagttgaagatggaaatgatcttgatgctatttcaaatgctatcgaagaaggtaaaaaggaattaaaaagaccaacaattattatagttaagaatcaaattggttttggatgtcctgcaaaacaaggtaaagcttcagcacatggtgaaccactaggtgaagagaacataagagcaatgaaagaaaacttaggatggaagctagaaccagcattttatgtaccagatgaagtttatgaaaatatgaatgagtatatcaatgatggtatagaaaaagaaaataattggaatcagctatttaaaaactatgctgttgaatatccagaattagcaaaagagtatgctgaatggatgagtggtaaaattgataaaaatgcattagacagtgatgatttttgggctgtagatgaaaaacctatggcaacaagacagtcatcaggaaatgttataaataaattatcgaagataataccaaatttaattggaggttcggcggatttagcgccttcaaataagacacatatgaattgtagaggagatttttcagcagaagatagaagtggatcaaacatgcattttggagttagagaacatgcaatggctgcaattgtaaatggtatgagtgcccatggtggattaataacatattgtgcaacattctttgtatttagtgattatatgaagggtgcaatgagattatcttcacttatgaatcttccagtatcatatgtgttaacacatgatagtattggtgtaggggaagatggacctacacatcagcctatagaacaattggcagctcttagaagtatgccaaatatgactgtgttcagaccagcagattcaaaagaaactgtagcagcatggtattatgcagtaacaaatggacacacaccaacaagcttagtattaacaagacaaaatttacctgtatatgatggctgtccaaagagagctttaaagggtgggtatataattaaagactctaaaaaagaaacaccagatgtaattcttatagcatcaggttctgaagttgaattaatatataaggcagctgatgaacttttagaaaatggaatagaagcaagagttgtaagcatgccttcatttgagttatttgatgctcaggataaggaatataaggaaacagttcttccaaataaagtgcgagcaagaattgcagttgaagcattatcatcattcggatggcataaatatgtaggtttagatggtgaggtaatctcattagatacttttggagcatctggtaattcagaaacattatttaagaaatttggttttacttctaaaaatattgttgaaaaagcaatggaaatagtaaataattaatatagaaataataatagatagtttggtttaaaactatctattattgtatatatgttctaaaaatttaccatataaaaattattagttaaagtaatttttaatgaaatttataaataggacttatatattaaatgtaacattagagaagttagtacttaagaatgaggtagatgaatggcaaaaattactatgaaagacattgcagaaagagtaggggtatcaaaaacaactgtatcaatggttattaacaaaaaagatggaagtataagtgaagaaacaaaacagaaaatatatgatgttataaaagagactgggtatatacctaataatattgcaagaggtctaaacactatgaaatctggaactattgcaataattgtgccagatatatcaaatccatttttctcagaattatctagagctgttgaagatactgctaataaattgggatataatgtattattatgcaattcagataataatacaaaaaaagaacaaaaatatgtggaactattgataagtaagcttatagatggaaccatattaataccaggaaataagagtgaagatagtgcaagaatattaaaagctaatggtattccttttgtatttgtagataggtgtatcgatggatttgaaggatatccaggtatatacttcaataataaagaaggagtaaaagttggtatagaatatctatacaataagggaaaaagaaagatagcatttgtttctggtccagttgaaataaatattaataggcagagacttgaaggatataaaaagataatgaaacaatatgaaattttcaatgaaaatttaatttttgaaggtaaattttcattagaaggtggaatagatataactaataccattcttgatagtaatgaagaaattgacagcattttttactgtaatgatgtaatggctataggtggcatgaaagcccttaagagaaggggatacgatataccaaatgatatttctataatggggtttgatggaataaaattatctaaaatgatagagccagaattaacaactgttcagcagccaatatatgaaatgggagaaaaagcttgtaaattgataataaagcttattgattcagaatctaataaagataaaagtgtatattttgagcctgaaattgttgttggtggtacagtatagaagtaagaataattatagacataaaaaatgtaagtaggatgaactctgcttacattttttattatatctattatattactcatataaaactactgtatgagtatcaacacttttttttacatctattactctttgattagtactccccttatatttgagagttatatcttttaaattttcttcaaactttccatcgatgataacatcaataaatggaagtacttttgacttaagatcatctttaagaatttcttcaaatagataccctgtccaaagccatatacttttagttgcagcgaatgtctttctgtattcttgcaaaagtggaagtattccatcaacattgtcaaggggatctccccctaaaagtgacagaccagcaatatatttatttttgcttttttcaataatatatttctgtttttctaaagtaaaaggctctccatttttaaaattccaggtttcaggttgaaaacaacctttgcagtgatgagtacagccagaagtaaatagacttaatcttaatcctggaccatttgcaacatcattaaatttaatttttgaataatacatgttatttactccttatttaatattaaaaaaattagaataggcaaaaagtaagagttatttaaataataatttactcttactttatacctattactcaattagtattttgaattaaattttatagttgagttattttataagtgaagtactctttccttgatttctgctgtacgccctttactccagtaagatgagcctatatatccacaagttcttctcattacctgcatttcactttcatccctgttaccacaattagggcagtaccagtttaaattttcatcattttggatttctccagtatatccgcatttataacataaatctggctttgtattaatttcagcatattgcacattatgataaatgaagtttattattgatttaacagcatctaaattattacttaaattaggaacttctacgtaagatatacatccaccactacttatggcatggaattggctttcaaattcaagtttttcaaaggcatcaattggttctgtaacatgaacatggtagctattagtatagtacattttatcagttacattttcaatctttccatatcttgctgtatcaagtctacagaacctatatataagattttcagcaggagttccgtaaagaccgaagcctaagttatattcttttttccaattatcacattttttcttcatgaaattcattacttcaagggcaaatttttcaccttctttagtagtatggcttacaccgagcatagcataggtaagttcacatataccaacatatcctaaagataacgttgaataattattcttaagaagttcatcaattacttcacctttttttagtcttccaagtgcaccaaactgccagtgtataggacttacatcagattttgttccaagaagtagtttatgcctacacagtaatgcttctttacataattctaatctttcatttaatagtgaccagaataaatccatatctttgtttgctattataccaatttgaggtagattaaggcttataacaccttgattgaatcttccataccatttgtagtctccgttttcatctttataaggtgaaagatgagaacgacaacccattggagggaagttacatccttcataattttgacgcattatttttgcagattgataatcaggaacaagtctttttacattacattctgcacaaagttctgttatataatcatatttaccgccttctaagcaattatgctcatcaagtacataaataagtttagggaaagtttctccaatttcctgtcctctgtaatttttcattccttcaagacgttgctttatcatttcttcacatataagcgcttgttcacgttcaaattcatcaccttcgatgatttcaagatatacagttgcaaatggactttgtccgttagttgtctgaagtgttgaaagttgatatcttacagtctgtacaccacttttaagttcttccatcatcctttccgtagcaaggtcataagctaaatctttatcacacttttcaaggtactttttgtgatatttatcaaagcttactcttaaaaatggagctaagtgttttatagttatactttgaccaccatattgatttgacgaaacttgtgccatgatttgagtagccactgtacatgcagtactgaaactttttggtgtttcaacaagcttgtcattgattacagttccattttcaaacatatcttctaaattgataagacaacaattgtgtatgttttgtattgcataatccatatcatgataatgaagtatcccttcatcatgcgcttgaacaatatttgtaggcaataatttacgtctagctatatctttgcttacttctcctgcaattagatctctttgagttgcagcaatatttccatctttatttgaattttcttttaatacatcttcattagtactgtttaggagacttattatgccttcgtcagtggtatttttatgtcttttgaattcttgaacagctctgtagccttcataggcttttgcaacaccttcaaaaccatttttaactaattcgtaataaactaaattttcaacttgttcaactgttggtggtgtcttttcatttacgaagacattatatatatttatagatatttcatctgcaatattttcgtttatatttcctatgccaaacttcatagattttaaaatagcatttttaattttatcaggattaaaatcctctacacttttgtctcgtttaataataagcattattttttctccttaagtttaatagtattttatttatatacttatagaaagttaattgcatttcacaatataaaatcatatcataaattctaattaattgtcatgtattatattatatctaaattaaaaatatttttatatcctaaaagtataaaatagtaaaattatgtactataatgttgttaaataggaatatatgaacttaaaagtatattttagtaaaatatgatataataaattaataattaaaatattaattttaccaattacgtaaaattatagtgtgaaggagaatgttatgagttttaaagtattaggtataacagcaggaagaagagattcaaattcggaaattttattaaaagaagcacttttggcttgcaaagaaaaaagtgctgatgtaaagatgataaatcttaaagactataatatatttgattgtacaggctgtacagcatgtactcagggagtagttgaaggaaaaaaagtaccatgcatattagaaaataaggatgataaaaagaaaattatggatgtgatgcttgagacagatgcaattatagtttctattcctacatattatttaatgcctaatgctgcttttttaagatttatgcagagaaatttatgttatgagacaccttttttggaggcaattggagagacggttcataaagataaagtcgcaggattgatttcagtaggaggttctacacgtgcatggcaatctatgtcattagaagcacttcaagtaacatgtacattaaatgattataaggttattgatatgtatatggccacaagagttgcagcaccaaaacaatgtttgcttgatgattcaatgattgaaagagcacataaagttggtgagaatataatgaaatccttaaatacaccagcttctgaaagagaatggcttggagatgatgatatggggtggtgtccaaactgtcattctaatgctttgattttaggggaacctcaatgggatggaataaagtttgatgttgagtgtcaagtttgcggtgcaggaggaacactagaaaaaacaaatgaaggaaaatggaaatttattattgattcaaatggactaattcgtgatcgtaccactccagaaggaagaaggcatcatgttaaagaaattggtgtaacacagggcgggttttataatgaagaaaatttaaaaagtacaaaagaaaaatttgaaaaatatagtaatattactttcccaagtatttaaataaattattaaaattcaaataaaaagtattttaaatatatgattttgtaaaaagataactatatttaaaataaaattaaaacatgaaatggagaatagtaacagaagttctgattatgaatctgagagctaacttatatggaggaaaacatgatagatgatcacagtaatactaataaatatattggaaatgagttaaaagatttaatagataatattccatatacagtttggattaaaggtagtgatggcatatataaatatgtaaataaagcttatgcagatgtaacaggtgtaaaaccagaagatataattgggaagaatgactatgagattagagataaagagacatcagaattatttttagctgaagatagagaaattttatcagatgaaagaacagtattaaatagaaaaacacctgttaatatggaatataaggttttttttgaagtttcaaggatgataataaatagcaataatcctaatttaaagttaattgggggaattggaagagatataacaattaatgagacgctttataaggaaatagaaaaaagtacattaacattactagataataaaaatatagataataaaagtgaactgccctatattttaaaaaatacattaaaagccaatggaataacagtattaatacttgatgaagaaaagaaaaaaatgaatatctttttgaaaacatacgataatgatgtaattagtaaaaatttcagtttggatataacacaagaatataaggacaaatgtatagaagctcagaaagataaaaagtatttagaaggagaatatataataaattctaaaaaatattatttaagaacatatgtaatagagtttgaagatgaattaatcggtgtattaaatattcattatgattgcaaagaaacatttccaataattcaggaagatgtgattataaatacatgcaatagattgggagtaattataaaaaacagaatacttacaaataagtataaagtagaaatccacaaaagaaaagaaagtgaaaaaaagctacaactttttttagataatgcaatagatttttgcgttatatctaatactaagcaattttattttgaaaatgaaagtagcaaaaaacgtttagagaaatttttaggatatagtattgaagaaattaatagtaaaaatggcatagaaagtttacgacatcctgatgataagcaaaagattaaaagaatgtatgaagccgcaaaagtatgtaataaaatagaaggaattgtaataaggtatttgtgtaaagataatgaatatagaagcgtaatgtggaatataagatatattatggaagacaataaattttttcttacaggaaaagatataacttataggctaaaattagaaaaggaaaagaatgaattagaaaaaacaattgaaatagaaagtttaaaaacagatttttttgctaatatgtcccatgaatttaaaactccattaaatataatccttaccacagtacaagtattatatgataaacttattgtacaagataataacatagataatttacaaatgataaaaaagtatcttaaaggaattaaacagaattcttataggcttttaaaaatagtaaataatataatggatattactaaaattgatagtggaatttataatttggaactgggaaactataatataattagtatagttgaagacattgtgatttcattgtcaggttatttaaagcaaaacaaaagaaatattatctttgatacaatggaagaagaggttatattagcatgtgatccaatgaaaatagaacgtataatgcttaatttactttcaaatgcattaaagtatacaaatgaaaatggaaatattgatgtaataattgacattgataaggaaaagaatgaagttattgtaaacgtaaaaaatgatggagatagaatatctgaagacgataaagaaagaatatttgagagatttactcagtcacaaaatttatttacaagaaaagcagaaggaacaggcatagggttgtttttagtgaaacttcttgtagaacagcatggtggaagaatttatgtggatacatctgaagagataggtacaaaatttgtgtttacacttccaattacattagttgaagagaaaaaagaaaattatacatatacaaagcagatagtatcaaaagttgaaaaatatgatattgaattttcggatatttattccatataagtttttacaaagttaatatacattgtgattttggcaatcttataatgaaatataatatataaaattaataagacaatattacaatgcatatgtgaacttagttcacatatgcattgttttttataatataacacatataatttttaggattaaataatttataaaatgaaaatcaccatattttatagattttatcagtatttttatgacaaaatactgaatttgtataaataaatttttaatatcacaaagttattgacatatgtcaataactttgtgatataatataaatatacaaaattatgaaatgaaaaaatttttacgtctgaataaaaattagtatttaattttacaagtatgttgtttggaggtggatcaatgccgagacctaataaattcaggagagtctgcagaatgccaaaatgcagtgaatttgaatcacaaagctttaaaaataataatagaattgtattagacatagaagaatatgaagctataaggcttatggattatatgggacttacacaagaagaaagttcaaagcagatgaaggtttcaagagctacatttcaagctttatacatggatgcgaggaagaagatttctagatttttagttgaaggaacagggcttattatttctggtggcaattatgaattatgtagcagcaaatgctgtcagaataaaaatataaaaaaagaaaattgtatgttattgaaaggagataataatatgaaaattgcagtaacttataatgagggagaaatttttcaacattttgggcatagtgaaaaatttaagctatatgatgttgaagatggtaaaatagtatcaagtgaagttgttgatactaatggaagtggtcatggagcattagcaggattcttaaaagataaaaatgttaatgtattgatatgtggtggaataggaggtggtgcaaaaaatgcactagcttcaaataatatagaaatatatccaggtgctagaggaaatgcagatgagcaagtacagtcatttttaagtggaaacttatcgtataatccaaatacagagtgctcgcatcataagcatgaaggtgaacatacttgtggaagtcacggatgtggaagtcatgattctgatcacaaatgcagtcatgaataattgagaaaacaaattttaaataaatagatacgtgcattctatcagtggtagaatataaaaaatatatgaagttagtaaaagaacaacatcttatgtacttttactaactttatttttatgattaatttttaataaaacaatattcaataataaataaaaatatataatttaattgccattataataagattatgattaacttataagtagagggaaagtcagctttagaaaggggaagcctagaaaattgatggaagtaaatcacagtaagattaaagaaacaaatagaaaaaagattataaagttgttattagaaaaagatgagataacaaagttagatatatcaagaagtttggatataagtattactacagtttcaaccaatattacagagttaaaagaagaaggaattgtagaagatgtaaggccaatggaatctactggtggcagaaaagcaatggctataaaattgaaagagaattgtagttatgctttaggaattgcattaacgcccaaacatgtaaagttgctgttgataaatgtaaaaaacaaagaaattgagaaaataaaagtaagacacaataatgatggtataaatcatatagtaaacttagtaaaggaaaatatatcagacattctcaaaaatcataatatagatgcaaaacagttattaggaattgggatatcagtacctggaactgttgattcagataatggaattataaaaagatgttatcttcttaatgtgaataatgttaatcttaaagaaaaatttgagtatttaaatgtacctatatatatagaaaatgaagctaatttatcggcgtattatgaatatttaaataaaaaggatttagtagataaccttttatatgtatcaataactgatggtctaggacttggaataataattaatggaaatatatacaaaggaagcagtaattgtgcaggtgaaatgggacatatgaagataaaaataggaggcaaactatgtaaatgtggtgctaaaggttgcttcgaagcatatacgtctaaaaatgcgcttatagatgcttataatgaaagtggaaatagtataaatgaggttgaagaatttgaagatttgtataatataaatgacgaaactatcaaaaaggtattaactgaatatatagatatacttggagcaggaatttctaatttaactatgctctttgaccctaaaattattgttattggtggagaaatcaataatattttaataaatgaaatggataatcttaaaaatgttatatataaggataatttatttttagatgaaagtatatgtaaagttgaaataacaaagtttaaggaatcatatttattaggggcagcaaggtttgtaattgaagaatttttaagaataaaatagattacttagattctaattgctctaaatataaagcagatgaattaaaagatacaaattaacatataaggttaaagattattgatacataaaaagatcaatggttttattcattactatataagtgtagatgaaaatcatagaatatgatgtaaatatctacacttatttttgcgttatatcaaattatataatggaaactccaaagtcatcacataagaaaaagcttataagctatgagaaaaaatgagtacacagaaatttttaattttgataatgaaggagactatgtaaattatgaaagaaacttaaatatagaagatgcattatcatctttgaaagatactatgaataatattagatatagtatgagcaaaaacttttaaaattatattaaggatttaagaagagttctaagcagtattgataacggagaattgaatattgaaacggtctatcattgaaaatgcaaggttaaaattaaaatagaagtgagagtaaatatgaaaaatagtgagtacttagaacataatttaaagttgaaatttaatatggaaatagaacaattaattgatagagaaacgttaattttaacggttgaaaagggacagattattttgtgggaaggagaaagagcaaagagcttatatttcatcataaaaggaattgtaagaggttactacattgatgaaaaaggtgatgaaatcacaaaatgtttcagcatggaaaatgagttttgctctacagagggatttaggacaaagaaagaatcatcatttactattgaaaccttagaaagatctaatcttattaagataccatatgatgttatttataaaattatagaatcagatgaaaaaattaaaaattcagttaataatttatattttaaggaacttgaaaaagtagaaaatagggctaagaatcttatgttattaaatggggagaaacgctataaagaattttgcaaacaatattccaatttgcagaaaagagttgagttgcagtatattgcatcttatataggcgttaagccaggatcactcagtagaataagaaaaaaactaaaaattaatctgtgaattaacaaatgtgaattacaaagccagtctaatattttattgtatatataaaaggagtggcgatatatggaatatgtattaattacaggtggaacaagtggaatagggtatgaacttgtaaaaaagtttgcagctaataattatggtattgttatagtatcttctaatagattgagattagaaaatactaaaaaggaaattgaaagtaaatttggtatcccagtacttatttatgaggaagatttagggcagataggttcagcatgtgctatatatgataaaattcatgaggctaatattaatatatcagtattagtaaacaatgctggatttggattattaggttgttctgataaaatatcattagtagaagatgaaaaaatgatgattttaaatattatcagtgtagtagaactttgtaaattatttcttggtgatatgtataaacaaggtaaaggtaagatcttaaatatttcatcaacaggagcatttcagccaggaccatatacttcaacttattttgcaagcaaagaatttatattaagttatagtaaagctattagatatgaagctaagaaaaaaggagtgcaggtttgtatattatgtccaggtgcaactagaacaaatttttttataagggaaggtaaaaagactcctaaaagtgcaatgtctcctaaaaaagtagctgaatatggatataagagattgatgaagaataaagaaatatcaattccaggaaaacttaatagattaatgaggttattccctgaaaaaattaagatgaaatatgtagctaatatgaagaagtagaatgttatcatccatagaagagtgaaatgataaatctaaaataatgataatgttatttctgtttttttcaatagaatattttaataaatattacttaaaacttgttatataagtatattatgaatataatatacttatataagctagaacgtaatattgttttaggttcatgggctaaggggatagctaaaaaaagatagcagtatagatttatgtgttatttttgattatgtagataagagaaattcattgatgtatatgagtataaacaataaattagattatttagaaaaagaacagttttgtcaggagtatgtaaatggtaagagaaatagtaaaagacaatgatagattaacacaaaaagcagtagaagcgacaaaaaaggatttatatattattgatgatatgatagatactgcaaaggcaaatagagatatatgtgtgggacttgcatcaaatcagattggtgagaatgtgcgtattattgtagcattaatgggagaggagtttattcctctagtcaatccaaagataataacacatagtgtagctacttatgaagatgaagaagcatgtttatcacatgaaggaacaaagaaggcaacacgatattcttctattgaagtagaatatcgtgatagaaattttaaaaaaagaaagaatattttcaaaggatttgttgcacagattattcaacatgaaatggatcactgtgaaggaattttgatttagaagaaaattataagtatttgaaaaggcttttcccaacaatatgggaaaagcctttttagatatttaattaatggcatttagaattaaaaaaatacatcagattattaactaataaatattgaaagttgataaattgtaagcatattggaattttagcgtattatttacaaaatatctataaaattcagtgataaatgttataataatatttaagaattcttgaaaagtgtgagttttatttaagtgagaattgtaatagcagaatgattttatgtattactaatctagagaattttatatgctatattcttatagattatagaaaaaaatatatattataaattgatagagcattaaagaaaaaactaaatcaactgagatatggggaagagttatggaaagcataatattggaattaaaagatttaaaaaagaattttggatcaaaacaagtattaaaaggtgttaatttacaagttaagagaggagaaattattggatatataggatctaatggtgcaggaaaaagcacaacaataaaaattatccttggtacagtagatggatatgaaggggaggcgagaatttttggagaaaacattaaagatacaaaaggtgagtataaaagaacaataggatatgtgccagaagtatcagatttatatgaaagtcttaccgcaaaagagtatttgaattttattggagaattatacgatttagatgtagaaaattcaacgagaaaagctaaagaacttatgagtcagtttggaatagaaaattacttgaatactagaatttctgctttttcaaagggaatgaggcagaaactgatacttatttctgccattattcataatccagaaatattatttttagatgagccgttaagtggactagatgctaattctgttatgattgtaaaagagcttctggaaattttagcaaaggaagggaagactatcttttattcatcacatattatggatgttgttgaaaaaataagtcacagaatagttcttctcaatgatggaaaaatagtggctgatggaagctttaaagagcttaaggaaaattgtaatgaaggatctctagaagaaatatttaacgatataacaggatttaataatcataaagaaatagcacaagaaatttcaaggataattaaataggtgcatgtatggaagaatataaattattaaaatttttagataaatttaagggtctgtacactaagcttggcgtagattatgaaaagatgagaataatattaaagattaaactaacttttgatagaagaagaatatcaactattatgggaagctccaataaaaaggatgaagaaagtgaaaattcatttgtttatgcattaattatgtatgggataattggagcttttattggaataatcatactaagttcttctaatgcgatgttttcattttccatagcctttggtatgtttatgttttttgtattaacttcatttatatcagatttttcaaatgttcttttagatgtaagagataaaaatgtaataggaaccaaaggtgttaacaataaaacaatagcagcagctaaagtaacacatatatgttattacatttttcttatttcattagcactgtcatggctttcaataataggaatgtttagatttggcatattaacaggtatactttttctaggagaattaatagtagcagatatattgatgattgtaataacagcgcttatatatctttttatattaaggttttttaatggtgaaaaagttaaagatattattaattttgttcaaataggattaacaatagtaatgactataggttatcaatttttagggagaatgtttaatgtttttgatttaaagatagtctataaaagccgtatatggaatttactattaccaccaatgtggtttgcagcaccgttatatgcagttaatggaggggaaattgataaaataataattatgcttattacattagcatttattgttccaattatagcaattatattatatttaaaaaatatttctaaattcgaagattccttatcaaaattaaatagtgtaagaaataatgaaaaggaaaagagtaaaggagtattctataggtttggaaggtggacatgtaggaataatgaggaaaaggcagcttataatctttcagtttctgtaatgaaaagagaaagagagtttaaacttaaggcatatcctaatttaggttttattattatctttcctatattcttcatctttatattcacgaataattatgaagggataaagagtattcctttaagtatgtcattaaatatttattggtttatacttatgattccagcaattttaatgactcttcaatattcaaatgattataaagcagcatggatttatgaatctgtatttataaaagatacagctaatatatatagaggcgtttataaagctttgatagttaatttattattaccattatacttagttgaaagtgtaatttttacagtcatttttggtatacaagtactagggattttaattattgtatttatattcttattgatatttatagtggcccaacatctaattggaaaattaagattaccatttactacaaaagctggtgtggttgataatggaagtaatttactaaacacattactaggtatgattcttgttggtgttgcagcaacaataaattattttctactatctaatataattgcaatgatagtttatggcatagcccttgtgatagtagcactttttatgtggaggaaatgtattaaaatttatctgtaattatgacaagtataggaatagatgattgttaccatagaggatttgttttaaatattatttaacaggaaatggagcactatcaaagtgatataatttggaatgaaattataaatatttgacaaatttatattgaagtgatattttttatgtataggttatacaactgacggaagtggaataaaccacatgaagtataacaagtaataagccgaccgtctgggcaaaagtccggataggtgggctttttattttgtttaaaaaggagtgtaatattagcatgaaagaattaaaattaaagtatgggtgtaatccaaatcaaaaaccatctaaaatatttatgaaagatggtgaacttcctataacaataatcaatggaaatcctggatatattaatttgttagatgcattaaatggctggcagcttgtaaaagaattaaagaatgctactggacttccatcagcagcttcatttaagcatgttagtccttcaggagttggcgtagcagtaaaattaagtgaagtattaaaaaaagcgtattttattgatgatgtgggtttatctgacattgcaactgcttatttaagagcaagaggtgctgacagaatatcatcttatggagattttgtagctttatcagatgagtgtgatgagcagactgcaaaatttttatcaagggaagtttctgatggaataatagcaccatcatattcaaagggtgcattagagatgctaaaaaataaacgtaaaggcaaatatttaataatacaaatagatgaaaattatattccaaagcaaatggaagcaaaagaggtttatgggataacatttgaacaaaagcgaaatgatattaaaatatcagaagatttattaacagatttacctactaaaaataaaagtttacctgacactgcaaaaagagacttgattatatctttaatagcattaaaatatacacaatctaattctgtatgttatgtaaaagatggacaggcaatcggtattggggcaggacagcagtcgagaattcattgtacaaggcttgcaggcaataaggctgatgcatggtttctaagacaaagtcctaaggttataaatcttccatttaaacaaagattaaaaagagcagatagagataatgcaatagacatatatatttcagatgattatatggatatattatctgaaggggtatgggaatatatatttactgaaaagccaaatccatttactaaggaagaaaagagagaatgcttaaaaaatttgaaagatgtatccttaggatcagatgcattttttccatttggagataatatagaacgtgcaaaaaagagtggagtatcatatatagcacagcccggaggttcaatacgagatgataatgtaataaaaatatgcgataaatataatatagctatggcatttactaatgtacgtttatttcatcattaaattaagtaaataatttacggtaatgtataaaaattaaaaggagagaacaaatatgtatagtgaatatccaattatacgattaagagataggacagatttaaatgaaagagcatctaattggtttcataaaaaatggggcattccaaagaaagcttacttaagtagtatacaagagagtcaaaaccattgtgtaaatataccacaatggtatatagtattggataaaaatgaaattattgcaggaataggtgttatagaaaatgattttcataagcgtaaggatttatatcctaatatttgtgctgtatatgtagaagaagaatatagaaattatggaatagcaaaaagaatgttagattttgtatgcaatgatgtatttcatatgggatatgaccatgtttacctaataactgatcatactaatttttatgagaagtgtggttggaactttctttgtatggtagaagaaaatgatggacatatgatcagaatgtatcactttaaatgtgaacattaagtgtgttgggaaattataagtaaaatattggattgtactaaaactagtagtttaatattatttatattatggcatatatgtatatcggcgaactagttagggattagagacattagcaataagtttacaaaccatagagagataaactttctatggtttgtattatgaattaagttattgtatttaaaacaaaatagtattttgataattcctatataaatcaagctttccttgctttaagtgcaggaataaatgtacggaataggaataaagctagacatattgctgcaaaaattagtcctattggataggctattgatgttgatagatggaatccttcttcagcatatagtatataagtgcagcttacagcagacataaatgttgcaggaagtgctgcaattaatgatgaaataggcttgtttaacttagcatatttagcaagatatacagaaccagcccaaagtaccatcattgctaatgtctgatttgaccaagaaaaatacctccatacaacctggtaatcaacaagtgatattaaataaccaattccaagaagtgggacagctaaataaagcctgttaggaattttagtttgatcaattttaaaccaatctgcaattgtaagccttgcacttctgaaggcagtatctcctgaagtgatagggcatgcaattacaccaattatagcaagtacaccaccaacattacctagaagtcccattgacatatcatatactgttgtagaattaccaccatttgctgcaaataatccaccagttcctttataaaatgctattccagcagaagcccatataagagctataattccttcagcaaccattgcaccataaaatacatgtcttccatttttttcattttgaatacatcttgaaataataggtgattgtgtagcatggaatccagaaattgcaccacatgccactgtaataaacattaatggccagataggagatccttttggatgtagattttcaaaagtgatttccatcattggatttgttccactattataaatagttgcaccagcaatacctacagccataacaattagacatattccaaagataggataaagtctaccgattattttatctattggcaataatgtagcaagaaaataatagattaaaacaacgattgtccaaaatgtgatattcataaagttaggtgttagttttgcaagcagaccagcaggtccaaccatgaatacaacaccaaccataacaagaagaattacagagaatactctcattacatttttcattacattacctaagtaaagtcctacgatttcagatatacttgcaccatcatttctaactgaaagcattccacttagaaaatcatgtacaccaccagctagaattgtaccaaatacaatccataaatataccgaaggtccccatatagcacctgaaagagcaccaaatataggtccgagtccagctatattaagaagctgtacaaggaatgccctccatgttttcattggaacataatctacaccatctggatgggatattgctggtgtttctttgtcaaattcaggtccgaaaaccttttctacaaatttaccataaatgcagtatcctataactaataaagctaacgatacgaagaaactaatcattattattccccccttttagaatttagaaaacttataaatagcatcagatataaattgattcttcattaaattatatacaattagtttgtataatattaactaatatcaaatatatttgtataatttttattgtcatgattgtattagtataaaagaactgttgattttacgctgataagaaattttatagtgattaaagtaataataaataaaggaaggacacaaaatataaaaccatctattaaaatttattcaaaagcaattttaacagatggttttataagtcataaagttagtttctagctttacattcattaagataaaaagttgttattttatctaaagtaagattattttctatataagatttattccataatcctaattttttacgattttctgaggaattaattaaaagatttatatattcagttaatttatttattattaattcatcattaaatttctcaggattaaatgaatgatctccaaaatttgaatcaactaaggtttcaatattactattatcaacaatatttacatgtccatttgaaccaaaggaaataactggttttcctaaactcatagcttcaattgcaactcttccagttccaataattaaatcactttcaaagtagtaggataagatattaaatttattccctaagaaaaaaactttgttattatcattaaattctttatttatattttggcataaatttttaatagataatgcataatttccatttccagcaattatagcaaaaatatttttgttttttttgattacttttttaaagctttctaaaaataatagagctagttttgatttattgtaagataacctgctgcaatatatcaggattattgagttttcatcaatacccaatgctttttttaagaaactttttttactaataatatcattagatatttcaataccattaggaattacaagatatttgtgaatatatgatttttctaataattcactgtaatatttttttgaatactcacttacaaaaataatttcatcaagataattactataagattgtataattttttctgaataatatattccgtgaatagtaaatattataggaacatttaatattgatttaatcataggacacagatataagtctttatctatatgaatttgaataagctttatatttggaataattgaaagagtatttttaaatttataaatattttttaagtcaaaaatatatagaggaatatcataaaaaacaaataactctttattaaagcattcattagttaaaatgcataattgtatcttctcttttttcagtctattagctaaatttataacataactttccgtaccaccaatatttaaactatttaaaatagtaacaatagtagaatcatattcaatgcaataagttgataattttttttttgaagttattatttctttaaagtatgattgattatcaagaattttatttctattaaaaatagcaagtttattagtagtgagtggagattcgcaataatttagacattctttataaggaagccttgatttttggacataatatagaatttcagggactttacttattttttcaaaacgtaagaaataaagtataagatcaatttctgaatcgaaaatactatgagtacaataaggcaatatatcaatgagaaagctttttcttagcataaatgtatataaatctaatggaagataagatgctgatattacagagttaatgttatcagaatctataaacttattagattcaattaatgcttctttttcataaatattattattcatagaggcttctagacaagagcagatatttaaattatttgaattcataaaagaaatctgtttttcaaaccttttaggatcattaatatcacaattagctattaaagcaatgaaatctccagaaagtgatgaagaaaatgataataagaaattaaaaatagacgttctttcattgatttctattatctgatatttatcttttataatattgcttatattatttattttttcaaaagtaataatatatagttcccaattagtaaatgtttgttttgaaatgctcgttagagtgtcagaaagatcagtgttatcaagagcaattaaaaggatatttaatttagaagtcatttaattgtgcatcatacaatatcattgtagatacctgtgtgcatggactttgtgctgcatatgtgacctgaaaattctctataattctatagtcatcataattatttattactaatgggaagaaaattactttagttgaacatggagttatatagtattgattttgaaagactaaaatactttcgccatcagtaaggtcataaatatttatagtaacatagtcgcatactgtgttattagttatagttatttttaatatattataattttgattgttattaacaatttcatatttatattcttctagcatcttattatttcctccattaaaagtatatatttttctaaatcttgtacatagtcagtatatgaattttataaaatattgttaaataataaaacaaaaaatataagatctgcataatatagtatagacaagacatattaggaggaaaagtaatgcacgttgagaggataaaaaatttagtaagtattgttgtatcaaattataataatcaaaaatatattgaagaatgtttagactcattaataaatcaatcatatgaaaatattgaaataattattattgatgattgttcaacagacaatagtgtagatattattaattcatggataaataaaataaataattacaacaaagacaaaataacattcttaaaaatgcctaaaaatatgggcttttcaggagcagttacagttggtatgtatcttgcaaaaggagaatatattgctatccaagatggtgatgatatttcacataataagcgaatagaaactcaagtgaaatatttacaagataacaatgatattatgatggttggatctaattattctgtatttagaaattatatagaagaagcaaaaacagtgcctaattttgttgtttatggaaaaactaaaatagaagaagagtttggaaatggaaacagtcctgtgtcttttggaactatactttttaaaggagaagtatttgataaagtaggaggattaacaagaaaattagaaggtgcagaagattatgaatttatagcaaaatctcttatttatggtattaataatataaatgaacctttgtattactatagatcccataaagatcagagatcaaaacaatattattcaaaggaggcaaagaagaaggataaagtctataaagaaacattaagtgttatgttggttttagacaaatttaatattggaggaacagaaacgcatgttttaacattagcaaaacaattaataaacgaaggaataaaagtaacagtagtaggtggttatggtcctttagacaatgaatttagaaaattaaagtgtaaaatatataatttgaattttcctcttgaaatagaaagagatgaaaataaaaaaatcagttttttagatgatataaataatattatagaagcagaggatataaatttgatccatgcacatcagtcatcatctggaagtcttgcattagaggcaggtaaaaagctgggaattccatgcatatttactgttcatggtatgtattattatgatatattaaatagtgcattaaagcaggctgatactgtcataagcgtaagtattccagtatataaatggcttttaaaatatgatataaattctgtagtagttcctaatggaatttcatttaggaattatatgaatagtcagtctgattttttacgaagtatctatgatatggatcaagattcacttggcataatttattgcagtaggatggcatggggaaagatacaagtatgtaaaaatttgattacagttataagagatttgcgaaaaaaagataatataaaatatgatggaataataataggagatggaccagggtatttagagttaaagaagtttgcagatagtgttaacaatgaattgggacaagaagttattcattttactggaagtcaaattgatgtgaacaagttttatatggctggtgattgtgtattaggaacaggaagagttgcaatagaagcaatggcggcatttaaaaaagttattgcagctggtaattctggatattatggttttacaacaagtgaaaattttaaagaagcttggagcacttattttggtgatcatgattataagtttgataatgaccctaagtatttatatgaggacatgaaagagtactatctaaataaagaatactatgataaagatatatatgacctatatgataagagcagagttttatttgatatatttaaggtaacaagcgaattgatagatatatatattgatgcgtttaattaggaaatgaaaataaatgctaatttgatttttaaaatataaattccatttataataattattagttatatagattttactattcggagtactatttaaaaataaaaaattcagattggctttaggggctgtcacattaaatttagtgtgatagcccctttgctataaaagtacatataatacaaagcatgaatttatatagaattaatacttctatacttattaggagagtattcataatactttttaaagagtttactgaaataataagcatcagaataacctacagattgagcaataattttcacaggcatttctgttttaagaagtaaatctttagctttttgcagtcgtaaattgattaaataattaatcggagattcacctgttttttctttaaaggtttttgatatataaacagaacttatatacatattttttgaaatatcattaagagaaatattattcatataatttttttcaaagtaatctataataatttctactatgttacttttatcataaaaaggcagagaatactgtttaattttctttgtattttttacatagtttgtctcttttaaaaaaagagcaataagtttcataacaagactttttaaaactaattctttgccaatttcgccacattcatgttcttcaattatttcaaggcaacacttgtgaaagtcttcaccatattgattaaattgcattggtactgttgaagaattcttcaaaatatgatttaaaggaagaccatcaatttttaaatttctaaatccaacatggagttctttaagattgctattaatacctttggtaaagtactcgtaatggtaaactccagggttaaatggaagcagggttttttcttttattaaataaaatttatcatctattttgtaatttacatttccagaaacaacatagctgaattctataaaatcatgacagtgataatttccttcaaatgtatcactagtagtacaataaatagaatataacacttcaggattaaatttttcaattgaaattcctacgtcacacactaatggttccccctttcttctatataagaatatacatcatataaataaaaaagtacatttttatttaactttttttattagataattaacatgttaaaaaaatagagacgatgtagggaggaattattaatgagcagcattaaatgggtatttacatatgtaaataagtacaaatttagattttattcagcatttgtagcagcacttatctgttcacttatgtctatgattaatccatatttaagcggagtgattgtggatgatgtaataatgaagaataaatcggggattcttatttatatatttggaataatgatatttataacaggaataaaatcagttataagatatacatatcagatggtttttgaacatgtatcacaaaatgtaatatttgaaataagacagcagatgtatgaaaaacttcaggaacttgatttagattattataataggacaagaactggggacataatggcaaggatgactggagatatggatgctataagacattttattgcatgggttatgtataatatatttgaaaatgtaactatgtttgtatttgcaataggcactatgtttgtaataaattcacaatttacaatttttatgtttttacttacaccactagtagcatattgtgcatataaaatgacagtaaaatgtaatcctatattttacgatataagagaaagattttctaaattaaatactgttgtacaggaaaatataagtggaaacagagtggttaaagcttttgcaaaagaaaaatatgagatatcaaaatttgaagagcgaaataaggaatatatggactcaaatatggatcttgcaaaagtgatacaaaaatatatgccaatgttaaatgctctctcaaatatgttcagtgtaataatgattttagttggtggaatattaataataaatgaaaaattgaccatgggagaactggtgatttttaatggtcttatatgggcaataaacaatccagttaatatggtgggatggttaataaatgatgtgcagagatttctagcagcatcaaaaaagatgagaatgcttcttggggaacagactaaagttgcaaatcctaaaaatggaataaaaccaagcaaaattaagggtgaaattgaatttagaaatgtaaattttgagtatggtgatgaacaggtacttaaaaatgttaattttcatgtgaggcctggacaaagagttgcaatttttggtcagacaggctctggtaaatctactattattaatcttatagagagattttatgatgcacaatctggcgaagttcttattgatggagtagatataaaaaaatatgatcttcacgcattaagaagaaacatatcaatatctatgcaggatgtgttcttattttctaatactatagaggataatataagatatggaataccggatatagataattcaaaaatatcatgggcggcagaaatgtcagatgcagataattttataaataaacttgctgactcatatgaaaccatagttggagaaagaggggtaggattatcaggtggtcagaaacaaagaataacacttgctaggtccataataaaagatccatcaatattaattctggatgatacaacatcagcacttgatgttgaaactgaagcagcaattcaaaggaatctaaaatctatatataaaggaaagacaacatttattatagctcatagaatttcttcgataaaaaattcagatttaatattagttcttgataatggtgaaataattgaaagtggtacacatgaagaattgataaatgcacatggacattattatgatgtatacaaagaacaatatggtgagtatataaatgatggtgataaaaaaagggaggttatatagatggcaaaaaacaaatatgatgttgatgaatcattagacgaaaaactgaacttaggacattgtaaaagaattttatattatgtaaaaccatataaaaaagaaatgataattacacttatagtaatgcttttatcgagtgtagcaagtttaatgggaccttattttgtaaagattgctatggatgaaagtattcctaataaagatatgaatggacttatttttataagtatattatttgttgctacaattataataagttcagtatgtatgaaatataagataaaaacaatgacgttagttggacaatctatcataaaaaatataagatcagatttatttaatcatctgcaaaaacttccattttcatattatgatagcagacctcatgggaagatacttgtaagagttgttaattatgtgaattcattaagtgatttattatcaaatggattaattaatatgattactgatttatttagtatttttgtaataattggatttatgttatttataagtccaaaacttacattaatatgtctcattggaatgccagttttatgtttagtagtagccatgcttgcaaaagttcagagaataacaacacagaaatatagcaataagcaatcaaatttaaatgcttacattcaggaaagtataagtggaatgaaagtaactcaggcatttgcaagagaaaatgtcaatgcacaaaagtttagaacggtaagtggggaaaataaaagtacctggcttacagctgtaaaatatcagcttatgttatggcctgcaattgataatatttcagtttttactgtatcccttgtatatttagtgggtataaaatccattggagtagacatatcagtaggtacattagttgcttttgtagggtacatatggagattctggaaccctatagttaatatatcaaatttctataatacattaattatggcaatggcatatttagagagaatatttgaaactcttgatgaagaagtaagcataataaatttaagagatgcttatgaaatgccagaagttaaaggtgatgtagagtttaaagatgtagttttcaaatatgaggatgaagatagggaaatattgaagaatgtatcatttaaagtgaatgctggagagacgatagctttagtaggacctacaggagcaggaaaaactacaataataaatcttttaagcagattttacgatgtgacaaaaggcgaggttagaatagacgataatgatattagaaaagtaacacttaactctttaagggaacagatgggagtaatgcttcaagatacatttatattttcaggaactatattagacaatataagatatgggaatttaaatgcaactgaagatgagattgttaatgcagcaaaagctgtaagagctcatgaatttattatgaatttaaaagatggatataatactcaggtaaatgaaagaggaagcagattatcagtagggcagagacaacttatatcatttgcaagagcactacttgcagatcctaaaatattaattttagatgaagctacttcaagtatagatactcagacagaaaaagcacttcaggaagggttgaacaaattattaaatggaagaacatcatttgtaattgctcatagattatcaactataaaaaatgcagatagaataatggttataaacgatggaaagatagctgaaattggtactcatgatgaattagtgaaaaaacgtggtgaatactatgagctgtatagggcacagtatgagattatgaatgctgtttaattgtatataatattaaaatttattatattaggtaaaataccaatgccaaatgtgaactaagttcacatttggcaatttttataataaattataaaggttatttattcaaatgggagaattattaagttttttcatgaaaaagcagtaaatattgatggatgtacagatgtatttattaagtttaaagaagattaagagatatatttttaattgtatgaaaaatttatatgtatattaaaaaataaaaaatatgaaaaagtttacggaaacatattgactaattaaggaaatggcattagaataaacttattaaaatacatttaaaaagtatttttaaattaatttgatttataaaactctttaaaattatagaaaaggaaaggtgtggattatggaaataaaaaaagttaatgatttagaatttaaaaaatatggacaagtattaaaaaattataattgtgaagaaataattgaaaaaatgcagaaaatgccactacttcttgatgttatatatgagccttcagtaaaagaccttgaagaatcagaaatttttaaggaacttatggaaagagaatttggaggtcttccaatacagattggatactgtaatggaaataataatatgttaaatgcagttgaatatcatagatcatctgagataaatatagctgttacagatcttattttgcttttaggatggcaaccagatattaatgaggatcatacttacgatacttctaagatagaagcttttttagtaccagcaggtacaattatagaagttttcgcaacaactcttcattatgctccatgtaatgcagataataatggatttagatgtgtagttgtacttccaagagatacgaatatgccactagaacataatattgaaaagaatggcgaagatgcattattgtttgctaaaaataaatggcttattggacataaggatactgacttaggtaagcagggtgcttttataggtctttatggagataatatttccttaaaatagaaataatcaattataaataatttataaaaagataaaaatatttgcagcattaaaaattataagtatgaatcaaaattgctgaagaagcaatataattacaaaatgaatgtttggaggaattaaaaatgaataatataccacaagttaaattaggaattgttgcagtaagtagagattgctttccaatggaattatctacaaatagaagaaaggcagtagttaaagcttttgatggagaaatttttgaatgtgaaacaactgtggaaaacgaaattcatatgagaaaagctttagatgaagtaagacaagcaggagtaaatgcattagtagtttatcttggaaactttggacctgagacagcagaaacattacttgctaaggaatttggtggtcctgttatgtttgtatcagcagcagaagaagctggagataagttaatgaatgatcgtggagatgcttactgtggaatgctcaatgcaagttataacttagctcttagaaatattaaagcatacattcctgagtatccagtagggacagcagatgaagtagcagaaatgataaaggaatttgaaccagttgcaacagcattactaggacttaacaatttaaagattatctcatttggtccaagaccacaagatttccttgcatgtaatgcaccaataaaacaattatataatttaggtgttgaaatagaagaaaactcagaattagatttatttgcagcatttaatgatcataaagatgattcaagaattccatcagtagttgctgatatggaaaaagaattaggtgaaggaaataaaatgcctggtattttacctaaacttgctcaatatgaacttacattattagattggatggaagaacataagggttcaagagaatttatagtatttgcaaataaatgctggccttcattccaaacacaatttggatttgtaccatgttatgtaaacagtagattaactgcaaagggaattccagtatcatgtgaagttgatatatatggcgctttaagtgaatacattggaacttgcataagcaaagatgtagtcacacttcttgatatcaacaattctgtaccaaaggatatgtatgaagaagaaattaaaggaaaatttgattatactttaaaggatacattcatgggattccactgtgggaatacagcagcatgtaaattaacttgttgcacaatgaagaaccaaaagataatggcaagagctttagaaccaaatgtagaaccaaatattacaagaggaactcttgaaggcgatatagtacctggaaatattacattttttagattacaaagtaatgcagatgcagaacttacagcttacgtagcagaaggtgaagtattaccagttgcaacaagatcatttggtgctattggaatatttgcaataccagaaatgggaagattctatcgtcatgttttaatagaaggaagatatccacatcatggagcagttgcctttggacattttggaaaagctatttttaacttattcagatatttaggagtaaaagaaattggatttaatcagcctaagggaatgttatataagaccgaaaatccatatagataattcagacataaattactaaaataaagattataaactaaactggcatgggaaatagctgaggatagtttgattgactgattagtaatattcagagaagaatatgtatatataataagatgttgtaattttccctgtttatttgacaaggaaaattacaattactagtgtactaaaagttttataaattttttatattaaaaatacaattgaagtggaggctttgagtattaatatattgaaatatacttaagaagtctaatagaaaattctaatttatatattatagaatttatatcaacagaaagtactgtttctattttatgaaatctataaaagaatgtgcttctattaatatttaatgattcagcagttttgctcgcatttctgtttttttgtatatatgtagtgagtgtgttaaatagttcagagttgttacttttgtcataagaaatcaacttgtttaataaaggatgtacaagatttcttagttctaatttttcagagatacattttgaatcaaccatattaaaaagataaaaatcaatataatcctcaaagtatgcaagaatatcattattattaattttttcgcatatttttaaggcataaatggattgtagtacaaaatcatgaatattaattaaattatcaaatgataaacttatgccgcacttaagtttattaaggtttaaaaattctaaaaaactattcttaacgctgtctgtaagaacattaacagtatcagagcttactagaaatataatattattttcatagtaagcagataaacagtttttaaagatatttttacatgattgcataagctcttttaatccaaaattatatctataatctttatatttctgtacataaggtattgatagtactacataattctcttttagtaaaaatctgctgttcttaagcctctcttctatatattttatatcatcacagtcaattttattagatagaagatcaattaaataatattcatcgcaaagaccagagttagatataaaaaaatgttctttttgtgtaaatattgaaatagtttttgatagtatgtttactaattccaaatcagagtctttaaattttacttccctttccaaaacacatatataaccagtcgtcacattatttatttttatggaacagaaaataaggttatcgttatcataatgaaaaaatgctttattagaattgtagatgttatcaatgcatttatgttttttcataagatccacagcatcacatatcagatagtatttattattatgttcttcaatacttgaagtgacagaatacccagtagatgaacgacataaaatagaataactcgtatccactataaagattggattttttaagtgaatttctgctacatttaaaatttcatcaagagtatcagccgtaaataagctttcatatattgaacatttttttagtgaagatgagtaatcatttagtattatctcaggaacgaaatctccagaagtattaatattattattttttatgttttctaaaagttgttctaaagaactcaaattattttctccttaatattttttagttatttatctaaaaattgacttcattaaattagaaaaaagtctaaaatatcatgtagaaatactattattttaggattttattttgatgagagatgagtttatgaatgttaatattataacagttattaaaataaattaaaattgttttatgctcttttataaatttatggaggttatacaacagaatttattaaattacatataaagggagaaatgaaatatgtcttttacagtattaggtattacagcaggaagaaagaattcaaattcagaaattttactaaaagaagctttacttgcatgtcaaaatcaaggtgcagaagtaaagatgattaatttaagagattatcatattgaagaatgcacaggatgtacagcatgtactcatggaatgactagtggtaaaaatgtaggctgtacattaagtaagaaagatgacaagcaagcaataatggatgttatgttaaatgtagatgcagttattatttcagcaccaacatatgacttaatgccaacagcaacattctcaaaatttatgcatagaaatttagcatatgaatcatcattcttagaagctattggtgcggttgaacacagagatagagttgcaggtcttattgctgtaggtggctcgactcgttcatggcagtcaatggcacttgaaagtatgcaagctacatgttttacaaatgactttaaagtagtagatatgtacttagcaacaagagtacccgctccaaagcaatgtttattatatgatgacatgattgaaagagcttatgaaatgggagaaaatataataaagtctctaaagactccagtggaaaaaagagaatggcttggagatcctaatatgggatggtgtccaaattgtcattctaatgctttaatattaggtgaaccacaatgggatggtctgcattttccaattgagtgtcaagtttgtggagcaggtggaaatttagaaaagactgaagaaggtagatggaaatttgttattcaggaagatggattatgtcgtgaccgttttgatgttaagggaagacagcaccacggagaagaaataggacatactcagggtggattctacacagaagaaaaccttgcaactgttaaggcaaagtttgaaaaatataagaatttgacattttctacaattaaaattgaaaagtaatagataaaaaatatgtttatataggaaaagaaaaaagcaatgaatcacgcatataagattttgtgattcattgcttattattttatatcatttatgactttagacatagccaaagctaaactatcacctcgagcattattcctaataaatacaaatttcttttgattagtcgttatttttatcaattcttcatttttattagatgttacccaaaattctgttaattcttttaatggtattgtatataaatctcttgtttcttcagcatacccaattgcggcatggcctttatattctaaatacaaggtatcattagtcaatattaaccagactttattagctatatctccaccggctgaagttaaaaggttacctacaaaattgattaaaacatcttttttacttattgatttactagcattaattttcattaaaatatcatcatcatttaaatttacagaaaacatacaatacctcctaaatttataataataattattacatatattatacagcaaaatatattctatgtggactaaaagtattcatatagataaatataaaatatgggtaaagaaatattaaaattatacttaaaataactaatgaaattcttcaggctttcatttgagtcaaatctaaaggggactgttttagtctaataaaaattaaatatgctataataataaaaagataaaagacgtttatagatttattttaaataaagtagaagaacataagatgggggaacaataatgatgaacaaagaaataatattaaacaaaaaaatgagaaaaatgttaaagccaaaataaaatatcttgatgtcagttatatagataaaattattgaacttgaaaaaaatatatatgaaatgctcgaaaacaaggaattttattcttgctcttcaaaagaggagtatagcaatataatattaaaatatgggaagataatcgggtgtgttttggaagaaacagatgaactagtatgtataggagtttatgcttcatatggatataatgaacataattatgggtatgattttaatattgaaggagaagaacttttaaaggtaagtcagatagaatcaactattgtaagtcctaaatacaggggcaatggccttcagaatatcatatgtaatgcaatagaggagcttgcaaaggaaaatggagataaaatgattgcggctacagtggcaccagaaaatatatatagccttaatacatttataaaaagagagtataaaatcatggcagataaattaaagtatggtggactaagaagatatgttgttatgaaagaaatataatggttatatccttgtcactgcacatcttttgcggtgagagctgaaatgtataaaaggcttcctgtaagagaagtaggagtaggattagaattagagtggtaataatagatgaggtgtgtatataatgtgtatttatgagattaaaaataagaagtcaatagagaaattagctggaggatggaatgaaactttaatatggtcatatctccaaggatatatgggaactgcatatactaataatattgagacaatagaatctgtacaaattgtagtaggagatttttgcttttttttaggtgaacctaaagaggaaattgtaaatcataagccagaattttttaagtcagattttattattatggtcgctaaagatgaaggatggtttgagcttattgaaaaagtttattctgaaagagcagtaaaaagggaacgttatgcaattaaaaaagaaatagattcatttgataaagaaaaacttaaaatcatagcagagacacttgaaaagtcttatgaagttaaaatgatagatgaaaaaatttataatcagattatgaataataaatggtcaatggatttatgttctcagtttaaggattataaagattataagttacgtggaattggaactgcagttttaaaagatggagaaattgtctctggggcatcttcatatactgtatataatggagggattgaaatcgaaattgatacaagaagagatgagagacgtaaaggtcttgcatctgtatgtgctgcaaagcttatattagaatgtcttgatagaaatttatatccaagctgggatgcacaaaataaatggtcattggatctagcagaaaaacttggataccatttttttaaagcataccctgtttatgaggttaataattattagaaacaatgtcagcaatggcattgtttttttgaacatagaaataaatctactaagaaaatattgataatgattatcatttttgatataataaatttatcagaaaattcacagtgcaaggtatattgtgaaaattatgataaaaaacccatatagttaatgaaaaaatatagcaaagtatgctataaaattaggaggaattacaaatgaaagatcatttagaaattgtagacgttgttgcaagacaaattttagactcgagatgtttccctactgttgaagtagaaatatatttagaagatggaactatgggaagagcagcagtaccatcaggcgcatcaacaggaatttttgaagctgttgaattaagagatggagataaagattactaccaaggaaaaagcgtattaaatgcagttaagaatgttaatgaaactattgctgaagaattaattggatgcaatgtatttgatcagactgcaatagataagatgcttatagaattagatggaacaaataacaaaggaaaattaggcgcaaatgcaattcttggagtatctcttgctgttgcaaatgctgcggctaatgcattaaatatgcctttatacagatatattggaggtgttaatgcaaaagtattaccagttcctatgatgaacatattaaatggtggttcacatgctgacaattcagtagatttacaagaatttatgataatgccagcaggagctgactcatttagtaatgcattaagaatgtgtgcagaagtttatcatacattaaagaaattattaaatgacaagggatatgctacaggtataggtgatgaaggtggatttgcaccagatttaaagagtaacaaagaagctttagatgtaataattgaagctatcaaaaaagctgggtataagccaggtgaagaaatattcattgctattgatgccgcatcatctgaatactataaagatggaaaatacgttttagaacatgaaggaaagacatttacatcagcagaaatggttgatttctttgaagaatgggttaatgaatatccaattatatctattgaagatggtatggctgaagaggactgggaaggttggaagcttataactgaaagacttggaaagaaagttcagcttgtaggtgacgatttatttgttactaatactgaaagattagaaactggtattgaaaaaggagttgcaaactcaattcttatcaagttgaatcaaattggtacattaactgaaactttaaatgctatagaaatggctaatagagctggttatacagctgtagtttctcataggtctggtgaaacagaagatactacaattgctgatttagtagtagctgtaaatgctgggcaaatcaaaacaggagctcctgcaagatctgaaagagttgctaagtacaatcagttactaagaattgaacaagaacttgaaactgttgcagaatacagaggaaaaaaagcgttcttcaacataaaataattaataaaaactagaaaaacatatttctactaattcaaaggttacacttaattatcaaaattgggtgtagctttttttatagaattcatattgtgggataaggataacttaatacaattttagataataatcttattagatatattgacaaaatatgaataatattatatcatgtaaatgagaatgattttcagtatgccacgtacaacatattatataaagaaaaaacttccttgaagcgcacacaacaaagaagttaaaatttattatatgtataagagaaaatctctacttatttaaataatcacaactatatttaaataaaatctaacaatattattttgtggatatattgttaggaaaagaaatcttattgtatagtttcgcacacatttctatacaataagattttaattttattattaacaattgtcaagttaatataatccaatttcatagagtaattgatattttatgagtgctagcttatttttaaagattaggctggctttatattttagtttaaacatatagaaggaagtaaagtaaattcatagattgttatggtaaagaatataaaagtatataatatttacttgacaaattactggtagtgatataaaatatcaactgataatacaaatcaaaaaagtttagaattgttataaagttttttgaaatgagaattattaataattatttttatataagttatctaatattgattgttatataactatagtttgacccctatattgtatttaaaatattaaagataactaaataattagaatactaatcataatattatttgagtagttgcatttaataaaatgttagtaaaatcatttcataaaacatataattttatttaccaatgaagaaatatgaattttgctttcagctattaggtatgtagaggtaaaataatgagagattaagaggggatggcagttaattttataaaagaatgagactagcctaaagattattattatagtggtaaagcagattatctagataataacaggaataagtggtaatgagaatattccatgagagtgtttagataatataacaaagggaggaatttaatcatttcctccctttgttatattaaattttaatttatacaccaaccataactgaagttgctttgattatagcgtaaactgttttaccagtagataattcaagttctttaacagcatctatagaaactgttgaagatattttataatcttcacaagctatttttacaatggcattaactgcaccttcgttaatgctttcgatagttccttctaattgatttcttgcacttaatccagcaagcttttcgcatgcaaccatgacttcagtagctttaacgatagcataagcttcttttccaatttcaagttctaattctttaacagcatccatagaaattgtagctgaaatatctgcacttcctaaagtgatagttactattgaatttacgcttccttcctttatagatttaatagttcctttaaattgatttcttgcgctaattttcatattaatctcctccataagttaaataaaaaatttataatatataataaatagctataaaatatagcctaatattaactatttaaaaaacaaataagctttcttttggaaagtttagatgtattttttcatgtatcttaaaatataagttatttttaggcatgaaaaacgtgatttgagctgaattttctttattaacttgtcttgcataaattgttaaatcaaatggattttcaattatattttctataagaaataaatcagtatttaactctttcattgaattatccgatactggatttatataatgagctctaattccaacataagcaatatctttttcgcacgattgaacattaagttccatatgccagtcttctgcataaattttatcagaactgattcgtgttgcttttgaaatatttttacaacctgttattgttgcttctgtaagatttcctggtgtgtcaaatagctgatttcttgatctgactggaaaattcaatccgttttcaaatacaagtatattgtcacatattctataagcttcttcgatatcatgtgttacaaaaagtacatagccatcatatgagtttaaaattgattttaactccttttgcatgttcaatcttaagtgatgatcaagtgctgaaaaaggctcgtctaaaagcagaatgcgtggatttgttattaatgctcttgctaaagcaacacgttgttgttgcccaccagatagctgccaaggatattttttttcgagattattcaacttaaaacgttctatgtattctgaacataaagtattaatgtcattttttctcttattattctttattccaagttttatattatcaataatgttcatatgaggcataagagcataattttgaaaaacataaccaacatttctattttgaggtttaagaaatatattattttcagaatcataaagagtgcactcattggtttttataagaccactatgtggtttttcaagtcctgctatgcttttcaaagtcatacttttcccagagcctgatggaccaagtattccaagcatgccttttcccacagtgaaatcaactgaaatattaaaattaggaagttttttttcaaattggacttttaacatgttattttctccttcctaaaattttatcttgaattgatgaccaatagttcatgattaaaatcattgatagtgaaaatattattatgataattacccataacattgcttggctcatgttgcctccttcaacagcaaagaagatggcaagtggcattgtttgtgttttcccaggaatatttccagcaagcatcaatgtagcaccaaattcacccatagcacgtgcaaaagtaagtacaacaccgccaattatgccaggataggcaagtggaacggcaattttataaaaaatactaaactcatttaaccctaatgttctagctgcatttagtatattagagtcaacttgctcaaatgaagaacgtgttgacctgtacatcattggaaatgcaactacaattgcagaaatcacagttgcaggccatgaaaaaatcaaagttacatcaaagaagtttctgagaaagatgccaacaggaccgttttttccacaaagaattagtaggaaaaagccaactactgttggtggaagtattaatggaagtgtaattattccatcaataaatcctttaaatttattattactttttgcaattacataagcaattggaactccaataataaatgtaataactgtgcttaataaagatgtttttatagaaatccaaaatggagaaaaatctgtaatcatataatgtctcctccctataattaaaattttattaagctattgaataaccatatttttcaaagactgactttgcactatccgtatataaaaaatctacaaatgatttagcatcatctaagtgtgatgttgatttaacaacacctacaggatatgttattggagaatgtaaatcttcaggaatagtttcaattatttttgcagagttatttgattttgcatcacttaaatatacaaagcctacatcagcatttccagaagtagaccaggcaagaacttccttaacatcttttgcaaatactaattttgaagaaacactatcatatatgtttgagttttttagaacttcatctgcatattttccagcaggaacacttgaaggttctccaactgctattttacttactgaatcatttgtaagatcattaagtgatgttattgaagtatcagaaggaccaacaagaacaagtctgtttttaactaaatccttacatgtatcatccaccattaatgaaccatcttttaaagcattcatttgtgtttgtccggcagaaataaaaacatctgctggtgcaccttgttcaatttgctgttgcaaggaacctgatgaaccaaaattgaaagtcaatttaatgtttggatatttttcgctgaacaatgtttctatatcggccatagattcttttaaacttgcagctgctgaaattgtaagatccacttgttcctttgtttctgtcgtttttgtagatacattgttttcagcagttttttcagtgttaccacaccccataagtagtaaacaagaaatcattgataaaaggattgataatttttttttcatggatatttcccccttattaagtaatataattttaatattataaaaaataatatcatgaaaatgttaaataacgtcgataatggtaaaataattattaaaataaataaaataccaaatattacttaataaaataaagtaatattaaaatagtgctagaaattatagacgctatattaaaaaattaacttgctcataattatttttacaaaaaataaataattaaataataatttcctttattttttctgaaaaaattattatgatttaaattataaaatttaaattaattgtgtgaggtgggtgtaatatggaaaaaatatcattttttttaaaagagggcgaagaaataagttcatttcaaaatagcaaaaagatagctatttatgaaaagcagaacaagtggattaaaaaccaggaaataaaaataaatgtaggtcaatttaatacaatgcagtcattaagaaaatattttgttgatatagttaataaattagatgactgtaagattgtagtagtggataaggcacaaggaataccatatggagtattttatgaagctgactatagtatatgggaactttcaggtgagccagaagaatttctagatatgattgttgaaggtgaaaaaaaacatgatgtagaaacaaagaatagtgaaaatgaatctgtcgctaaaaaaattgaagagggatattttcttatagatttaaatgaacttcagttcacgaagccagaattaacatcaaaaaaagcgataattccttttctagaaaaagaagcatttgatgttctagaagtaatatgttgtcatataccaccatggcttatagaaaaggaaaagaaaaacgaaataactatggatgtatcaaagctaaaaaagaatgagtataagttgctaatatcaagggaaaggaggaacagtgaaataatggattattacttaaaggaatatggattgcttaaaagtgttactatagcagaaaaatatgcatctggtgaaattgaatcttttaaggtggaagaattaaataatatatatataaatggtgtagaatatgttccaagatatagcataaatgatgatagaaaaaaagaatttccatctataagattatataaaagcggaaaacttaaaactcttgatttagaaaatataattacaataaaaacagtagaacatattttttctgcagaaaagcttgttttttatgaaactggagagataaaaagaatatttcctttaaacgggaagatatcaggatattggtctgaagatgatgaatataatcttgcagaagcatatgactttaactttaaatttgcattttttaaatctaaagtaatatcaatacaactatttaaaaatggaaaagtgaaaagtataacattatggcctaaagacaagataagtataaattacaatagtgaaaagataaatgtaagaataggtatttcattatatgatgatggtaaccttaaaacttgtgaacctgcatgtccgacaaaaataaaaacaccaataggtgaaattgaagcttttgataaaaatgcttttggaattcatggcgaagataattcattaaagttttataatgatggaagcataaaggctttgactacctctacaaagataattaaaataatagataagaaaggaaatactacaattcattctccaaaggaggtttttcattattcaggaagtttggtaaaagatattattactgtaagtatagaatttaaggaaaataaagttattatagatggtacaagcgagtatctactttacgaaaataaatttattattgaacaatttggagaaaaaaaattaacgttaaaaggtgatttatgaaaacagacaaaaaacttttaagtcctcttgaagttgcggaaatactgtcaatatcaaaaaaaacagtatatgaaattataaaaagaaatgaattaaaagcattcaaggttggaaataagtttagaatagaccaatatgaggtagaaagatatatagggaaaaaagatgatagtcaaatagataatgatttgaaagaaaagcaatctagggaaacagttttagaagaaaaaaatattttaaataaaatatatagaaattatatagataataagattgttatatgtggccaggatgctattttagatattcttgcaaaatatatgaatagatataaagatgagggaaaagtattaagactatatgataatagttttaatggtttatgtgctctttataatgatgatgtacacgtgactgcaagtcatatttggaattgtgaccttgatgagtataatgcagattttgcatcaagggtattaattggaacaccaataacagttgtaactttgtgtcataggattcaggggttttatgtattaaaaggaaatccaaaaatgataacaggatgggcaagtcttgcaaaaagaaaagcaagaattataaatcgcgaacttggaagtggttcaagaatacttctagatcaaagtataagaaaatataatatagataaaaatatgattattggatatagtgattatgttaattctgctggggaagtagtaaatagaattagaatgggacaggctgatgttggaataggattaaaatgtgacattaattgtcctgaaaaagtagactttatacctttacatgaggaaagatatgatttgatttttaaatcagagaatcttgaaaagccgcagtttaaaaggcttttgaaaatattatccatgaatgaatttaaaaatgaatgcatatctataagaaattatgattattcagaaatgggtaatatagttaagaaatttcaaaaataaaaaagttaaaaaatgtatttacatcaaataaaaggtgtgatattattattttaacgtaacagaagagaacaaaacggaacgaaacggaactatgaagaataaaaaaatgaataaaaataagtgacaatggcgttaaaaattattatgtttttaacgctattttttatttattattaacaatgaagttgattatttgaaaaaatagtggcttttatttttatccatttttcataaaaattttaagattttatacgttaattgctcataataatgagaattatatattaattttttattttaaggaggaagattatatgagacaagttgcaatttatggaaaaggtggaataggaaaatcaacaacaactcaaaacttaacatcagcattggctgagatgggaaaacacattatgatagttggatgtgatcctaaagcagattcaacaagattagttcttggtggacttgcacaaaaaacagttcttgacacattaagagaggctggagaagatattgatcttgatgatatcatgaaaactggttatggaaatatcagatgcgttgaatcaggaggaccagaaccaggggttggatgtgcaggaagaggtattattacttcaataggtatgcttgaaagacttggtgcttatacaccagatttagattatgtattttatgatgtacttggtgatgttgtatgtggtggatttgcaatgccaataagagaaggtaaggcacaggagatttatattgttgcttcaggagaaatgatggctttatatgcagcaaacaacatttcaaaaggtattcaaaatatgcaaagacaggtggagttagacttggaggtatcatttgtaactcaagaaaggttgacagagaattagatttattaaaagcatttgcagaggaacttggaagtcagttaatacattttgtaccaagagacaatatggttcagagggcagaaatacacaaacagacagtaatagaatttgatccaaaagcagatcaagctgatgaatacagaacacttgcaagaaatatagatggaaatcaaatgttcgtaattccaaagcctatgaaacaagaaagacttgaagaaatattaatggaatatggtttaatggatatctaaatttaattaagaggaggggaagttatgtatttagtaagagctattataagaactgaaaaagttaatggagtattatctgagttagttgatgctggttttccacaagtaacaaagatggatgtctttggtagaggtaaacaaaaaggaatccaagttggtgaagtgcattatgatgaactgccaaaggaaatgctattaattgtagtaaaagatgaagataaagatgatgttgtaagagtaataatgaaaaattctcgtactggagaaggaacttatggggatggtaaaatattcatctcaaaagttgatacagcatacacaataagtactggaaaagaggaactataaaaagctttaggaggagtaaacaatgaaagagataatgggtattattcgtttgaataaagtaaatgtcacaaaagaagctcttactgaagctggatttccatctattacttgtagaaaggttttaggaagaggtaagaagtctttagatcaattaagtaaagaattaattgatgcacatttaggaacagcatctggattttctgaagctttttctgaagggacaagacttattgctaaaagattctttaatttaatagtaaaagatgaagaagttgaagaagcagtaaagataataatagaagcaaataagacaggtactccaggagatgggaaaatttttataattcctattgaagatgtttatagagtacgtgacggtcaaaatggagaagaggttgtttaataaagtgaggtgaggtaaatgagcaagatagatagcgttttagacaaatatagcgcaaaagtttataaaaatagaaaaaaacatgttcttgaacttgaacatgaaactcaagaaattgatgcaaacagaagatcagtgccaggattaattaaccatagaggatgctgttatgcaggatgtaaaggagttgttcttggtcctacaaaagatgcattaataattacacatggacctataggttgtggattttattcatggggaacaagaagaaataaagcgattgctgaagaaggttcaaatcaaaattatgtacaatattgtttttcaacggacttacaagaaagtgatatagtgttcggtggagaaaagaaattagatgcagcaatagaagaagctgtaaaaatatttaatccaaaaactatatggatatgttcaacttgtccagttggactaataggcgatgatcttcctgctgttgcaaaaagaaattctgagaagtttggtataacagttatggcatttccttgtgaaggatataaaggtgtatctcaatcagcagggcaccatatagcaaataatattataatccgtgatttgattggtactgtggattacaaaccaattaagcattccgtaaacatacttggcgagtataatataggcggtgatgcttgggaaatcaaaagaatcttaacattatgtggctatgaagtaatatcaacattcactggcgatggaagtgttgaacattatagaagagcccatactgctgatttgaatgttattcaatgtcatcgttcaattaattatatagcagaaatgatgaaaatacaatatggtactgcatggatgaaaggtgatttcatcggtttagataacactatcgaaaccttaagagaaatggctaaatttttcggtgatcctgtgttaactgaacagacagaaaaagtaatttcatcagagctttctaatataagtgatgatatgaatttttacaaagaaaaattagaaggaaaagttgctgctatatgtgttggtggttcaagaacacatcattatcaacttcttcttaaggattttggtgtaaaaacagttcttgcaggatatgaatttgcccatagagacgattatgaaggaagaaaagttattccagatatagttgaggatgcagatttaaagaatattgatgtattacatgttgataaagatccagaaaaatttaagatatatagaactgaggaagaaatagaagaacttaaaaaagagatagcagaattagaagattatgaaggtatggaagcagatatggataaaggatcagtaataattgatgactttaatcattatgaaactgaagagtttttaaaaatgttaaaacctgatattttcttctctggtattaaggataaatttgtattccaaaagcaaggaatattatcaagacagcttcattcatatgactatgcaggaccttatgctggttttaagggtgcagttaactttggaaaagatgtaacaatgggattatctactccagtatggaattatactgttgcaccttggaaaacacaatcagttttagaagggaaattaggaggtgaagagtaattatgatgctagatttaacacctaaagaaattacagagcgtaaaagcttaaaaataaatccaaataagacatgtcagccagttggagcaatgtatgctgcactaggtgtacataactgtatgcctcacagtcatggatctcaaggatgctgctcatatcatagaacattcttgacaagacattttaaagatccagcaatggcttcaacttcggcatttagtgaaggtgcttgtgtattcggtggttcatcaaatttaataactgcagctaaaaatgtctttgatatatataatccagatattatggctgtacacactacatgtttatcagaaactataggtgatgatattggttcaattattgagtcaatcgatatacctgaaggaaagtatatggttcaagctcatacaccaagttatgttggttcacatgtaacaggatttgcaaacatggttgctggttttatacgtgatctttcagaaaaatcaggaacaccaacaggaaagctttgtgttcttcctggttttgtaaatccaggtgatatgagagaaatgaagagaataatgagtagtatgaaagctccatttacaatgcttccagatacaacaggtgtacttgatgcacctatgactggaaaatttaatatcttccctaaaggaggaactttagttgaagatattattgcattaggtgatgctgaacttactctaggaattggaaagtttgcaagtgaagaacctgcaaatgttcttgaaaatatacacaaagttccacagaaaatattaacaatgccaattggtatatgttccacagatgattttataatggaacttgctaaattcactaagggagaagttccttatgaacttgaggaagaaagaggacagcttcttgatattatgattgattctcatccatattattcaggaaaaaaggtggcaataaatggagatcctgattttgtaatagcaatgactaaatttgcattagaacttggtatggttcctaaatacgtaataacaggaactcctgggaaagcatttgaagcaactattaataaactttttgaagaacataatgttgaaggatgtatatgtaaagctgaaagtgatttatttgaattacatcaattaattaaaaatgaaaaagtagatttattaattggaggaactcattcaaaatatatagcaagagctgaagatataccatttgtaagagcaggttttccaataatagatagatatgtgcattcatatatgcctttagtaggatacagaggtggcatgagactaattgaattaatacttaatgcattgatggacagaatggacagagatgctaaagacgaagattttgaattagttctataaaaagataaaaatttaagatattgagcagtgttgttatttaattttaatatataacctgctcaatattcttataatcaaagaagatttagagcatttattcaggcaggaggatatatggactttaaaatatgaaatgaatttcctgtcattttaaattttagaatccataattcaggaggtgtgtagagatatggaacaaataaaagaatatgatgatttattaaaagaaagagaagaatttatatgtaaaaagggaaaggaaaatggaaattttaagtgtgacagtgaaagtgtatctggagcagtaagccagagggcttgcgtttactgtggatcaagagttgttttgaatcctattacagatgcatatcatattgttcatggaccaattggatgtgccagctacacttgggatataagaggaagtctatcaagtggggatgaaatatatagaaacagtttttcaactgacttaagggagcaggatgttatctttggtggagaaaagaaacttgaaagagctcttgaaggtgttattaaagaacacaatccaaaggctatatttgtatattcaacatgtattgtaggagtaattggagatgatattaaggctgtatgtaagagtgcagaacagaaatataatttaccagtaataccagtaatggcaccaggattttcaggaaataaatctaaaggatacagaattgcatgtaatgctcttatgaatttattttcaagggaaaagcatccaaaatcaaaggggataaatattcttggggattttaatcttgctggtgaaatgtggataattgaaaattatttaagggaaattggcgttgatgttgttgctaaaataacaggtgatgcagatgtagattctttaaaaaaggcttcaagtgcaagttttaatgttgttcaatgtgctggttcaatgaattatcttgcaaaaatgatggaacaagatttttctataccatccataaaaatcagttttgtaggtcttgaagacacaaaaagttcattgatgagaatagctgcacttacaggagataatagcataattgaaaaagcaaaagagctaattgaacgagaagaagcacaagtaatgcctataattgaaaaatataagaaaaatctaagaggaaaaaaagcagccatatttgttggaggaggctttaaggcaatatccttaataaggcagttcaatgaacttggaattgaaactgtaatggttggtacacagactggaaaaccagaagactatgaagtaataaacggacttgttaaagaaggaacggtaatacttgatgatgcaagtgcatatgaacttgaaaaattcatgatagaaaaaggtgcagatatacttgttggaggtgtaaaagaacgtcctcttgcttataaacttggagttgcattttgtgatcataatcatgaaagaaaacatgcacttggaggatttcagggagcagtaaattttgcagaagaagttaatttgtcaataaacagtccagtttggaagtatgtataaaggaggatgatagtatgagtaaacaagattatgtagatttaaatgtaaatccatgcaaaatgtgcatgccaatgggtgttgcaaatgcaacttatgggattaagggatgtatgactatacttcacggttcacagggatgcagtacatatataagaagacatatggcaacccattataatgaaccaattgatattgcatcatcttctcttacagagcagggaacagtttatggcggagaaaaaaatttattaaaaggtcttgaaaatctaataaaattatataatccagaagtcataacaatagctactacatgtcttgctgaaacaattggtgaagatgttggaagaattgcaaagacatttatggaagaacatccagatgaaaaagtaaaattgataccagttgcagcgccaggatatggaggtacacaatatggaggatattttaatgcattaattgctatagtaagtaatattgaaatgaaaaaagaaaaaagtagcaaagtaaatgttgttacaggaccaatgagcccaagagatgcgagaaagttaaaggaaatacttaatgattttaatatagattatattttactaccagatatttcagaaaatttagacgatattcataaaaaaatatataacaggcttccagaacatgggacaagtattaatgaaataagtatgatggcaggagcaaaggcaactatagaacttagctcatttgttagtgaaaagagctcagtagggctttatttggaagaaaattatggcgtaaaaaacataagaataaatatgcctgttggattacgagacacggataaatttttggaagttttatcacaaatatcaggaaatgaaattcctgaaaaatatgtgaaagaaagaggaagatatttagatgctatgattgattctcataaatacaatgctgaaggaagggctgcaatttttggagaacctgattttgtgtattccacagcacgcatgatgcttgaaaatggagtaatgcctgtacttattgcaacaggagatgtatgcccagaacttaaagataaactttttgatgaagtgaaagaattatctgaagccttatttgtagataattttgagataatagacgatgctgatttcacagacatagaaagttatgcagtaagacttgatgcaaatatccttattggaagttctgatggacgaagaattgaagaaaataagaatataccactaataagattagcatttccaattcatgacagggttggaggtcagagaattttatcaataggttatgagggttcactaaatgtaagtgatagagttacaaacatgatacttgaaaggaagcatgatgtatttagaaagaaaacatatgatatgttttataaaggagatgtgaaaaatatgaaaaataaagatatatctgtagaaaatttaaaaagtaatattatatcaattgaagaaaaaacaaagacacatccatgttttagttgtgactctgctcataaatatgcaagaatgcatcttccaatagcaccaaaatgcaatgtgagttgtaattattgtcatagaaaatatgattgtgtaaatgaaagcagacctggagttacaacagaagtattaagtccagaacaagcctttgaaaaatataagtatgtgaaatcaaaaatgccaaatttaaaggtaataggaatagcaggacctggtgatgctcttgcaaattttgataatgtaagagaaacgttgaagcttatacgaaatgatgatccagaaattacattttgtctttcaacaaatggacttatgcttccattttatgcacaagaattaatagaccttggtgtatcacatgtaacaattactataaatgcagttaatccagaaatatcagcaaaagtatataagtatgtagactatcttggagttatatatagaggagaagaagctgcacagattttattgaataatcagctttcaggattaaaataccttacagacagaggaattgtagtgaaagtaaatatagtaatgcttaagggaataaatgatgagcatatttatgatattacaaaaaaggttaaagactttggtgctacaataactaatattatgcagatgattccagttaaggatagtgtatttgaaaacatgcctcttgtaagtcttaaagaaattaatgatatgagaaataaatgtggtgaaaatataaagcaaatgtatcattgcaagcaatgtagagctgatgctattggaactttaaatgatgatcagtccataaaaatttccttggaaatgaaagagaaaaaatctaatgaaaaaattatgaaatttgcagttgcaacaagaagtggaatgacagtggatatgcactttggacatgttagtgagttttatatatatgaatatagacatggtagtgcaatgttccttgagagaagaactattgaaaaatactgtaatggagaaagtgattgtggaaatgaaaataaaatagataaattaatatacacaatttctgattgtagtggagtgattactttaagaataggtgaggagcctaaaaagaaattaaaagagaaaaatattttagcatttgcaagctgtgaaagacttgaagatgcagtaataaaggcagcaaagattcttgaagggaaaaatgaagttgaagaaattcaaattctataatatgggtgataaaatgagaaataacgtgttagctactataaatggtaaagaaattacagagtttgatgtggaaaatataataagtcaatattcagaagcagatcagaagtctgtaaatactgataatggaagagaaaaaatattagatcagcttgtaagctgtgagcttatgtataattttgctcaggatgaaaaattagaggaaacagatgaatttaaggttagaattgaagaagcaagaaaagatatcttaactcaaatgggaatttcaaaagcagctggaaatgaatctataaatgaaaatgaggctttagattattataattcaaataaggaaaagtttatagtaggggaaatggtaagtgttaagcacatactagttgaatctcaagaagaggcatataatgtaaaaaatgaaatagaaaataaccaaatcagtttttcagatgcagcattaaaatactctatgtgcccttctaatatgaatggtggaagtcttggaacctttggaagagggaagctcacagcttcttttgaagaagctgcatttaatgcaaagataaatatattaacagatcctgtagaaacagaatttggtttccatataatacttgttgaagattttagagatgagtatataaaagaatttgatgatgttaaggaagaaataatgcttcatttaaagaaaaaacgtgaattaaaaaattataaagaaattattgaaaaaatgaagaaaaaatattataaagcaaatttggaggcgtttatgtgaaacttaaacagagaaaaatagaaataatagatactacactgattactttatgggaaaattacagatgtagttttaaaagaaacattaataaaattatggagcttataaaattagtttatattgcaggagcagattatatagaaattacagatgagttatatagatttatgttgaaattaccagaaaatgttgaatttatccttgattactataaaagtatagaaattaaaggtgtagatgaattaaaagaaaatattatgatttttgagaacaataagaaaatcaagcggttaagaattataggattggatgatcttatattaagtgactatgaggatatattatatgaagttattgaaaaattagaagatagagtggaattatctatcacagataaatataagtgttcgactggaatagctgtagaatggattcgacttggtggaaagaagattgtaacaagttttgctggaatagctggaaatacacctcttgaagaattacttggatctttgagatatattgagaatattaatataagaggggattttagagtatttaagaaaatttcaaaattatatgaagaaataacatgcactagtatacctcctacaaagccattaatagggactgatatatttaatgtagaatcaggaattcatgttaatggaattataaaaaattcaaagacttttgaaccatataatccagaggaagtaggaggagagagaaagattattataggaaagcattcaggaataaaatctttaaaaattaagcttgaagagctaaaaatagaatataattcagagtgccttgatgctattttaatagaagttagaaatcaaagtaatagtaagggaagaggattaaatgatgatgagataaaagcagcatgcaaaagaggggagagtttatgtgaaaagaaatgtgaatattgttgatacaacattaagagatggcgaacagagtgcaggaaaagcctttacaatagaacaaaaacttaaaattgcaaaatatctagatgataatggaatatatcagatagaatgtggaataccagcaatgggttgtttggaacaagaaataataaaggctataaaagcaaatacaaagaatgctttaatttctacttggaatagattaaatattgatgacattaaagcatcaattgattgcaagcctcacattattcacataagtgtaccagtatctgatttgcaaatatatgaaaatttaaatagggataaaaaatggattgaagaaaatcttataaggtgtatctattatataaaggagcatggatttgatgtgacagttggctttgaagatgcatcaagagctgatataaaatatattatagagcttagctgtttaattgaaaaactaggagtaaatagaattagatactcggatacagttggaatattatctttgcttaaaactaagaacgtagtaaatgaaattagaagaaattctaaccttcaagttgagatacatgcacataatgattttggaatggcacttggaatttcagtagaagcagtgaaaagtggagcagaatttgttgattgtactttagatggtataggagagcggacaggaaattgcagccttcaggaatttttaaaaataagcagaaactttgaatgtaattatgaaattaataatgataacgctattaaaaaaacacttatagatataattaaaaattaatatccaataattagtttttaattattatgttataaaaaagtaaaataattaatatttaaaaattatatataagaaaaagaatattatctttaaattgtaaaaaatagtagaatatttaaggataaagattgactagtcaactatatgaggatataataatgttgactagtcaattattatttggagatgataaacatagatatcgataaatttataatgtttaataacaaaatttttaggaatactcagggccatttagatagaaaattaaagaaatataatttaagcagcggtgcatacccatatttgatagtacttgcaaaaaatgaaggtataagtcagatacagataagtagagagattggaaacgatagagcaatgtctgcaaggactataaataagcttattgaaagtggatttatttataaagtacaggatgaaaaagacaatagggcgtataaactttatttgacatctaaagctaaagagatactaccactaatacatatagaaattcaaaagacaatacattgtataactgaagatcttacagaagatgaaaaagatataactatgagagtcttaaaaaacatctttgaaaaaactaaaaatttaaagaaaggggataatatttaatggatgataaaattaaaaagtggactatatttataataattatttcagcgacttttatgtctacattagacggaagcattgttaatgtagcactacctaaaatggcagaagcattaggagttacaacttcaaaaatacaattggtagtaacaagctatttagtcgttatttcagctgttattctaatatttggacgtcttggagatatgtttggtaaaactacagtttttaaaataggtctttcattatttactctaggatcatttctatgtggaataacaagctcatttaatatattaatattagcaagagtagtgcaagctataggagcggcaggaactatggctaataatcaggggatagttactgagatatttccagccaatgaaagagggaaagctcttggacttattggtacagctgttgcactaggttctcttgttggtcctggtcttggtggatttattgttggatcttttcattggaaatttatatttttaattaatgttccaataggtattattgcgttattttatgcatttaaacttcttcctacatctaatagaacaagtagtgaaaaaatcgatattgtaggtgcgttattatttatttttacaataattccactatttatgtctcttaatgaaggaataaatcttgggtttacatcacctatgattttattaggatttgctattgcagcaatatgttttatttcatttattatactagaaaagaaaataagctcaccacttattcagcttgatatttttaaaaataaattattttctataagtattttttgtggatttgtaagtttcgtggcaattttctgtcataatataatacttccattttaccttcaggatttgatgggatattcaccacagaaagcaggcatgattcttatggcgtatccattaattttaatggttgttgctccattaagtggaagtctatcggataaaataggttcagaacttttaacattttttggacttattgtaggaagtattggattatttttaatggcaacattaaatgataattctaaagttattgtaatggttatttttatagcagttatgtctgccggaatgggaatatttcaatcgcctaacaactcattgataatgtcaacagtacctaaaaataaacttggtattgcaggaagtattaatgcattagtaagaaatgttggaatgtcaacgggtatagctttagcaacaacacttttatatactcagatgagttctaaaataggatatagagttacagactttgtttctggaagaaatgatgtatttatatatggaatgaagtgggtttatattgtagctggtgctatatgtatgattggtgctgttttaactttttatagaatgtataaaaattcaaaagaaaaaaaggcattagatgaagagttatgtgatagtattaaatctggaaatggcgtgtattaattttcttaaaagtttctattaatataacgtatatttagaaaaagcactttataagatggagaataaaactatcttataaagtgcttttatgtataataaattaagcaatattgaagttatatatgagtattcaatgggtattatataaaatattctaatagttataaaattaaaaagagatctagatataaaaattatattttattagattgatacactataaaaccaattggtgtttttatcttatatattaatacagcttagactatgatatcattaaagaaaataggaatatctgtatatggtgaaggagtggtataaattaatgaataataattttaatttggataagcttatagatctggaaaaatgggaagatttacaagaaactattgcctctgttacaaatgtagcaataataattgttgactataaagggaatccagttaccaagcatagcggatgtcatagattttgtaaggaaataagagctaatccagaacttgtaaagtattgccaaaagtgtgactcaagaggaggccttgaagcagtgcgtttaaatgaaccatatatatatttatgtcattacaatataatagatatagctattccaataatgattgatgggaaatatattggagcgattatggcagggcaggtaaagttattagatgttaaagttgaaagttcattggaaaaaatattagtattatctaaagattcttcagcaaggaaagctttagatgattttaaagagtattactatgaattacctgtattatcctatgagaaaattaagaaaatttcagatatgttattttcgttgtgtaactatttaatagaagaagccttggaaaaaaacttaatttcagatatatatttgaagattgtcaatgatcagcaagaaatagattcaaatgtattaggtaattacacactaaaaaatatagagcatgttaaaaaagaaatgtccaatgctaaaataaatacttacatagatgaaaaaatattaaataatgaaaatcatattaaaataattgatactctaaagccagcaattgagtacatttataaacataagagtgaaacatttaacatagagactatggctaagctttgtcacattagtccaagctattttagcagattatttacaaaggaaatgggtgagaacttttcaagctatgtatctaaattaaagattgaatggtcaaaaaatttattagaagaaacaagtatgtccattaatgaaattagtgatgagcttggttttagtgaagtaggatattttataaaaatatttaaaaagtatgaaagggtgactccatcattatatagaaagtattgtaagagaaaatagtattaaaagctaattgaaaatgtatgatatattccttttgacacgcattgtaaacgatgttatacaatgaagatattataaaaataagatttctatttaatacaattatatactaaagctacgaggcaagtattattgattacataataaaatacaatttataaattttataacaaaaaattacggttttaaattataaattttcgtcattttaatacaatgagttttcttgtaaacgatattataatatagacaagtcaaaaatatttggatataaaggagatattgatatgagaaaagcatttatttgcccaactaaatatgtacaaggcgaagatgatattttaaacttgggatactttgttagaagttttggagaatcagctttattaatagcacacaaagatgatgttacacgtgtaaaggacaaattaaataaaacttgtgaaaagtttaaaattagttttgtagaaagtggatttaagggtgaatgttctagagaagaggtatgtagattacaacaaattgctagtgaaaataaatgttcatgcataattggtcttggtggggtaaggctattgatactgctaaatgtgttgctgaaggagaagctttaattatagttccaacaatagcggctacagatgcaccaacaagccattcagctgtactttatacaaatgaaggcgcatttgatgattatgcttatttcaaacaaagtccaagtgtagttttaattgatactacagtaattgcaaatgcaccaactcgtttcttggtttcaggaatgggagatgcactatcaacatactttgaagcaagagcaacttcaaattcatattctaatgtaaatgcaggattaccttgtggatttagagaaggtgtttgcaatgaagctaaaggaactaatacagcattagctcttgcaaaattatgctatgaaactcttataaatgatggagcaaaggcaaaagtggcttcagactgcaatatagttacaccagcattagaaaatattatagaagcaaatattcttttatctggtattggatttgaaagtggtggactagctggagcacatgcaattcatgatggattgactatattagaaggaactcataaatatttccatggtgaaaaagttgcatttggaacaatagcacaattagtattagaaaattcaccaaaagaagaattaaatcaagtattagacttctgtttagaagttggattacctgtttgtttagcagatattggagtggagagtattaatgaaaatgaacttatggaagtagctaaaaaagcatgtattaaggaagaatcgattcattctatgcctttcccaataagcgctgaagatgtagctgcatcaattattgcagctgataagataggtagagagtacaagctaaaaaaaggagggtgcaaataatgaaaaaattaataaataatccagaaggtgttttagaagatatgttagctggtcttacagctgcttaccctgaatatttaaaaaaattagataatgccaatgtaatagtgagagctaatagcaaaaaagataaagtatcagtaataagtggtggaggtagtggacatgaacctgcacatgctggatatgtaggatatgggatgttagatggggcagtatgtggtgaagtatttacatctccaactccagaccaagtatatgaagcaattaaagctactgataatggacaaggggttttagttgtaataaaaaattatactggtgatgttatgaactttgaaatggcaaagggaatggctgaagatgaaggcataaaagttgaagaagtaattgtaaatgatgatgttgctgtagaaaatagtttatatacagcaggaagaagaggaattgcgggtactgtttttgttcataaaatagctggagctaaagcggaaagtggtagcaatttagaagaagtaaagagagttgcggaaaagactattgaaaatgttagaagtatgggaatgtccttatcatcttgtatagtaccagcagcaggcaaagctaatttttgtttaggtgaagatgaaatagagattggaatgggaatacatggagagccaggtactcatagagaaaaaatttctacagcagatgaaataacagaacatttggtaaataaaatattagatgatatgacaataaaaaatggtgatgatgttgcagttttagtaaacggtttaggatcaacacccaatatggagttatatattgtaaataaaaaaattaataaaatgttgaaagataaaggaataaatattcataaaacttttattggagaatttatgacagctttagaaatggcaggatgttctatttctatattgaagcttgatgatgaattaaaagaactacttgattcaaaatctaatactccaggattcaaagtattttagacttatataagtaggaggatagatatggttaatggagaagaattaaagaatatttttaataaaataaatattgttatagaagaaaataaattatacttaagtgaattagatgcagctattggagacggggatcatggacttaatatgagtaaaggatttaaggccgtggtgaaaaaaataaatgacttagaagaagacgatttaggaaaaatattaaaagcctgtggtatggcattagttactaatgttggtggtgcttctggaccgctatatgggacagctttattaaatggatcaaaggcagttgctaagaaaaattgtataaatataaatgattttatagaaatactacaagcatctttagatggaatcaagatgataggaaaagctatggaaggtgaaaaaaccatgattgatgcactttcaccagcattagaagcaggcagaaaagctttaggtgaaaataagtcttcaaaagatatattaatagcaattagagatgcagcaaaagaaggaatggaaaatactaaaaatataattgccacaaaaggaagagcaagttatttagatgaaagaagtttaggacatcaagatgcaggtgcaacttctatgtatttaatactaaatacaatagcagaagaattcattagttgaggtgaaagtaaatggttggaattgtaatagtatcacatagtgatttggttgcgagaggtgttaaagaaattgcaggtcaaatggcaccagaggttaagattgaggcagcaggtggaaccagtgataatagaatagggactgctattaataaaattactgaggcaatagaaaaagtttatagcgaagatggagttatgatattttttgatttaggaagtgcttttatgaatacagaattagctatagaattcttagatgattcaatgaaggggaaaatagaaattatagatgctcctttagttgagggcgtagtaatagcagcggttgagtgtagtatgaataaaagtatagaagaagctaaaaaatcgctagagggaatgaaactaaataaaatttaggattatttaaataaaatataaattaaaaagaagcttttggtgtaggaataaaagtgttgagaataatgtttacagaaatttcagaggcaataaattattttctcgaaaaaacctagtgagaaagcaataaatgcctgtagatatttaatagatatgtacaggcattcatattttataagtaagtctaaaattttcttttaaattacataataaaaaaaaggatgattgtggtgatgaagaatgaacaacattattaatcttaaggatataataagcattgaagagttccaaagtattcaagatgatattgcaaaagctacagggatttctattataactactgattatacagggaaacctgttacaaagcatagttgttgtacagaattttgtagtattattcgacgagataaaaaacaatcagaattatgtgaaagatgtgattcaagaggtggaattgaatctacaagaactggaaagccatacatctatatatgtcataaagggttagtagattttgcagtacctattatagttcaagggcagtatatgggagatataatggaggacaaatacttataactgatgatgaacagaaatatttagaaagctttaaaaatactaattataatttggatgataatgaagaacttatatgtgcatataataaacttccaataatgtcactggaaaaaattaaaaatatagctcaaatgattttacacctatcaaaatatttagtagaagaaggtatgtataaaataactataaataagttaaaacaaagtaatgactcagctgttaaattagaaagtgagcaatttaagttacaaaataatttcgaaaaattaaaattaaaatctttatctgctcaaataagtcctaaatttatatttgatataatgaacaatgtgtattcacttgcattaatagaagaagcggaaaaaacaagtaatctaacttataaattaacagaatttataagagatacattttataaatccaataaagtagttacattaaaagaagaattagactattgtttagattatttaaatttgcagaagattaggtttaatgagaaattgaacttcagtgtaagtttaagtgttgaagaaaattttaagattccgtttatgagtatttttccttttgttgataatgctatagttcatggtgttatgaagaaagaagagggaggatgcgtaaatataattatagatagagaaaatgaatttataattatttcagttatcgatagcggaataggcatatcaaaggagaaattaaactttataaattctgaagaaaatagcatgaatcattcgttaagtggcatattagctgcaaaacaacgaataaaaaatttttataagtatgattattctgtagacatagtaagtgagttaaataaatcaacaaaaattacaataagcttaccacttgatgaaaggtaggaagtatttatgtgtgatgttattttagtagatgatgagagaatagagttagaagcacttaaaaaattaattaataaactaggtattaaagtaaatattgtaggtgagttacaaagtgcaaaagaagcaattgcaacccataaagattttaaggcagatgtaataatcatagataatgaaatgccagggattaatggaactgaacttgcaaaaataataaagagtaataataaagataaaattataatattgcttattgaatattataattttaacaatgaattggatatatcaaatattgatgattatatattaaaaccagtaagtttagaaaagttatttaaggtattaaacaaacatataataaatttagcaacaaacgaaaataaattaaaagaaatggaattattgctcttatccaaaataattttttatgaagaaaaagatattaaagatttacttaataatttgttgtatggatatgaattattaagcaatgatgacattaatagctacaaaaataaatgtacaagcctactaaataaaatgattaatatctttattaaaattaataaaaataaggcacatgcaaatctaaatatatatagtgataagttaaacaagattaataatatatgtaaaataaacattgtcatgaatgaatttttagattttatgagtaaagataatacagattatataattagggaaaaattaattggtaatagagaggtaaatattctattaaatcctgttttaatttatataagtgaaaattatagtgaaaaaataacattagaaagtgtctctaaagcttgtaatttaagtgttttttatcttagtaaattatttaaaaaaatacaggaatgaaatttattgattatataaatttatataaaatagaaaaagctaaacaactattagaaaatacagatatgtccataataaatatatctatgagtttgggatatgatgaatctggatatttttcaaaagtttttaagaaagtagtaggagtgacaccatcagcctacagaaataaaaatctaaataagccagaataaaagttatctaataatgataaaagtcattattagataactttttattttaaaataactactaataaaaagttcaaagaatattacagtagacatttgaaagaatgcaatgataaacaattgtattagttttaactttagataaaacaaacaaaaatgttattattagccaagaaaatactgttacataaaaaacgagaaaaacatagcaaaagagtaccaatattaagcaataaagtttgttaaaatattatcaataaaatgataagattagataaaccaagtaagaatgtgattggaggagtaaaaatgataagtaaaggatttagtacccaaacagaaagaataaatattttaaaggctcaaatattaaatgctaaaccatgtgttgaatcagaaagagcaatattaataacagaatcatttaaacaaacagaaggccagccagcaattttaagaagagcattggcattgaaacacatacttgaaaatatccctataacaattagagatcaagaacttatagtgggaagtttaactaaagaaccaaggtcttcacaagtatttcctgagttttctaataagtggttacaagatgaattggatagattaaataagagaactggagatgcattccaaatttcagaagaaagtaaagaaaaattaaaagatgtctttgagtattggaatggaaagacaacaagtgagttagcaacttcatatatgacagaggaaacaagagaggcagtaaattgtgatgtatttactgtaggaaactactattataatggcgtaggacatgtatctgtagattatggaaaagtattaagggttggatttaatgggattataaatgaggctaaggaacaattagaaaaaaacaggagtatagatcctgattttataaagaaagaaaaattcctaaatagtgttattatctcatgcgaagctgcaataacatatgtaaatagatatgctaaaaaggctaaagagattgcagataatacaagtgatgcaaaaagaaaagctgaattaaatgaaatagcaaaaatttgttcaaaagtttcaggagagggagctaaatctttctatgaagcatgtcaattattttggtttattcatgcaataataaatatagaatctaatggacattctatttctccagctagatttgatcaatacatgtatccatattatgaaaatgataaaaatataacagataagtttgctcaagaattaatagattgtatctggattaaattaaatgatattaataaagtaagagatgagatttcaactaaacattttggtggttacccaatgtatcaaaacttaattgttgggggtcaaaattcagaaggaaaagatgcaactaataaagtatcatatatggcattagaagcagctgtccatgtaaagttgcctcagccatctttgtcagtaagaatatggaataagactccagatgaatttttgcttagagcagcagaattaactagagaagggttaggacttcctgcttattataatgatgaagttattattccagcattagtttctagaggtcttacattagaagatgcaagagactacggaataattggatgtgttgaaccacaaaagccaggaaaaacagaaggatggcatgattcagcattctttaatcttgcaagaatagtagagttaactataaattctggatttgataaaaataaacagattggacctaaaactcaaaattttgaagaaatgaaatcctttgatgaattcatgaaagcttataaagctcaaatggagtattttgtaaaacatatgtgctgtgctgataattgcatagatattgcacatgcagaaagagctccattacctttcttgtcatcaatggttgataattgtatcggaaaaggaaagagccttcaagatggtggtgcagaatataacttcagtggaccacaaggtgttggagtagctaatattggagattcattagttgcagttaaaaaaattgtgtttgatgaaaataagattactccttcagaattaaagaaaacattaaataatgattttaaaaattcagaagaaatacaagccttactaaaaaatgctcctaagtttggaaatgatattgatgaagttgataatttagctagagagggtgcattagtatactgtagagaagttaataaatatacaaatccaagggaggaaattttcaaccaggattatatccatcttcaattaatgtatattttggaagcttaacaggtgctactccagatggaaggaaatccggacaaccattagctgatggggtttctccatcaagaggctgtgatgtatctggacctactgcagcttgtaactcagttagtaaattagatcattttatagcttcaaatggaactttatttaatcaaaaattccatccgtcagcattaaaaggtgataatggattaatgaatttatcatcattaataagaagttattttgatcaaaagggatttcatgttcaatttaatgtaatagataaaaaaatattacttgcagcacaaaaaaatcctgaaaaatatcaagatttaattgttagagttgcaggatatagtgcacagttcatttctttagataaatctattcaaaatgatattattgcaagaactgaacatgttatgtaaagacagcttttaaaggggataaaagtaatgagtaaggagataaaaggcgttttatttaacatacaaaaattttcgttacatgatgggcctggaataagaactatagtattttttaagggatgttcaatgtcgtgcttatggtgcagtaatccagaatcccaagatattaaacctcaagtaatgtttaataaaaatttatgtacaaaatgtggaagatgtaaatctcaatgtaaaagtgcagctattgatatgaattcagaatataggatagataaaagcaaatgtacagagtgtacaaaatgtgttgataattgcttaagcggggcacttgttattgaaggaaggaattacagtgttgaagacgttataaaggaattgaaaaaagatagtgttcaatatagaagatcaaacggtggaattacactatctggaggggaagtattacttcaaccagattttgcagtggagcttttaaaagagtgtaaatcatatggctggcacactgccattgaaacagcaatgtatgttaatagtgaatctgtaaaaaaagtaattccatatatagatctggctatgattgatataaaaagtatgaatgatgaaatccataggaaatttacaggagtgagtaacgaaataatattacaaaacattaaattaagtgatgaattagctaaagaaataataatcagaattcctgtaatagaaggatttaatgcagatttacaaagtataggagcaatagctcaattttcaaaatcattaacaaatcttaaaagaatagatcttcttccataccataattatggagaaaataagtatcaagcaattggaagagagtattctttgaaagaactaaaatcacctagtaaagacaaaatggaaagattaaaagctttagttgaaatcatgggaataccgtgcacaattggagctgagtaatagtagctttacatcagatattttaaaaacaattttaaattaaaaggagaagattgcatatgagaatgtatgattatttagtaccaagtgtaaactttatgggagcaaattcagtatcagtagtaggtgaaagatgcaaaatattaggtggaaaaaaagcattgatagttacagataagtttctaaaagatatggaaggtggagctgttgaattaacagttaaatatttaaaagaagctggattagatgttgtatattatgacggagttgaaccaaatccaaaagatgttaatgttatagaaggattaaaaatatttaaagaagaaaattgtgacatgatagtaactgtaggtggaggaagttcgcatgattgcggtaagggaataggaattgctgcaacacatgaaggagatctttatgattatgcaggaatagaaacacttgtcaatccattgccaccaatagtagctgtaaatactactgcaggaactgctagtgaattaactcgtcattgtgtattgactaatacaaaaaagaaaataaaatttgttatagttagctggagaaatttgcctctagtatctataaatgatccaatgcttatggtcaaaaaacctgcaggattaacagcagctacaggaatggatgctttaacacatgcaatagaagcatatgtatcaaaagatgcaaatccagtaacagatgcttcagcaatacaagctattaaattaatttcacaaaatttaagacaagctgtagctttaggagaaaatcttgaagcaagagaaaatatggcttatgcatcattactagcaggaatggcatttaataatgctaatttaggatatgtacatgcaatggctcatcaattagggggactgtatgatatggcacatggtgttgctaatgcaatgctattaccacatgttgaacgttataatatgctatcaaatcctaagaagtttgcagatatagcagaatttatgggagaaaatatatctggactttctgtaatggaagcagcagagaaagccataaatgcaatgttcaggctttcagaggatgttggaattccgaaaagtctaaaggagatgggagtgaaacaagaagattttgagcatatggcagaactagctcttttagatggaaatgcctttagcaatccaagaaaaggaaatgcaaaagatattataaatatttttaaggctgcttattaattaatactatttaaaggattcaaagtaaaagataaaagatatatatattagatttaagattttattataggctaacaacaaagaacaagttaagtattaaacttagcttgttctttgttgtttattttaaattagcgtaataaaaaaatatttaaaatatcttgacaaattattaaataataattattattagttacaagatagttaataaataatatcaattaataataaaactcaggaggtaatgaagatgtcattaataaataaaaaagtttcagattttacagttcaagcatatcaaaatggagaatttaagaaagtaacattagaatctataaagggtcactggtcagtgtttgtattctatccagcagattttacatttgtatgcccaacagaattaggagagttagcagataattatgaaaaattcaaagaagcaggatgtgaagtatactcagtttctacagatactcactttgttcataaagcatgggcagatgcttctgatacaatagctaaaatacaatatccaatgttagcagatccaacaggaagacttgctagagattttgaagtaatgattgaagaagaaggcttagctttaagaggttcatttgtaattaatccagaaggtgaaataaaagcttatgaaattcatgatttaggaattggaagaagtgccgatgaattattaagaaaagttcaagcagctcaatttgttgcagaacatggagatcaagtttgtccagcaaaatggcaaccaggtgaagaaacattagtaccaagcttagatttagttggtaaactataatactataggttaaatataatggtgaatcagtagctttattgattcaccattaatttaaaatattatgaaagtattactgtatataaaattttcataatgctttaaaaattatagttataaaatgtctgtttaatatagagaaagataaagcaaggaggagttaatatggaaaagatatatgatttaatagttataggtgcaggtccagctgggttatctagtggtatttatgcaggaagagctaagttaaatacattaataatagaaaaatctgaatttggagggcaggtaaataagacttatgatatttcaaattacccaggtgctagaaacagtaatggtccaaagcttatggaagaaatgagaattcaggctgaagattttggtgtagattttatgagtgctgaggtacagaaggtaaacttagatgatgatgtaaagataattaaaactgatagaggagaaattaaaggaagagcggttataatagcaactggtgcatctccaagaaagttaggatttaaaggtgaagaagaatttacaggaagaggggtagcttattgctcaacttgtgatgggcaattatttgagggacttgaagtctttgtaataggagcgggatttgcagcagcagaagaagcaatgttccttactaaatttgcatctaaggttactgtaatagctagagaaccagagtttacatgtgcaaaatcaataagtgataaaactttagctaatccaaagatagaggttatgttcaatacggagatattagaagctagtggaaatgaaacattaaactatgctaaatttataaataataaaacaggagaaacatttgagtatcatgctaaaaaagaagatggatcatttggtatattcgtatttgtaggatatgcacctcaaagtgatttatttagagatattttggaaactgataaatatggatacatgataacaaatgaaaatatggagacaaagattaaaggagtctatgttgctggagatttaagaccaaagcagctaagacaaatagttactgcagtttcagatggagcaatagctgcaacaatggcagaaagatatgtgattgagcttaaagaaagacttggaataaaggatgagtatgtatcaaaaaagccaatagaaaataataattcaaatagtgacttaggaatggtatcaagaaaaagtagtcttttaactgatggattaagaacacaattaaaaggagttcttgaaagattagaaaaagaagttacaatagtatcaatagttgatgaaagtaatcctaagtcaatagagcttagagatttaataatggatatttcggaattaggaaataaagtaaatgcagaagtatatgccaaaggaggaaatataaaacttgaaaataaaataaatgcagataaatacccagtggcagcattattagatcataataataattatagtggagtcaaattccatggtgtacaagggggacatgaactgaattcatttatattagctatttataatctttcaggacctgggcagcagatttcagaagaaagtttgagtaaaatcaaggaaatagagaaaggggtaaacataaaagtctgtgtatcattatcgtgtcatctatgtccagatgttgttgtatcctctcaaagaattgctatagaaaataaaaatatagaagctgaaatgattgatatttcaagcttcaaagaaataaaggataagtttaaagtcatgagtgttccagctgttattgttaatgatgaaaaaatttactttggcgcaaagaagattgatgagataatagatattataaagaattaataaatcaataattactacattactaatttacaattatatattaactaaaaatattatttatattgaaaaattttctataaatttgattaatttatttaaggctggagtatttgctctagtcttcttttttgctgcaataacagaaagttctatattatgatttaatggaacagtaacaagatttttgtgatgaaaaatctcaatattctttttaggaagaaggctaattccttcattaagtgctacagcacctataatagattctgtccttgcagtacgtactacattagctgagatattatattcttctataatgttcatgcataattgataaatataagtataaggattcatcaaaataaaattttcaccagaaagttgattaaaatttaattgactatattttgataacttgtgccctaaaggaagaacaacaacaagttcatcttttgctataggatatatatcataatatttaggattcagcatattctctcttgcaagaataatatggtattcatccatttttattccttcaagtaatttttcatcctctacttcatcaattgtaagattaatttctgggttatcttttttaaattcattaaagatagaagttaaattatattgtgtttgaattggaagagtaccaatatggagtttctcatcattgaattttttataattacttatattatttaaagctatattatattgattaattagtataatagcatcattataaaaaagtcttccagcatcggttagagaggcacttcttaatctacgatcgaaaagatcaatattcaattctttttctagctttataatctgctttgatagattagactgagatatatgcagagattcagaagcattaaagtaagttccattttcaactattgcaataaaatatttaagttgttcaaaagtcatttcttatatttattcctttcacatatgaagtaaattaaaatcattccattttggaatcaattgtatcataagttgaattgatttgccaatgttttatttgtaagctttaagtataaataaaacattggcaaatcaaggatttaaaggagaaaaaatgaggaggaaatataaatgagcaataaagtatatgatcttagaagtgcattagaattattaaaaactctgccaggacaattgatagaaacagatgtggaagtagacccaatggcggaattagcaggagtttatcgttatgttggtgctggtggaacggttcagcgtcctacaaaagaaggaccagcaatgatttttaataatataaaaggacacaaagatgcaagagtattaattggattacttgcaagccgtagacgagtggcagcacttttagattgtgaacctgaaaatttaggaaagttattatatagaagtgtcgataatccaattgccccagtacttacagacgcaaaattacctttatgtcagcaggttgttcataaagcaacagatccagattttgatttaaataaattagtacctgcaccaacaaatacacctgatgatgctggaccttatattacacttggaatgtgttatgcaagtcatccagatacaaaatttagtgatgttaccattcatcgtttgtgtattcaggggaaggatgaactttcaatattctttactccaggagcaaggcacataggtgctatggcagaaagagcagaagaattaggacaaaatcttcctatttcaataagtataggtgtagatcctgctatagaaatagggtcatgttttgaaccaccaactactccattaggatatgatgagttatcagttgctggagcactaagaggaaagccagtggagctttgtaattgtattacagtaaatgaaagagctattgcaaatgctgaatatgttattgaaggtgaagttatacctaatttaagagtacaggaagataaaaacagcaatacaggatatgctatgccggaatttccagggtatacaggtccagcaagcgatcaatgttggatgataaaggttaaagctgttacacatagagaaaatccaattatgcaaacatgtataggtccaagtgaagagcacgtatcaatggctggtataccaacagaagctagtatttatggaatgattgaaaaagcaatgccaggaagattacaaaatgtatactgctgttcatctggtggtggaaaattcatggctgtattacagtttaaaaagactgttgcaagtgatgaagggcgtcaaagacaggctgcattattagcattttcagcattcagtgaacttaaaaatatattcattgtagatgaagatgtagattgctttgatatgaatgatgtgttatgggcaatgaatacaagattccagggagacactgatattgttacaattccaggtgtaagatgtcatccacttgatccatcaaatgatccagattattcgccaagcataaaaaatcatggaattgcatgtaaaacaatatttgattgtactgtaccttttcatatgaaagaaagatttaaaagagctaaattcatggaagttgatccagagcattggttataaggacgaaagaaaggaatattaataatggcaaagaagattgtagtagctgcaacaggtgcaagtgggataccaattttgattcaatgtttaaagatgataaaggaagaacaagaatatgaatctcatcttattatgagtgacagtgcaaaagttacattgcttcaggagacgaattattctttagaagatgtttatagatatgctgatgaaatactagatcagaaaaatattggagcaggtcctgcaagtggttcatttagaacagaaggaatgttaattgtcccatgcagtatgaagacaattgcaggcattaatagtggttatacagataatctcatattaagggctgctgatgtaacaataaaagagcatagaacccttgtactagcggcaagagaaacacctttaagttcaattcaccttagaaatatgcatgaactttcaaaaatttcatgtgtgagaattatcccaccaatgatgactttttataatatgcctgagaatatagacgatatgatatatcatattgcagcaaaacttttagagccatttggcatagaagcaaaggagtatagaagatggaaaggactatagtgtatgaaaagaacctatctttttcaaaaatttcaataagtgttacaaaaattggagaagattataatatcatacttgaaggtggtgaaagaccacatataggatgtactgtaatttcaattccaaggctatcattaattggtgatggaagtataagttcaacatcatcagtattaaatgttattggacataaagatgaagagatatgcagatatgttgcagaaaagatatgtgtaaataagaatgctgttgttgtctgttgtggtggatttcatattgataatataactcaagatagaattaaggaagtaataaatggtgtaagagatttgtgtgaaaaagtcattttgtaattaatttaaaatgagagatgaaacattcccatacacatatacacagggaaaaatacagataggaaatactgcttcatcaggtggaggagaaggaattgatctttcaagaactccaggacagggtggagataaaaaagatggtcaaatgccaccacaagggtaaaatggaggaagaggccaaggtgcaggtatgatgcaaggtggtgcacaatcatcagaatcaaagacatatgaaacagttcaggattacattgattctttaaacagtgatggaacatggattgattatgattcacagactaatactgctaaaattacaagtgttgaagactttgtaaaacactgcaaagaagcaacaaagcctgtaggtgcatttgattctgtagatttaagccgtggagaaaataatctatttggtaatggtcagtctacagcattacattttgattctgtagaatcatcattgttatcaaaaaatgaatcaaattattcccaatatagtgactgggattcttcatatataacatcatttgaagatgatttgaagtcagaggatagcattggaactgatatgcagacacgtgtaaatatgtataatcctatgtattatctttcaagctattattcaggatataacacatctaaagtggcaaaatattggagaatacgtacaggaataaatcagacagatacagctcttactgttgaaactaacttaaaacttgcacttcaaaattatgatggagtagagagtgctgattttgcaacagtttggggtcaacctcacactacagctgaacgtacaggaaacagcacatataattttataagctgggttgatgaatgcttgaagtaatgtgattgtggtgagtggaatgtagatgatgaattcagtatattagtattaaaattttttagatatatttatggaaatagaggatttgtagtttttgggggatgcgggtttggtacgactcgcctccaccaggaagaatccaggtcaatttcagaaaatgttacttggggtcaaagaaagcggtttgcagatggaaaggtaagtttaccttataaacaattcttaggatatgaaaaaggtgaagatggattaccaaagatagttgagtcagaagcaaaaacagtaaggttaatatataaattatttttagaaggtaaagctacttggtggatagcaaaatatttgacagagcacaagatatcatcaccagcaggaaaagataaatggcaagaaacaacagttagaagtattcttaagaatgaaaaatataagggagatgcgatgcttcaaaagagttttacagtaaattttcttacaaagaagaagaaggttaatgagggagaggttccacaatactatgttgaaaatagccatccagcaataattgcatcagaagtatttgatttagcacaggctgaatttgaaaatagaaggaaagatagaggtttaagaagaagcagcacttgtttttcaggtaagataatatgcggtgagtgcggtagcttttatggaagcaaagtgtgacactccactagcaaataccgaagagttatatggcaatgcaactctaagtttaagaatactgagaaatgtaacacacctcatattttatgagggtaaattaaagcaagcgtttgttaaagcatttaatagcatacttaaaataaggatgaaattttacaaggatatgaagctataatccaagcattaaccgatacttcaaaacttgataaagaaagtgataagcttcaaggtgaaatagagattgttactgaaatgcttagaaaatgtatagatgaaaatgctaatagtgctttacatcaaacagaatatgaagaaagatataatgctttagtggaaaggtatgaaaatattaagaaaaaaattgaagggatagaagaaaaacgattagagagaagtgcaaagaaagaaaatattttagattttataaaaaggctgaagcaaagaaaaggattaattacagaatttgacaaggaactttggaatggcactattgagaaaatattggtgcattcggaagatatgataacttttatatttaaggatggaatggaattagagtggaatatataaggtgattgataacacccacaaggttagataatgttgtagctgactttgtgtttttttcacttaatttaatattcaaattagtactactaattgtaattataagtttacaattaaggtattagaaaatatgagaggttttaataacttaaggagaggtagatgaatttgttatgtaaaaatataagaagtggcttagataataagatttatggtgaactttttttacagatggtggagcaagtaaatgtcataaatttggctgaagtggagtttgtataagagcaggttattattaaagagatattatagaggtgtataaggtttaaagcattagcaactattttaaagagctagtgcttttatttttttgttggactgtatgaaaataatgatggatgtaaattggtaaaatatatagaaaattatattaattttctatataattataatgtgattttgtgtttatttatatatacgggtaacttttgtaaaattttatataaaaaagtatgacatggacagtaaatgtccacatagaatgctataataagagatatagatggtgataattttggctgaagagaaagatggaaaagtaaatagagtattgactatatatgaaaagcttacaaaaggtgaagtaatatataaaaaacagttggcaactatatttggtgttaatgaaaaaacaatacaaagggatatagaagatatcagagcttatctatcaaatagcacagaaactaagtgcagtatagatgttgaatatagaagggataaaaaaggatatagccttaacaaaagagaagatgctattataaacagagaagatgtactagctataagtaaaatattattagaaagtagagctttttgtaaagaagaaataaattatttaataactgcaatgttaggggaaatagattttgaacaaaggaaatatgtaaaagagcttattggaaatgagttgctaaattttgtacctttaaaacacaatgataaattactatcaaagatatgggatttaagtgaatttataagacataaagaaagtatagaaataaactatgcaaaaacaaatggagcagaagttaaaaggattattaatccagtagcaataattttttcagaatactatttctatttaattgcatattttaatgatttagcatttgatgatcctacagtatttagaattgacaggataaagaaatatgaaagtagcggaaataaattctatattccagaatcagagagatttgaagatggtgaattcagaaacagaattcagttcatgtatttaggtaagttgatgaaaataaaatttgagttttgtggcagttctgttgatgcagtgttagaaaggctaccaacatcaaaaataattgaccaatatgatgataaatatttaattgaagctgaagtatttggaaaaggaataattatgtggatattaagtcaaggaagtaagttaaaagtaatttcgcctgatgattttgttaaagagatagcttgtgaagctaaaaagataagtgaactttataaaaatggttaacaaaaataaaagttaattcatatacatattaaatttttggaggtaatagagatggcaaagactataaaattcaatttaattttagatgataaaccagtaagaactattgaagatttaagagaaaatttctcgattgaggacattttagaatcatataataatggattattacaaagatggcttgaggtgagaggttactcagaacttttagaaaaagtaaattctataaaagttgatagcaatattgagcaaatacagcaattaattaatatatttgatgttgaatgcgatgttgctaagataaaagaagggattgcaatattagattatattatcgaacgtaaatgtttactggaagaatataataaatcaaactataaagctaaatcagttattgatgactatcactcaggatatgattctataataaacgatattatagagaataaagataacatgcctaaagtcaaagctaatataaaagaaattgaagaaaattatatggggctttttaatttaaattataaggatttatataataatttagttgataatgcacctttagctatttttgctattcttatgaatactaaaatgagaagctattttattagtagtgattattcaagtgaaaatacaaatttaatttataacaaaatcaaagagtttgtaacaaataaaacagtattaaaggaaaaattaggcgaagaattaaaaatgtttaaaggaaatacagaagcctactggaaggacatagaaccaaaagaaaaaatgcttatgattataagtatgcaagatggaaattatgtaagaaatgctggaacatttggagaggaattatcaagtgctgatgtaaataataattttatggttttaagtggaattgactataaaagcaataatacttaccatgaacttctatatatggaggtgtaatcatgaagaaaagttcggaaaatttattagcttcgtatatagatgcattacatccaataatttatataaatcattttgattttaaagtaatagacgaaactctctcagcaataggtaaaaatgtaaatatagttgagttcaataacgcattaggaatagttgatttcagcactaaaagtccaatgatggagtgcagtttggaaaagtttttattaaataatatggatgaaggatatgaaaatcaaacatttatagttcttaaggatatacataatgctttagaagatcctaaaattatagcattactaaaaagaatatctgaagataatttatatcgtgaaaattataatgcaactatctttatagtatctagtaaggttgttataccaactgaattagaaaactatattactgtttttgatattccactgccaactaataaggaaattttaaagataatagataattttaaagaaagcttagatctacaagtagatgaggatgtgttaaatgatattgcattgtcatttaaaggtcttaatgaatttcaaataaagcaaatattaaatcttgcatatcaggatggcggatacatagatgaagaggataaatatttgattcttcaagaaaaagaacagtttattaaaaagtctggcatgctagaaatggttaatttcaaggaaagtatagatgatattggtggattagaaaacttaaaggattggttgtatagaaaagctaaagtatttaataatttagatagagctattaagtttggtgtagatataccaaaaggtataatgattataggaatgcctggatgtggaaaaagcttgactgcaaaagcaacagctagattatttgaaataccattagtaagacttgatgtaggaagacttcttggtaaatatgtaggtgaatcagaagaaaatatgaggaaagcactaaaactttcagaggcaattagcccatgtgttttatggattgatgaaattgaaaaagcattttcaggtgttggtagtgaaggtggaggaaatgatgtaactactagattgtttggtcaatttttaacttggatgcaagaaaaagaaaatactgttttcattgttgcaacagcaaatgatatttcaagaataccaccagaattcttgagaaaaggtagatttgatgaattgttttttgtagatttaccaaatgctgaagaaagaagaaaaattatagaaattcatattaagaagagaaataaatggaatagagaaattgatactattactttactaaaagaaactaatgggtttaacggagcagatttagaagcagtagttaaagatgctatagaatcagcatttattaatggagaagataaaataactactgaagatttaatgcaagctgttaaagatacaaaatcaatttctagtaccttaaaagataaaattgaacagataaaacaaacaattagtaagattgatataaaacctgcaagtaatgctgataatagaccaggaaaaatgactatagaaagactgcaaaatgcaagtaataactatactaatagtacaggaaaatatccaacaaatccatatgttaaagctagagataacaaaaatgctgaaactgtaggaaaagctatatcatctgtaggaaaggctacatcatcagctgttgagtcaattttgagagcaattggaaataaatagttaggtttagggggatatgatgagcaaatttaaaaatgataatttaattattgatgtagaatataattcaatactagttgaagatgatgcaaagcaacttaagcaactacaacaaagatttattgaaagctacattgataataaggataaaatggagcttaatcaatggttaactattgaattgaaaaataatctgccagaaaagtcagaactagaaattcaagaaattagtaaagatattatagacacaataaaaataaacgaagaaaaacaaaagtccttagaaaaggctattgaaaatggtagaagtaaagaaagttggtttgcagctaacttaaaacaatctacatcaaatatgacaacttctcaaacagctgaatatttacatggattagatgaagctattaataatgcgaatcaatctatgtatgatacaataacaactaaaagtggagctattaatcgaaattttaatttagatggattcattgctgaacaacaccatgctaactcttttaatttagaagccaatcttaagggcagcgagtatagagcagaagtgctggtacctaaagatggtcaaacttatgggaagaactctgttgatatagttgttaaagacaaaacaggaaagattgtagagagatatcaagctaagtacggcaaaactgcggatgacactataagaatgattaatgaaggaaactataataatcaaagattgctagttcctgctgaacaagtagaagaagttcaaaaagcatttccaaataaaacagttgtagcatcagttggttcaggcgatataaagagtaagcctttagataaaataggagcaaaagaattacaaaatgaagctcagagtggtaattggaatgatttaaattggaatgaatataaaagtaaagatttagccattggtataggaaaacaagcaggatatgcggcgatacaaggtgcagctattggtgcaggagtagaacttgcaactaaagtatggaatggcgaagaaataaaagccgaagaagtggttgaacaagcgttagtatcaggggcagattttggtgtaaaggctgcaacagcaggtgcattaaaagttggggttgaaaaaggtatagtaaaagcaataccaaaaggaactccagctggaactatagctaatatagcatatgtagctatagaaaatgttaagattttaggaaaagtagctacaggggaattaactgtaaaagaaggtttaaataaaatggagcaaactacagtagctacagtagctgggatagcagcaagtgcaaagggaacagctattggagctactataggatcagtattaggaccagttggaactgtcgtaggtagttttgttggtggtactgtaggatatattgcaggttcaaaagttgcagaaacagcagttaaagcagttcaaaaagttagagaaaaggcgagagaagttgtaaaagaagttggaagtactgtagtatctggagttaaaaatctctgtagtggagttagtagtggaattaaaagtgtagctagtggtattggcagcttttttggattttaaaaaggagtggatatatcttggcagaagaatcaagtagtatagaaaataaaccatttgtaaaatatagattaactggaatacaaggaataaatataaagaactgtgaacctataaatttagaaagtgacaatttagagtttattgaagttagtaaatcactagatacaattacaatatttttaaaagaaaatataaacgagtctgatgcatggaatagttgtgaagaatttatatttaaatatattattagcttaatcgtaaatccagatattgatgtaactattcctgagtacaaggtagatagttattataatattagcaaacaaaatacattgaatataaatgaatatttaagtataagtgatagtgcgtcttttacaagaatatatgaaggttctgaatttgtttcaaatattgtaagtgaatgtaaaactaatgttaatgctaaaaattatctcatgtataaaaaactttacagtataatgagaaaccaagatattgtaactaaatatttgttattatatgatttcttgttagacttagtttcaattaataaaaaaagaaaagaacagaaaaatataagtgatttcgttgtcgttaataaattaaatgaaggaattaactgtattggtttctacaaaactagaagaaaaggatgtaattttgaagaggatagctttacatattatagaaatgaaatagcacatgccgaatttaataatgattttaaaatgtatgagcaggtatctaataatataaataatgggtttataaacaaaatagtagaagttattaatagcattcttaaaagaataaattaatagttgatattatgttttagagaattgataatattgtttataggtcaaaataactgttttcttttcaccttatataacaccttcatgcatgttgaaacggtagtaaagctgcaaaggaaacacagttagaaccttgagaaatcaaggttcttttcttatgcaaaaatttatatgttcccaaatacatagttagcaaatctaaaaaatgctataatattgttgtaggttagtagtggaaattaaatgagaggagagacactagtgtggcaagattgacatttttaaaattagcagagaaaatattagctgaacaaaatattcctttaacagcacttcagatttgggaaattgctaatgaaaaaggatataatgctgaattgcgttctcaaggtaagacaccatggaaaacaatagaggcacagatatatgttaacttaagggatgatcaaaactctatatttacaaaagtaaattctaaaccagtaaagttttttttaaaggaacttgcggaaaaaagttgtgaacaagtaaaaaatgaagataaagttataaatgatacgataaaaatggttcttcctaatttatccgtttggagctaacattagttttgctgcaagaagtttcttactacatcttccatacatagttctttttatcatttttaacttactattagtaccttctacaaatccattacttaaatcactacaaatagaattttcaactgcttcaatatcttttaataatccattcgctaaagatgataattcactaatatctatatttatatatttctcaacaaatatataaaataatgcaagattctttttcttaaataattctctaaattccataatacactttttcaaactaaatacctttggataattagcatatatatgatttttttctatttcagatagttcagaatccatccataagtaatcaaatatatagcttctctttagataaatatatttttcatctctagcaccatttttagttttaacactttcactaacaggagaatacttatttatctttaggttattttctttaacaactttccgaatcatatgccttgcattgctttttgaaagtttatatccttctgataataatatatctacaatctgtttttcaatatatcctatctttattaaactaattactctattttcatatgggttatttctttttctggaatgtttacataaatcatgtacttctccttgaatgtatcttttaatggtacgtctatctttacctaaaagtcttgatatttcactaattgaatatccatcatttttcatttcttggattttatatattaatttaatgcgtatatgctcagcagctgtaaagttatccacagtttttaggattttttttaccgtggtcattctgttcagagctacattgagttttaatatcattttcaatttttatagttgaaggaatttctttgtaaagagctttttttatagcttgcaatagattttggtgtatatggaatctatcagctatttgcatagctcccggtaattcttgctcaataactttagcatatgcacttgcacgatctcgtgtaactacttttatatgcttattatcctttaaccaagttgataaagttttaccatccctaccatctaatatggctattggtttatgagttttttcatcaacaataatagttccataattatgtctttttttaaaagagaaatcatctattccaacagtactactacaagtatttattttcatttcatcatatttttttagtaatatttttataattgtatccccactaactttgatattcatatttttagctatacgtgcagccccttcacagcttgtttccaaagctaaggtacataaaaaatcagataaacgctctgtcattctgctataataactaataaaaccatcaaaagattctactatagttttattagaacaatcaatattctcgcatttatattcatatgaattgatttctaataatacttgcttacctaatataggtaaatcctgaacttttcttatatatgttccatgatatttgttagatatgatattgcatttaggacaaatacaattattactttgtgactttaaacttatcttaatcacttttgtatcttctaatatattagtaatttttaatttgttagttgggaaaaagttttgcagatctattgatgaattacacatgattaatacctcttaaatatatgatatattaatgatatcatatatacggataaatacggaagaaccattcatgggttgacatttatacatatgttgtgaattaacaaaaatacactcattttcttttatatcataactatctccattaattgaatatgacatatttccttttaacataagtgtgaattccaaatcattatgccagtggttgatagctgacatgcctggatattctgacaataaacttttatttgctcgaatggggaaatctataaaattatatgaaactttttcagatttattagtagataaattcatttttatcataatactcctttcatctaatatatacgattgttatatattttaaacctattattatatttttacaggtaaatttgtaatattattataatatactattttattattggaaactataaataagattccaataataataaagaaaaggagaaatcttatgtcagaaaaaaattatgtccagcttgtggaagtagtgaaattgcaaaagggaaacaaatagcacatggaagaatgattccagtaaataaaatttttacagctggattaaatgttttagcatgcactagctgtggaaatattttatcacttaaagtagaagaaccaggaagatttaagttatagtgaaaaggtattgtaattttaataagatattaaattagatatataggttgtcagtaaattatttatttgaaataatgattttgggagagtgataattatgaaaaataacttgatagacatgcatatgcatagtttttatagtgatgatggtgagttcacaccttcagagttagttaaaaaatgtcatgagagtggtgtgaaaatcatggctattgcagatcataacactgtcaaagcaatcgatgaagctataaaagaggcgcaaaaatataatataaattatatttctgcaatagaaattgactgtacttataaaggaattaatctacatgtacttggatatggaattgactataaaaatgatatatttaataagttagaagaaacagttagttttatcaagaacagtggtggaattgcagttcttgctcatcctggaaataatctaaaaggctgttttgatatatttgatgaaatgattgatgcaggtattggaggtgttgaagcattcagcagttatcatgatgatacagcaatacagtattttttagacaaaggaatgaattctaaccttcttataacttgtggaagtgattatcatggaaagacaaagccagctatacaaatagggaagacaggatgctttgtagatgaaactgaaattgaaaaacatcttaaaaaggttggtttaatttaaataaagatactaaatagtttttagtgaattttaaaagttaagcttcagaattgctataaacctacaaaaatcataattttgatttttgtaggtttttgtttttataaatttatatcaatacatatatttacaaataaataatttagtggtaatattaacaaaaagcagtctataactatagactgagaaaggagaaaaaatatatgggtatatcgaagattccacaatcggaacttattgtgatgaaagttatttgggataatgagaaaacactttcatctaaggaaataataaatatcttaaaagaaaaaacaggatggaaaagaacaactacattaacattactatcaaagcttgttcagaaggagtttattagtgcagaaaaaataaaattatatacgtactatactcctataataaccaaaaaagaatatcttgaactcgaaacagagtatttttttacaaacattcatgataggtctttaaagagtcttattactgcacttcatgataatgatgagataagtgaagatgatattgaagatttagaaaaatggataaaagagagaaaagaataaaattttttaaattagcttagatgatctcgtatttatagtcttgggaaattaatttaagttgttatttaatttgaaaatagaatctagggaaagagtttacaggttaagattaaattagatatgtataaaagagatttgaataatatagaaagtttggaggtgttgtatggctgaagttatattttttgaattaataagaattacttttataggtagtgtagggatactactacttcttatgctaaaaaaattcatattaaaaaagtatactaaacaattcaattattatatatggcttgtgattattataagaatgttgactccttttaacatacctattacattaacaatggacaaagagccaggaattataattaataatatgatagaagatagaagtggaataaatgagacacaagattatgaatatcctttaggatctatacaatcagattttcaagacaacaatatagaaaatggatcgaaaatttcatactttgataaagaaataaaaaatatggttgcgctacttatgagtaagcataagctgactactatgctagtatatttgtggttgtgtgttgcgttgataatttctatatatagaattatttcatacataaaaatgaaaaatttaatcttagatttatcttatagtatggatgaaaataattccagtctaaagtacaggtgtaataaaatgctctctaaaataaaatgtgatttgatgaaagaactgaaattaaagcagaatataacacttaaaatatctgatgcagcaaatattccatttggtatgggaatattaaaaaaatatattattattccagccaatagcaatttaaaagaagatgaattaagatggattttaaagcacgaattaattcattataaaaaaagggatttgctttataaatatattgtcatagttgtaaaaacaatatattggtttaatccattagtttatattatgagcagaacaattgaaaatgaatgtgaactttcatgtgatgaagatgtattaaaaaatcatgattttaatgaacgaaaagaatatgctttgacacttgtaaagtcattaaaagacaataatcagagagttttaggaataaatctgtctactggctttggtgataaaaaactattaaaagagaggtttgaagagatgtttagtaaaaaggcaaagagtggaattttaattgcaggactttgtattgtaatctgtattgcatcattttttataatatctaataggaatttagaggagacttcggctgatgatggaagaagtaattcaaatgtatcagttgattcttcaaatgatgaaattgaattatatcaattaactactgataaatataaaggatattatatggagattaaagatcctaaaaggataaaaataggatatagcaatacaggagaaaaagcaaaaactgttaaagaatttgcagaagaaaacaatgcagttgctgcaataaacggtggagcatatactggggtgagttacaatgaagatggggtaatagatcctgtaccagttccatcaggatttgtaataagtaatggagagtgtgttcaggattattcagaagatgaatatgagtatggagtatgtgcaattactgaagaaggtaagcttataacaggaaaatattccttacaacagcttaaacagcttaaggttaaagaagcagtaagctttggaccatctttgattatagatggaaaaatgagcgaaatgactggagatgggggctggggaatagcacctagaacagcaattggacagaaagaagatggtacaataatacttcttgtcattgacggaagaggtattggaagccttggtgcaacgttaaaagaaactcaggaaataatgtataagcttggagcagtgaatgctattaatcttgatggcggaaaatcaagtactatgtactataatggaaatacaataaatgaaacagaagggcgaaagataccgacagcaattcttgttgaataaaatgttgataactgaaataagcatttataaaaataaattttaaaaaggaataaaattcagctagtagaaagattagatagtttatataaaagatagaactatctaatcttttttgtgtgttatttgtaaaaaatttaaaggagctgaagtaattaattgttctaattataatattttagaaaatatttgttctaaaagatttatgctgtctccaaaaaaggttgtaaatccttcatttttattatcagcaatattatcatctggtatagaaaaagagatatcagatgatttagatattgtgctattagggttagatgtaatagatacaacattaccattaaagcttctcatttgttcaattttatttatacatgaaaaattttcacctgatttagaaattaaaagaagagtgggattatgcattttatcataaactattggtatttctaatccatgaagtaatatgacattatacttttttactaataattttctatgtatgtatccagtaacaaattcacaaaatccttcaccatatatgtaaatatacttatttttattaaagtaaaaattaatttcatctaaagaaggaaacttagaattattaactaaattttgtctgtcttttattgaagactcacttgtcatttttttacatcaaaaattaattcattatagccactgtatccaagtttttttgcaagtcttattattgaagcagtagaggtgaaatttatttttgcaagttgtcgtattccttctttttgaaccttttcaggattatcaacaatatattcaagtatcttaatgtctgaatctgatagattttgatttttaaaaagtctgtctatatgaaatgtttttgccatactttatcctccttttaaggttaacctcatatctaaaattaattatatcatagaaagttacacttatattaagtgtaacatgttacgctgtgtgaaaacggctacagaaggctctgaaactatatacaaagaaaattacacataatataatcacagtatagtaaagaaggagggagataaagtgaagcacttgattattaatgcagatgattttggatattctaaagcagtaaatttaggaattatggaaagccatattaatggagttttaacttcaacaacacttatggcaaatatgccaggtgttgatcatgcagtaagtttgttaaaggatatgcccaatttatgtgtaggagcacatttaacattaacttgtggaaaaccaatgttaggagagaaagtttcaactttaattaaagaaaatggatattttttaaagttggaagatgtggaaaacaaggtagtacaaatggatataagtgaaatttatgaggaatggaaaacacaaataagatacttattaaataaaggggttaatttaagtcatattgattcacatcaccatgtacatacatttaaagaacatgaggaaataattaaagtactttcagaagaatttaatttacctgtaagaaattgcaataatgttttagaaaataaaatacgatttttggatttatgcaactataacccaataagaaacatggaagaaaaatatgaaaatgttagaattgaatgttttaaagtaatagaagaaattataaagaaaaatattcaatatgaaaatacagaagctatgtgtcatccagcatttttagatagttatcttttggaaaattcatcatttaatatagcaagaataagagaggtggatatattatgtgatcaactcatgagagatttgataaataaatatgaaataaagctatgtaattataaaaatatttagaatttaaaaggaggataaatatgatcaatacatttaaggtgattaaaaatcaattatctaaattaggaaaagctatgcttataccagttgttgcaatgccagttgcaggacttttagcaagatttgggcaaccagatttattaaatttagatatcttaagaattgcatcagatgttgtatttggaaatttagatatgttgtttgcagttggatgtgtacttgcttatacaaagagcaaagataaggctaatccagtactagctagtgtcttatcaataatggtatttagacaagcactcacatttttaaatgattcaattagcatgggggtttttggaggaatagtatctggtgtggcaacagcagtcatttataattatagtaaagagtggaaagttcctagtatgttttcattttttgcaggtgataaattagtaataacattaggtccacttttttctataccactagcatacgtttttagtgtcatttgggctccagtagaattagggttagataattttgcaacatggttaggagctatggggataataggaatattcatttttggatttttaaatagacttctaataccaactggattacatcatgttttaaatgcatatgttttttatgaattaggtacatttacaactgcaagtggaactgtagttacaggagaaatgtctagattccttgcaggggatccagcagcaggatcattcttaagtatgttttatgtaataatgatttttggaattccaggagcagctatggctatgtataaaactgcatataaggaaaataaagaagaagtaaaagggttagctaatagtggaatattaacatcattatttgcagggattactgaaccaatagagttttcatttatgtttgcatcaccacttctatattttattcattctgtttttactggtttagctggtgctatattatatattttccattcaagaattggatttgcatttggatttaatataattgatttggtgctaaattggaagatgggtaataatgttatatatgttatcccagtaggtatattattcttttgcttatattactttacatttaaactatttataattaagaaagatataaaaacaccaggaagaatagattcagcaaatgaggaaattgatgaaaaatcaataaaattatctcattcaaattatgaatatatggctaaaaaaatattacaaaatataggtggaagtgaaaacgttataactgcatctaattgtgttacaagattgcgtttagaaataaatgatattagcttagtaaatgaagaaaatataaagaaaactggtgccaaaggagtagttaaaataaatgataataatatacaaattataattggaacagaagtagtgaatgttatgaaagaatttaatgaattattgtaataagtgttaggaggaaataaaatgggaaataaaatagtaattgttggtggaggatctacacatactccaggaattgtggaagttttaaaagaacgttcagaggatttacaattagaggaattagtattatatgatactgataaaacaagaaatagtttattaggtgaatttacaaaaatatattataaagataataattctaaagttaaggtttcgtatacaacaaatattagagaagcatttaaagatgcaaacttcttatatgtacaaattagaccaggattaaatattcaaagagaaatagatgagaaaatttgcttgaaacatggagttgtaggacaagaaacctgtggacttggaggattttcatttgcattaagagtaattccagaaattttaaaaatagtagaagtagctcaagagatttgtcctgatgcatggattttaaattatactaatccagaagctattatatcagaaactatatataaacgttttcctgaagctaaatgtttgtgtatatgtgatatgccaattagtattgaagaggcaattgcggattatttaaaaattccttataaggatttaacttttaaatactttggattaaaccattttggatggtggacaaatatctttgataaaaatggacaggacttattacctataataagagaacgtgtattaagaggagaacttaaaggattaatacaaacaaatgaagaaattattggagatgattattggacgaagacattccaaaatgtaattagagcatttaaaaactatccaaagtattttccgaattgttacttacaatattattatttcccagatgaaatggttgaagcagataatgtagagtatactagaggttcatatgtattgaatacaagggaaatttcagtgtttgaagaatgtaagaaggtaattgaatcaggaacagcaaagaattcaaaattattaggtggcgttcatggaaattatattgtagatattacaaatgctataatatatgatacaaaagaaagatttatagttaatataaaaaataatggagcaatctgcaattttaataatgaagctgttgtagaagtaccttgttatattggagcaacgggagcagaaccagttactattggtaagataccaacattccatagaagtatgatggagatgcaaaaaggatacgaacttttaacagtagaagcagccttaactggttcgtataatactgcaatggaagctgttttgctaaataaaactattcattcccataaagttggaaaacaagtattggatgatttattagaagcaaataaaaaatattggccagaattaaaataaaattaatctttaaagtatattaagatgtttaaagctcatatagtcacattatttaaagtaatttattataattattactttaatatgaatgtgactgtatgagtaatttttttaactaaatagtgctaagttttatattgtaatttatttatcattaagatattctaaaaaagtttgtccgatatatttcttaaattttctacaaaaatattctggctgaaggtaagcaatatctgaaatttcttgaatagaaatagcacgattatagttaagctttgtatagtcaagtacgggttcaagctgtgataaaaaaatcatggttttttgagggcttcagtaaataaaatcaaagttacataaaaaaattatgtatgtgtgtttcaattttaacatactaaaaatagagtacttaaattttaatattatataagattgttttttactaaatatgttaaaaaaataaattgtattcaataaatgtacaaaaatgaaaaaataatgtatactttaaaagttaaattattatcaatcatgaggtggaaaaatgtattacagtgatattgaaaaacttacaaactcatcaaaaacaaaaaaggaaatggcggataaaagtatagtcaagtattttgctcgagctattatggctggaatatttctaatgctagcaactattctttcgtataccattggtgctgtactttctagtaattatccagaagctgcaaaaatatcaggagcagcattattttgctttgcaataatagctgttgttttctttggaggagaactttttacaggaaataatatggttatgtttatagggtatttgaaaaaagaagttagtttaaaagataccatgaaaatatggatatattcttttattgggaatttaatcggtatagttatatttgcttatatgtttgctgagagtggatgcaattttgaaagtattaaaacttatattgaacctatattttatgggaaaataaatctttcggtaagtcaaatgatttttagaggaatactatgtaatttcagtgtgtgtttagcagtttatagtggaataagacttaaaagtgaaactggaaaaataatattaatgtttttatgtgtatttacttttgtgttggcaggttttgaacatagtattgcaaatcttgcagcatttgcaattgctttcttttcatttggaggacttcctatggtgccagtgttaaataatatattctgggtagttattggaaatatattaggtggaggattgatactaggaggacttttagtaatctcaagtataaaagataattagtgagtaaatattttacataattttaaagattctggctaaatattagtattaaattgaattaaagcaaaaaaaaatcatagaagttattgacaaaaaaagaaaagtaatgcatatttatattatgtgataaaattaacaaagtgtgtaatagaaattgtcatattaagttaaaatatatatttattattaatattgacaatacatactaagttgagataatattttatttgaaaatgattttcaaataaaagttataatagttttatgaaatgctgattaaatagtacataggttattatgggacaagtttaatcatcgcgacccttttttattataatcacttagcaatattataattttaaagttcctaaccgattctgtaataaaatttgtgaaggtattttgggatacgctgagtagttgcggtttattgaaaaatatcttacagcatttcataaaacatgttagaaaaattaagtttagcttacacataattaataatataaattataaaaaaatatatatatgcacaaggaggactagacatgttagaaaatgaacaatgggctggattcgaaggaaggatttggaaagaagaaatcaatgttagagatttcattcaaaacaactatacaccatatgatggtgatacaagtttcttagcagatccaacagaagctacaaataaactttggagcagattacaagaattgcaaaaagaagaaagagctaaaggtggagtacttgacatggaaacagaagttgtttctggtcttacagcttatggccctggatatattgatgaatctttaaaagaacttgaaaaagtagtaggacttcaaacagacaagcctcttaagagagctttcatgccatatggtggtattaaaatggctgaacaatcttgtgaaaactatggatacaaaccaaatccagaattacacaagatatttactgaataccataagacacataaccaaggggtattcgatgcttatacaccagaaatgagagcagctcgtagcagtcatattataacaggacttcctgatacttatggacgtggacgtatcgtaggtgactacagaagagtagctctttatggtattgatggtcttatagaagaaaaatcaaaagatcttgctaactgtggcgatggaactatgactgatgaagttattcgtcttagagaagaaattacagatcaaattaaagcacttaaagatatgaagaaaatggctgaaggttatggatatgatatttcaaagccagcaaaagatgctagagaagcaattcaatggttatattttggatatcttgcagcaataaagactcaaaatggtgcagctatgtcaataggacgtgtgtctactttccttgatatttatattcaaagagaccttgataacggagttcttactgaagatgaagctcaagaattaatcgaccatttaacaatgaaatgtagaatggttaaatttgcaagaataacttcttacaatgaattattctcaggagatccttcatgggttactataggacttggtggtataggtgttgatggacgtcacatggtaacaaagaacgactatcgtttccttcatacattagaaaatatgggaccttcaccagaaccaaaccttactgtattttactcttcagcacttcctgaaaacttcaagaagtatgcagcaaagatttcagtagatacaagctctattcaatatgaaaatgatgatgtaatgaagccagtatggggagatgattactcaatctgttgttgtgtatctgctactcaaacaggtaaagaaatgcagttcttcggagctagagctaaccttgctaaatgtttactttatgcaataaatggtggtattgatgaaaaatcaggtaaacaagttggtcctgaatacaaaggaatcacttcagaatatcttgattatgatgaagtaattgcaaaatatgaacaaatgagtgactggttagctgatctttatgtaaatatattaaacttaattcaatacatgcatgataaatactactatgaagcagcagaaatggctcttatagatacagaagtaagacgtacatttgcaactggtattgcaggtttctcacatgtaattgattcactttctgcaattaaatatgcaaaagttaaaacaatccgtaatgaagatggtattgttacagattacgaaatcgaaggtgatttcccaagatacggtaacgatgatgatagagctgatgaaattggtatatatgttcttaagtcattccttgacaaaatcaagaagagacacacatacagaaattctgaacctacaacatcattacttactattacatcaaatgtagtatatggtaagtatacaggtaatatgccagatggacgtgaagcttggactccacttgcaccaggagctagcccatcttatggagcagaaaagaacggattacttgcttcattaaactctgtagctaagcttccttatgaatgggcattagatggtatttcaaatacacaaacaattaacccagatgcattaggacacggagaagaagaacaagttgataaacttgtacaagtattagatggttactttgatcaaggaccacatcacttaaatgttaatgtattcggtattgaaaaattaaaagacgctatggaacatccagaaaaagaagaatatgctaactttactatccgtgtatctggatacgcagttaagtttatagatttaacaagagaacaacaacttgatgttatctctagaacatgtcatgaaagaatgtaatttagataaaaatatagcaagaattcattcaatagagacttttggatctgttgatggaccgggagtacgttttgttacctttttaaagggctgccatatgagatgtcagttctgtcacaatccggatacctgggatattaacggcggtgagacaagaactgcagatgagcttttgtctcaagctctaagatataaaacttattggaaaaagggaggcggcatcactgtaagtggtggtgagcctcttctccaaatagattttttgattgaattctttaaaaaagctaaatcaaagggcgttcatgtcacacttgatacgtctggaaatccatttacaagagaagaacctttctttagtaaatttaatgaacttatgaaagtaacagatcttgtaatgttggatattaaacagatagatgaagaaaagcataaaatacttactggatggagcaactcaaatattcttgatatggctaagtttttatctgaaatcaataaacctgtatggattcgtcatgtactcgtaccaggtggaagtgataatgatgaacaattaataaaacttgatgaatttatcaagactttaaagaatgtagatcgtgttgaagtacttccttatcatagtcttgggacttttaaatgggaagagcttggtattgaatatccgttaaaggatgttgaacctccaactaaggagagaatagaaaatgctaaaaagcttcttcatacaagtgaatataatgggtatttatcacgataatttatgccaattaaaatataattaattaataagtctctcattttgagaggcttattaatattcgtttaaaaagatattattggaaactatagtttatttttcaaagcatataaaaataattaagtaaataaaactttgtaataagatataaataatatcattaagcttaaaattagtactcattacaaagcaaagtttaaaaatttatatacattgacttagatttaacttttcttattatctgatttttgtgctttattggtagtaatatcattgtctatattaggtattattgcttcttttatatctggcatatttaatattgagtttttactttgagccatatttgcaagtatcatacttaaaatactctccattgcatttggtgtttttccatcagctccacccatgattactgtttgtggaacaagtggagatttgcttatttttaaggcttcagcaaaagcagttagaacactttgttgtatttgtaattctggtccgccataagcatcaaccaaagctttagctgcagttccttttgctatacctacctttgtttcttgctcagcagtagcttgtgcaacttctttaatattaaatgcttgtgctgtaccaactttttcaagtttgaaagcttcagcactagcttgtaattcaacttgtttagcatttgcagttgcatttaattcagtagcttttgcgttagcagcagcttccgcttcttttgtatatcttgatgcgtcagcttcttgtgttcttttgtatttatctgcttctgcaagtttttgagtttttaaagccaactgttcagccaatcttaattcagatttacctttattatcagcaatttctatatcaatgcttgattgtgtaagtgctgcttgagctgcactttttgcaatagcttcatttaattctctttgtttttctgctgatttttgtttagcttcattagttttaatttcttctaaagcaacttgtctatctcttaattgtgctaatataagatcaatacgcttatctgttgaagaagcagcaggtgtacctattaatacctcttgcaattctaagtcatataatttgaatttttctttcatttcacttgaggcttgttcttgaatagaacttctatcttgaactaactcaattaatgttttagtctgtccaatatttttaaaataacctgcaatcataggatcaagtgactgttcaataagtatttttatatcaccaaatctttgaattacagaagaagcttttctataatcaatgttaaatactacagtaagaggtagatttggctcaaaagcatctttagtaattagattaatttcctttaaattatcatctaatttatgatcacctgattggccgctaatccatttcaatataacattagtggttggaacaggaatgattttacctgcgtaagtattaaatgggtatttacctggcatcatggattctctccatattccttttttaccttgttcaacaagttctccatgggaataacttgtgccagatacatctgctcctttatcaccaaagtaacttacaactactccaacatatccaatatctattatgctttttggaactatatcaacatttgcaaataatcgattgataaagtaaattccatctgttaatacttgcatttgtttaccttttcgaccatttgcagctaagaatttttctggttcttgaaagttgttgtgataaaattcatgagttataccttcaccaactatgggagcaataatagcgccattatctggagtagggccttcatttacagttactattccgatcgtatctttattttttattgaattagaaaattcatcatcttcattattctttgagcttgatataacaactggcataaaaccattaactcttaaaaggtcacttctcattgtttcaatttgagctgattcatcttttgaagtaaatatagaatgaactttatcctttgtaattattataaattgagctaaattaaaagcataagtaccttcacgaaggatttgacgttgaggtcctttttgcccaccgttatttaaaaaggctgttacattttgaaaagatttgcattcagtaattacttttcctagagtttgaccatctttaaggctttctccagaacgcgcaaagacataacctatttgtccttggggaatagttactaatctgacttttcttactcgatattgaaatggtgttttaaaatgaaccccagctctaagaacatctggctgataaccagcttcattttttaaagctataagaccatcagatggaacagaaccttttaagctccaccatttttcaactattcctacttcatctgtaccaattttggtgaaacctactccgtaaagaagtaaacaaagtattattattcctatggctaccattattagaattgatatggtttctgaactcataataacctcctatttctaaatacatataattcaattatttgaattatatgtattatattattctttaacacaggagtaaatactatgaggtattattaagaaaaaattaataaacctaaaaatcaaccttaaaatcaatatgaaggttgatttgttttatttttaataagaatatactggttttagaaaggaaggtaataagttatgaaatcaattattgaagttgaaaatttagtgaaaatgtacaaaactcataaggctgttaataatataagttttgtagtaaaaaaaggtgaaatacttggatttttgggacccaatggagctgggaagagtacaactattaatattttatctacagtattaaaaccagatgatgggcagataaatttttttggagaggacattaataataatatttttaattttaaaaagaatattggtgttgtgcctcaagatttagcaatatatgaagagataccagcagaaagaaatgtacgttttttcgctagcctttatggattaaaggggaaagatcttgatactaaagttaaggaagctctagaatttgttaaattatatgatagaaaagatgagaaaccaaaaagcttttcaggaggcatgaaaagaagattaaatattgcatgtgcaatagctcatgatccaaagcttattataatggatgagcctactgttggaattgaccctcagtcaagaaatcatattttagaatcaatactcaaacttaaggaaaagggagcaacaattatatatacaacccattacatggaagaagtcgaagaaatagcagatagaataattataattgataatggaagtatagttgcggaaggttcaaaagaggaattgaaagaaagtataaaagatgaacgaatttataatatttatgctgataatattgagaatctcagtggaaacatttttttcaaaattgaaggtgtaaaaaaggtagatatacagaagaattgcatatgtataactactttaaatacaattgagaatcttgataagattattttatttatgataaatagtggatgtaaaataaaaaatattaatacaagtatgccttcacttgagactgtattcctaaatttaactggaaaaaaattaagagattaggagatgaaagttatgaatttacttaaagtaatcaaatttgatttggcaaacagtttaaaaaatccttcttttttaattgcatacattttctttccatcaatgattttaggagggctagggtatttaacaaaagacaattatggtgcttataaattttcatctattgatttttatggcataacaatgggaatatttttatgtttatttatttctcaattggtatcaaactcgtttacagatgagcttataaaatcagttaatataagagttatatactctcccacatataaggcatatatatatttatctaaaataatctcggcatttgcatttggaagtattctattttccatatttgcattgtttgaatcttatattttaaaagtaaactttggaggaaataagagtccttatgtattttttgttatgattttatttctattttttatgtgtactttgggagcatttatatgttgcattattccaaatggagatgctgcaaataaagttatcacaattatatgctttttgtttgctgggttaggtggagcttttatgcctttaggtcattttggaaaaattttaaatataatatcgtcattatcaccagtaaaaattgtttcaaaatgtgcgtttgcaataatatatgataatgatttttcaatgattataccaacttcaacattattaataacactatcaattatattgattatactatgtcaaataacttttaaaccggaggaatatatataatgaatatattaaaaattttaaaaaacaatttttatagaattattgaaaaaaaagtataataatactagcatttataataatcccaataatgataatagcctcaatcatcgtatcagataactcagagacagtggagcatattgctcttgtatcaagagattttaattatagtataaataacgatcaattagatattcatctattagctgaacaaccaaaattatatgagcttattcttggagattatgatgcagtggttattgatgatggaaatagacaatttaatatacaaacaattcaatcaaaagaactaaaaagtaatttaaatgagtattttaatcataatgttaagatggatttttcaaaagataaagttaaacgaggaattggtacaaatactttaggatatttggtaatagtaatcttatttgagagtattcttcttatgtctctttatccagaagatagagaatgtggttcatttagaagaatattaatatctaatgtaaaaacaaaaaattatttatttgctcagtgtttgtttaactttgttcttctttttgtacccacatttttaactgttgttataattaataaaatatttaatatatatttgggattaaatttaacagtctttagtttattatttataggaatatgtatattctcagtagctttatcattagtgttaacatcgcttataaaaaatttaaatacatgtataagtatttcaggtggtatgtacgcatttttagggcttttttctggttgtatagttccatttaataatacaagtaaaatatttgatattgttactgatatcataccgataaaaggatttctaatcatatcacaaggtttagaaaatgggataagtatttcaatgtatgttgagcagattatttatattactatttgtacagtagtactttatgttgcaggaataattattacacagaaaaaagtaaatttaggattatattagctggatattttaattttaaatttataatttatggtaagattatattagattatttataaaattaatatttcatcattaggttaaatattaaaaaggtggttaaatgaagaataatataaatataataaaaacaaaacttatcatgccagcacctagaaaaaattatattaaaagaaagcatttacttgaaaaattaaatgatattgcagatcataaagttactttaattaaaggaattgcagggagtggtaaaacgactgcagtctctatttatgcaagtgaaaataatttacaaaatgtaaattggataagtctagataaagaaaatgatgagatttattcattttggtattatttttgtgaatctattaaagaatttcttagtaatgataaagtttttgaaagttttaaggagcttttaacaaaagattctatatacaatcttattgggtatatagtcaatgagctatctaaagttgatgatgtctttattgttcttgatgacttttatcatataaaagacaaacttttaaattcaacaatagaatatctcataacatactcatcatcaaatattcattatatattgcttacaagggacaatcctattctttgtttaggtcagcttagagctaaaggtcagttattagaaattggaccagaaaattttaaatttacacaaaatgaagtaaaaacttttttgtatgatactttaaaacttaatatagatattgatgatattaatattatatttgaaaaatccgaaggatggattacgggtatacagcttatggcattggctataaaaaataatacggtaataaatatttcaggaatagatactagaaatgattatttggtagaatattttactgaagaaattttgaatcaacttacctttgaagagaaagaatttcttattaagagttctattttaaattattttaattttgaaatttgtaatgaagtattgaatataactaattctgaatctataattaaatctttagttgataaaagtttatttatcactttagtcgacaaacaaaataatatctatagatatcataatgtattgaagcaatttttgaatggaagattcataaaattatcaaatgaagttcagaagaaacttcatttgaaggcatatgaagtctataaaattaatgaaaattttgaagagagtattaataatcttttacaaatcaaagaatatgaacaagctgtatctgaacttaatagtcaaataaataattcaaagggatggtattatttaaaacaaataccagttgagtatcttaaagattatgatgaattgataattcagagagtttattatcatttttcaaacttacaaatagaagaatgtaacaaagttatagatagggtaacaatagaaaagttacctgtacttaaagtttttaaagcaatcaacggagatagaaatattgatttttatgaattagattctatggatataggtaatttaaagtataacaatgtaacccaatgtatattatatacatctatattatttgtactgatttataaaaataattataataaagttcttaaatattgtaataagtattatgttattgctaaaaaacataaccttattagtcttagtatatttataaagggtatggaagctacagcacttgaagacatgggcgagctattggaagctttgaatatatataatgaaattagaaatataatttcagataatccaataatatcaaatcttattgtcttatatcattttggtgttgctggaataaacttgaaaatgtgcgaaatagaaaaagctaaaagtgaaatagaaaaagtggaatcatcaatagtaataaataaaagtatgtttgctatgccaatattatatcatgaaataataataaaatttttaagtggtgaatttaaagaaacattgaaattatgtaacgaacttaaagttaaagatcgccttagttatggatttattcttggctataaaatctttcttgatgattatacagaaagtgatttaaatgagtatatcaattcttatgaagacggaattagaaataatatatcttattctattcctgacaaaattatatattctatagctgttaatttatataatgattctgaaaaagggagaagattattggatgatattatagaatattgtagggcaaatagtataaaaacttatttagtagatagtcttatttatatgatattaatattatctgatgatttaaaaaatagtaaaagagaggttttcagttatttaagagaagctatttattatagtatggataataattatttaatgccatatgttttaagtggtgataaattgttaaagataatcatactgatgaaaaatgatgaaagtataaccttcacaactaatgaaagaaagtttgttaataagttatttgatatagataaaattaaaaataacagtaataaagaaattttaagcaatagagaaaaagaagttttacaagttctttcgcaagggttatccaataaagaaattgctgaaaatttgaatatttcacttgcaacagtaaaaactcatattattaaaatttattctaaattaaatgtatcaagcagagtgcaagctgttgaaaaagctaaaaaactttctttgttataagaattaatacaagggcaaaataattagtcatgaatttaccattttaatcacgaatttagttttttattttacaatattcagtgaaaaaatagttgacttagagttaactctaagtgttaatctttaatagaggaaactttgaatattcacgcagaaaggtggaaatataaatgactatttcagaagtcagtaaaaaatataatttaacagcagataccatacgttattatgaaagaataggcttgatacctccagttcatagaaattcaagcggaaaccgtgattttttagaggaagattgtaattgggtcgaatttataaagtgcatgagaaatgctggactttcaatagaagcacttattgattatgtagcaatgtttcaaaagggaaatgaaactgttaaatcaagaaagaatcttttaattgaacagcgtgaattgttagttgaaagaatagagagtatgaaagcaactcttgagagattagatatgaaaattgatggatatgaagaaagatgtttaattaaggaacaggagctttttagaggaaataaagagtaaaaaattaatatttattattgattataaaacaccattcttctctaagttaatagaaaagaatggtgttttttataaattaaatccaatttatttcagcatcttttcttggtgcagttctttgatatttcacatccgggtatccaattactaagcatgttgctatttgcttactatcttcaattccaagtaaatctaatatttctttattatcttgagatgcaactacgaagaaaccactgaagaaagttccaaggcctaatgcatcagtcataagttccatattagaagaagcaagacctgcatttattgatgttggtgaagttacaactattgcaagtggtgcattaaagaataatctgtcattttttactggatcttttttgtattcagcatacatatacatccatatgcgagcatatctttttagacgttctgtttctttagtcaaatttttatcagttaagctagctaatatagattcacctttattctttaagctttcataagtaagagctttcaagtcatcaagtttttcagtaataactgtataagaaacatcttgactatttgttgaagtctgagtaaatcttcctgcatcaataattttagaaattgtatctttttctacttttttgtctttaaactttcttacacttcttctgaattttatgaaattcaaaagattatctggatctactgaaaatgaattcttatcataagaaattacttcttccatattataatcatctgttgaaactgcatttactgggcatatagcaatacaatgtccacatttcatacaattgttattatttatttctgccttattgtctattaatgaaataactcttactggacagtccttgacacattgagaacatcctatacatttatccttgtttactttaaacacacacatacactcctttaagtttaaattgacttttatataactaaaatttataatttgattattagcaaaaaataagtatttatctagtaatgtgagtataacacttataattataatctgtctaatggaatttattcataaaactataactaaaatttatatattattaaaaaattatatattatggcaaataagaaatattataattaggtgttgttaaattgtatgatacatatatttgaatttacggtgacaatacttgtgagaaattgtcagttcatattaaaatcactatgtataatagatggtacttttaaaatttatagcgcaatatatatttaatataatagtataaataggtaaagtaggagagaaaaatgaacttacaacagttagaatattttaaagtaattgctgagactaaaaactttactgtatcttcaaatattttatcggtaactcaacctgctcttagtaaagcaatatcaaaattggaaaaagaacttgatgtaaaactttttgaaagagatggacgtaatattaaaatcactgagtttggaaatgaatttctgaaatatgcagaaaatgcattaaatgaaattgacagaggcaaagatagactgagagaaatgaaaagtagtgaagacaggacaatttcaatatcatctacatattgtataggatcgacgtttataccatttttaataagtagtttttttaatacaaaaatacgtgtgaaatttaatataaataatcaaagtccagcagatatgttaaaagatataaataataaaaaaattgattttggatttatggcttatcatgaagaaattagtagatatcctgaaatagagtctgtattagtacgaaaagaggaatatgttcttatagttcccaaaaatcattcccttgcaaataaggaagaagtttgccttaaggatttggaggatgaatattttattgtgtataatgataaagcatgtgataagaaaatatcttattcagaatttataggatatacgcctaaaatatctgcagagcctactgaagctgctgttctttctggattagtggcagctggagcaggaattgcaataattattaatacgcctattttggatacaagcaggctttcagttataaaaataaaagatgatataggatataaaaatatttatatggcgtggaataaaaatgcatatatgaataatgcaaaaaaagaatttaaagaatatgctttaaaactaatttgattaaaatacataacaatgtgtcttatagaagaaaatatatgttttacaattgaatattcaagatatagaactttacatattaatttactttagataataaaaggagctttataattatgaaattttattttgcacctcttgagggtgttactgggtacatatatagaaatgcatatgagaagtattttggaaaaattgataagtattttacaccgtttgtggcaccaacaagcaacatgtgttttacatcaagagagctaaatgacatacttccagaacataataaaggaatcaatgtaattccacagattcttacaaataacagcgaatactttatttatacaatgaatgaaatgaaaaacatgggatacgatgaagttaatttaaatttagggtgtccatcaggtacagtagttgcaaaaggaagaggatcaggtttccttgctcataaagatgagctcgatagatttttggatgcaatattttcaaaaacagaaataaaaatttctataaaaacaagaataggtgtcaattcaagtgaggattttaatgacattatgaatatatataataaatatcctcttgaagaacttattatacacccaagaatacagaaggatttctataaaaatacacctaatatggatgtatttaaagaagcattaaaatctagcaaaaatcctgtatgctataatggtgatatttttaattttcatgattataaaagagtagtagatgaatgttcagatattaatgctgtaatgcttggtaggggaattattacaaatccgggattgataaaagaaattacagataatgaatttactgataagaagaatttaaaaaagtttcatgatcaagtttatttagggtataaagaaattctttctggagataaaaatgtgcttttcaagatgaaggaattttggttttatatgataaatatatttgaagaaagcgaaaaaattgcaaagaaaataaaaaaagcaaaaagtgcaaatgagtatgaggctgccgtattaatgttgtttaatgatgttgatactaaataaattaatttttaagaattactgttttgttaatatatagtaactgggtttttgaataaaaaaatgtagagatatttgaaagtgatttatattattaagcataatgaaaatagaatattttattttaaacaggtatattggattaaagataaaatccaatatacctgttttaatttcaatttatggaaaacatgatcaataggaaagaaatgttaaatatgagtaaagagagtgataagaaattgataagaggctgtaaagcatgtgtaaaatctattaaaaaacgtttacattaaattgacgatgaattttactggtgctaagatgcaaagtgttgagagaaaaattattaaattaaaaaagcagttatttgttttgggaggtaaaaaacgtggcagaattattgcttaaaaacctatgtaaaaaatatgaaaataattcatatgcagttaaaaatgttaatttagaagttaatgatagagattttgtaattcttgtaggtccatcaggatgcggaaagtcaacgacacttagaatggttgcagggcttgaagaaataagtgagggtgaaatgtggcttgatggaaagtttgctaattatcttgatcataaagaaagagatttaagcatggtatttcaaaattatgcattatatccaacaatgtcagtatatgataacattgcattttcattaaaagtaagaaaggttgataaaaagactattaacgaaagagtaaatgaagtagcagaaataatgggactaaaagaacttcttaaaagaagaccaaaagaattatcaggtggacaaagacagagagtagcaattgcaagtgcaataataagaaagcctaagattcttttaatggatgaacctttgtcaaatttagatgcgaaacttcgtaatcacatgcgtgttgaactggcaaagcttcataaaaaattaaacaatacaattatatatgtaactcatgatcagactgaagcaatgacacttggaagtaaaatagtagtgcttaaagatggaacggtacagcaggccgatacacctcagcagatttatgataatccagtaaatgaatttgtagcaggttttatgggacttccttcaatgaattttattgaatgtactttggaaaaagaagacgcaaagtattcttttaagttaggagataaaaaaataaatcttccacaatttcatagcagagtatgtgatataaatggatataaaaataaaagtgttattgttggtataagacctgaatatatctgtaaccaatttagcaaagaagattttaatgaaaaatatataagtgaagttctatcagtaaaagtagacatgtgtgaaatgcttggagataagacaatcatatattttaaaattggagatgatgaaatatcatcaatcataaaagaaaattcagatataaaatcaggagatacaatagaaatatatatttatacagaaaaaatatgtatttttgataaagaaacaaaagaaaatatactttacgattcagttaagggaggtttgacatttgagtaaaaataaaaaatctttaattgcaccttatggatttattttaccaagcttaattatattttcattatttttattctatccattttttaaaacaatatatttaagtctttataagacagataagatgggacagccaaagctttttgtaggaattgaaaattatacagatttattttcatcaccttcattttataatagtatacttgttacactcatatttgttggaattgttgttataggaagtatggcattaggtcttatgaccgcagtattgtgtaataaatcatttccaggaataagagcatttagtacagcatatgcacttccaatggccatagcatcaacttcagcagctatgatctttagaattattcttcatccatctgtaggtattcttaataagattttaaaattagatataaactggctgacagatccaaagtatgcattgatatgtgttgcacttcttactgcatggcttaatagtggaattaactttctttatttttctgcaggattaagcaatattgatgaatcaatttacgaaagagcatctattgatggagctggaagtatacagcagtttttaaagattacgctaccaggtttaagtcctataatgttttatactcttgttgtaaatattatacaagcatttcaggcttttggacaagttaagattcttacacaaggaggccctggggagtcaacaaatcttcttgtttattcaatttatcgtgatgcattttttaactatcgttttggaagtgcagcagcacagtcggtagttctatttattattgttatgatattaactttaattatgtttaaagtggaaaagaaaggggttaaatattaatggaaggttatcttagcaagcaagattctaaaaaatccattatagctgagaaggaaagttcaaatataagagatattgaaaatctacaatatgtcatgaaaaaaagacataaaagaaaacaatttatgagatctacattgagattatgtgcaaatcttttagttgttttagtagtacttcttccattgctttacgcattaagtattgcattaatgccttcaagtgaggtttttacaacagatttaaatttaatacctaaaaatcctacattatcgaactttagtgatgctttaaggaagattccattgtttaaatttgtaataaattcattcatagttgcaggatgtattacacttggacagataatatcatgttcacttgcagcattttcatttgcatttctcgattttaaaggtaaaaatcttttgtttatgattgtaatggctacaatgatgattccaggtgaagcaactataatatcaaattatcttacggtatcatcgtggaactggcttgattcatacaaagtattaataattccatatcttacatctgcaatgggaatatttctatttagacagttttatttatcgtttccaatagctctttatgaatcagcgaaaattgatggatgctcaaatttgaaatttatacgttccatattaatgcctcttacaaagtcagctataggagcaatggcagtttatacatttataaatgcatggaatatgtacatgtggcctcttcttgtaacagggagtgataatatgcgtactgtacagattggaataagtatgcttaacagcgttgatgctcagtcaataacaatgatgattgcaggggttgtaatgataataataccatcattattaatatttatattaggccagaaacaacttattcgtggtatgttctctggagcagttaagggttaaataatattatttatataaaaacttataattttcttattttgaaaggggaaaaaataaaaatgaagtttaaaaaactattatcagtagcattatgtacagcaattggaataggagtgcttgctggatgtggacaaagttctcaaagtacagcaggaaagccagcagaatcatctgacgcaaaaactacaattactttctggcattctatgggaggggtaaatggtgaagctttaactcatcttgtagacaaattcaatagtgaaaatgataagggaattcatgttgatgcacaatatcaaggggaatatgatgattcaataaataaacttaaaagtgctcagcttggaaatatgggcgctgatgtagtacaaatttacgacattggtactagatttatgatagattcaggctggatagtgccaatgcaagagttaattgataaagataaatatgatatttcaaaaattgaacctaatatagctgcatactatacagtagatagtaaattgtattcaatgccttttaattcatcaacaccaatattatattataataaggatatgttcagtaaagcaggggtagataaagcacctgaaagtttcccacaaatcgaaagtatttcaaatgatttaactagcaagggaggagctcaaaatgctatttctcttggaatatatggatggttctttgaacaatttatctgtaagcaaggacttcaatatgcagataatggaaatggaagaactggtgcagctgatgctgttgattttgataaaaatggttctgcattaaatatcttaactgcatggaagagtctttatgataaaggatgtacagcaaatgtaggacgtggaggagatgctggaattgctgatttttcagcgggtaaatctgcaatgactttaggatcaactgcttctttaaaacaaattcttcaagatgttaatggtaaattcgaagttggtactgcatatttcccaagtgttgtagatggctcaaaaggtggagtttctattggaggtgcttcattatgggcattagataataaagatgaaactaaaaaagatgcttcatgggaattcattaaattcttgatttctccagaatctcaagcatattggaatgctaatacaggttatttcccagttacaacagatgctcaaaatgaacaggtatttaaagataacattaaacaataccctcaatttgaaactgcaatagatcagcttcatgcttcggctccagaatatgctggtgcattattaagtgtattcccagaagcaagacagataatagaaactgaaattgaaaatatggttaatggaaaatcatcaccagaagaaacagtaaaatctatggctgatagtataaataaatcaattgaagagtacaataaaattaatggttaatattaagaagttgtagtctagtgcataaaaaaacatagcatatttataaatacaaagaagctttatcgagtaaaaaaattatcttgataaagcttctttatatttgggttactatctaaaaaattatagtataaaagataatacagaaataaattttagctttattagttttagaaaaatctgtatatttaatttgtgagaataagaaaggaggatgtcaatgatgattaattgtatgaaaagaataaataagttttttagaggtgttataaaaaacacagaatgaaatatttgtgagggatagtgaaatttaaaatgaaaaaattatttaaaataataaaaaaacgtatgttaaatctatggggatatgaatttaaaggttcagttagaactataaataatctggaaagttatgtttatgagaaaacaaaatacaatgctgatattataaatagaagaatattgaaataatgtaattttgtgatataatagagaaatatggattaagtgaaaggaggcaattaaaatgtgcaaattagaaatgtatataattaataaaagttataggggattgtctctttagaaattactgaaagttaatcgcctagtatattttattaatttataaacttagatatgaaacgaattctaaggggttgatataatgaaatatgcaaaggccaaggaaatactgccacaagcattaatacaagaaattcaaaagtatatacaaggccagtatttatacattcctaaagatgagagcgaaaaaaaatcttggggtgaaaattctggctctaaagaagatactgcaacaagaaacattgagattaaaaagaagtttttacaaggtatcagtaaggaagtacttgctgaaatgtattgtttatctgtatctagtataaaaaaaatagtatattaatataagttaaagtggtgctttaaaaggcaccactttaatttatatcataaacattactagttaaatttaaagtataagattttatagttagatatacacttattttgaatttaataaatttttattagaattgtttccatatgaaacttgtgctgattttattaataaattaactggcaaaactaaaagaacagctacacaaataacaccttcagcaaggccaagtaatccattgacacttagggagtaaatccaaggagatacaccatcaggtgcaaaacttccaaagaaaactacaccagaaataaaatgaaagaagtatcttgagaatacagctataacagcacctaaaattcttttgttaggaaagaaaccagccaaacctaaagataagtatggtaatggataatcaaataaaacttggataggatgcaacatatatggattaaagaatagtgaaagtattccaaataaaaatcctgtaagcattcctactaaaggaccataaatataagatataagaatgattgggaccatagaagctaatgtaacgccaccaccttgaggaaaatgataaattttaagcaaatctaaaattgtagtaagtgcaagcgttagtcctatcatagcggtcattttaggattaaactttatgtttttagctttgattaagagaagtagtattatgccaaaggcaattaaagttaagattgatactgggtttttaaatatttcagagatattctgaggtaaattggtaaaaatctcatacactttactactgaattgagaaaaaatttcttttaatgacatcatggtaaacatcccccttttaatatattttatatgggagtttgtttctaaataaaaaaaacgtattccaataataggaatacgacttgattaatattcaaaacacttccctacgctggttctaaccagatcaggtgttgagggttagtgataaaatcacctctcagccaaaggcacccctagcacacttattaacatttaccatctaaagtatatatctttctgaagaattaatcaataatatttagatattatgaagatggtacctaaaaatagttttgtataaaaatatatgattattatacattggtactatttgaaaaagtctttaaatgttgaatattaaaggaaggaattgaagttattttaattcatttttatattggttaaacaatgcaacatatctgtcgataaacccttgacctttattctctaaataatgaacaatatcatgttgtcctttttcttccatttccatcacaatattagtcccgtaggaatcttgatagtaggttccaagcttctcatatactttgttgatatcattaccatttttattacagtaactttctataagatttataagataccttccattcatttaatttcatcctttcttaaatatcaatatacatataagcttattgatattattgactttcatataattttttaatcgattactatagtagattttttaatgaagggatttatcatttattccttaatattagaatatccaatatgtacagcttttgttaatactaaaagatagtaaagtgaaattttaagaaatagtatacaatttataataaatgtagtttttataggttagatttttttggtaatagttttatttgattttttaggacaggtataattaaatatataatcatagtaatataatgtgtgatagaattaagtatagatttagaaatgtttagtttttagattatttctttatagtttattgtgaagaagggatgagaaaatatgattataaatagagaaaaagctaaaaaagtttttgatgagtatgtaaaaatgtatgacagtgataatgagatgataaaattaaaaattgaccatacatatcgtgtaagtaaactttgtgaaaaaatagcatttagcttaggatttaataaaaatgatatagatattgcatggcttcttgggcttttacatgacataggaagatttgaacaggtaaaaagatatggtacttttaatgatgcattgtctattgatcatgctgtactaggtgtagatattttgtttaatgaaaataaaattcgtgattttgttgaagatgatagtgaagatcaattaataaaaaagctattgaatttcataatgcctataaggttccaggggaattttcaaaacgtcttatggatttttgtaatcttttgagagatgcagataaaatagatatcttcaaagtaaatattatggtgccgccagagtacgtatatggagtaagtaaagatgagttatatgattctactattacccatgaagtaatggaagattttaagaaaaagaacactgtacttagaaaattaaaaagaacagcagttgacaacttagttggtcatatatcattaatttttggacttgtatataatgagagcatagaaattgcagtggatatggggatttccagcaattacttgaattcagatccaagaataatattactaatagacagtttgaagaaattagagaattaacgcataaatatattaattacaaaatagagagtagataataaaatatttgaaaaacatgtttcataagataaataaatttattgtttcttatgaaacttgagtttcagtttttcctaatcttattggaatatatataaatatcgatataatgatttatataaaatactttataataaggtagggggaaaacaaatgagcaaaataaaagcaattgttatggatgttgatggtacacttacaaatgggaagaagcaaattcctgaaaagacaaaagaggtacttttaaaagcccaatcaaaaggaataaagttaatattagcatcaggaagacctacaactggtctgatggaatttgcaagagaattagaaatggacaagaacaatggacttctagtttcattcaatggatcaaaggttgtagactgtgagaattttgaggaattatttaatgaaccaatgagtgtcgaagatggaaaagcagtccttgagcatatgaaaaagttcaaagtaaagcctatgattgataaaggtgagcatatgctagttaacaatgtttttgataatatagtgcatatgaaaaatggaaatgaaataaatattattgaatatgaatcaagaggtgggaattataaattatgtgagatagatgatcttgcagaatatgttgattatccattaaataaaatacttactgcaggagatgcagattatttaaaagaaaattataaagaaatgatgaagccttttgaagataagcttagctgtatgtttacagcggaattttattttgaatttactgctaaaggaatagataaggcaaaggcattagatacagtacttaaacccatgggtataagtgaagaaaatataatatcttttggtgatggacaaaatgatttatctattataaaatatgctgaaattggtgtggcaatggaaaatgcagttgatgaattgaaagaatatgcagatgaaataactttgtctaatgaagaagatggaatagcgtattcgctgctaaagcacataccagaattaaattgttaatattagaattataatttataatgttcatgaggtgatcttatgaacattttttttaaaattgatgaattagtagacttaacggaaaatgaaaaaatattagttgaatttataaagagtaaacgttttgagtttgcagagttagaagttgaagatatttgcaatcagtgctttgtatctaaatctactatatatcgtttgtgtaagaagttgaatcttattggattatcacagttgaaagtagcagtatcagcaggggtgaaggattatgttcaagagcaagttgattatgattttccaattaaatcaaatcagacccaaactgaagtattagatagtttaaaaactatttatagaagtacaataaacagtacatataatttaatggatttacaagaattaaattatatcgcattacaactaaaaaaagcaaatgttatagacatttatacatcagctggaaatatattttttgcagaaaactttaaatttcaaatggcggaaattggagttaatataaatgtgccagaagaagaatatctacagcatttgacagcttcgacaagtgataaaaatcatgttgcaattgttatatcatttggaggcagaggaagatgtacaagtagcattattggtcttttaaaggagaaaaaaacaccgattattttagtaacatctactgatgataatcctttaaagaaatatgcaaaacatattttatatatgagttcctttgaaaatcactttaataaaatatcatcattttcaacaaggttgtcattactatatattttagatgtaatctacggatgctattttaagcttgactatgataaaaacattaaatataaaactgatacatataaaagaatgaggaaatatccaaaagattatgaatgctgataaataaagtgaaaatatttcattcaatataaggaacattatatataaaataagaataatatattatataaataaaaaaagtattgacaaggatacaatataagattagtatcagataggataaaaaaataaatttgttaggtgaggctcctataaagatatatgccgctacccagaaaaatcgagagattccaatgggttaacagaaattatcgcaaaggtaatttttaatgtggctgactagaaagtcaaagctctatagtgctaaagctctacaactaagtaattatatattatttagcgttaatagaacttttaaattatggatttttaggactttttagtgatgagctgaaaagtcttttttatttactattatatctaatattataaagtgtagttgttatagtgaaactcattcatataaattagaaattagtttttagctaaaatatacttaaaaataatttatattttaaaaaagagattttagaaaagcctgtgcctttcaaatacaattgtcaataaaacaaggggggaaagtaaatggattcagatgccagtaagacgaaaagaatcactggaaaattgaataaaaataatgaagatgatgaagtttgcttgccgcaatttcttcattgtcttgtaagtattggaggatgtagaaatgaattgtgtaatgacaaaagaaagactattagaaattttactttatggaagtgataaagagttacaggaagcaataaataaaatccatccagcagatattcttgatattattcatgatgaggaaaatgattttgttaaaatattaaacagacttcctgattggatgattgcagatattatcgaagaagaagaggacgaagaaaaatatgaaattcttaaaaatttctcggaaaataagcaaaaaaatattttaggagagatgttttctgatgaaataactgacatggtaggggctttagatgaagaggaatccaaggaagtactagaaaagatagatgaagatgaaagaaaagatgtacagaaattattaaattatgatcctgatacagcaggaggaataatggcaactgaatttgtttctattagagaaaataaatctataggagaaactttgaaatatcttcaaaaggaagcaccagatgctgaaagtgtttattatctatatgttgtagacaaaatggatattttaaaaggagttgtatcattaagagatatagtatgtacacaattcgatactaaaatttcagatattactaataacaatgtaataagtgtaaagtatgatgtcgaccaagaggaagttgcaaatatttttgaaaagtatggattcttatcaatgcctgtagttaatgaaaacaataaattattgggaatggttactgctgatgatattatggaagtattaaaagatgaatcaacagaggatatacatcgtcttggtggaattgacaaagaagaaaaggttgatggaacattaagtgaatcaataaaaagccgacttccatggttagttataaatttaattactgcaatacttgcagcttctgttgttggtgcatttgaaggaacaatatctcaagttgtatcacttgctacttttatgccaatagtagcaggtatgggaggaaatgcagggactcaaagtttgactatcattgtaagaggtatagctttaggtgaattaacaggagaaaatgcatggagaatattctttaaggaattattagtaggacttacaactggagttgcaattggtgctattatttgtggattaggttatatatgggaaagaaatatgatttttggaatagttataggaattgctatgatattaaatatgatggcagcaactacttcaggatttattgtaccagtcgtattaaaaaaactaaaagtagatccagcacttgcttcagcagtgtttgttaccactgtaacagacgttttaggatttttcttctttttaggactagctacaatgtttatacaatatttaatttaaaaatattaaatattaataatatatgatttggaagtttatatgaaaagttatatagaatatttatgataatgatcttaatgattatttagggaatattaagcacttgcttatttttgataggcaggtgctttttttatattgtcttgtttagaaaatttttcatatataaataaattaaaaaaatttaaaaaaagtgaaactttttatatagtgtagaacgtctaataatatgaaaggggaaagaactgttatgaacatattgattataaagatgaatttatttaagatcatataatttgattaaataaatcttgattaaataaacatacattaatgatgaaagagaaaggtgtacaagtaatatatgagaaaaagacgagtaaataagaaaaaaagaatgatattaacactagtatgtttgattttcatgggagcattaatgtgtaaagcatgggcttcggtggatggtaaagtacatataaacaaagaacagactaaaatggaagaagaacaaaaaataagattgcagaagaaaaaagtagacaagaagaagagaaaaaaggattgaagcggaacagagaaaaattgaagaggaaaagaaaaagaatattgttggagttaaagcagaagcagaaaaattttcatatgatgctgcaaaagtagccgaaaaattaagtagatatgattattctaatgatgggaaaaaaatagtatttttaacttttgatgatggaacttctacaactgttacaccagaaatactaagaattttaaaagaagaaaatgtaaaagcaactttttttctgactggacaaaatattgaaagcggtggagataaggcaaaaagtcttataaaacaggagtttgatgacggacatgcaattgcaaatcattcatatagccatgattataagattttgtatccaaatagagtactaaatttagaagcttttaaacaagattttaataaaacagataagatattaaaggaagtattagggcaaaacttttcaacaagagtgataagatgtccaggaggttacatgtcatggaagggaatgggtcaattagatgaatatttaaaggaaaaaaatatgttttcaattgattggaatgctttaaatggagatgctgagggaaaaagaaaaaatgcagaagaattaaaaaattatgcaattaaaacagcagaaggaaaagaaatggtagttattctaatgcatgatacttatgggaaagaagaaacagcaaagtcattacctggcataataaaacattttaaaaataatggatatgaatttagaacacttgtataaaatcttaacaaatttgatcaaacaaaaaacatatatttaattacagtagcacattattaattgagggttaataatgtgctatattcattaataaatagattactcatttcttcatggattttaaccaataatctttttgttcagatattatattaattgaacaaacaccttttttgaaccattcacaagtattacaaatattacaaaattttttagggttatatcttttataaatattgtttattatataagaaaaatcgtattcagtatttatatttaatttatattcttttaaagtcttgttatctaataatcgtactttatcatggaaaaggcaaacatctaaggatttactaggacagtgactgcagatcatatcacactgggatactaatttaatttttacattattgtctttaattagagtattttttatattgttcatgttactagtaaagtcgtaattgtagccaagtcctttaaaaaagaacaaacaatttatatgatgtggtctgataatcagcatgaaaaaacctccagttagtacgaatatagaacttttagttataaaaattattagattttttaaacatattaaagtatctatacataataatactataacaatttatattgtcaacttaaaaaaaatataggtaaacaatagtgaaggatttttaatatagcataagagctattattaagaagatagtaatagctcaattaacatttgaagtttttattatgagtaaaagttttaaatgttaagaagttgatatttttttgtgcttaactaaatttgatgatataaaggcggttaaaggtatgatcaaaacgatacctattccacagcatatggattgaaaaaattctgagcagaatacttttgcatttattatagtacttagtgagtaatgtaattgtttgaaatagatcataagtgtcataaaactgcttatatatgcaaaaaataatgtattggtcattgttcccaaaatatcttttccaatattcattcctgatataaaaagtttacgagtactgatttgaggattagcattataaagttcattcattgatgaagatatggaaatagatacatcaataatagcaccaagtaatcctattaaaacttcacaaattactattttggaaaagttgagttgaacgtacaaattatagaatgacaccaaatctgtttgctcagagctgaatccctgtatatttgaatttatacttgttttatatacacaagccataacaagtaatattacaatgataacagatatgagagaagataaggtttttctgttaaaaccattaagaaaaaataaactgaaaaaactaattattattgcaccaacaaatgttgtttttattggatcaatttttgctgcaattaatataagcataaaatatagtgtaaagaaatttaatataagagtaaaaaaagattgcatcccacgttttcctccgataaaaatcatgagaataaaaagaattataagtaatattaggataatattcataaattaagcctttcttatcttgttatatttatagattattatggaagtaaacattgtaatggggatgcttattacaataccgatacttccaacaatagcacgcatatactctagtgaaagatttagatgaagaatatatgtaagtggaatgttatttcttaagtataaaagaattgttggaatacttcctccgatatatgcaaatacaagagtattagacatagtacccattatatcttgtccaatttcttttacagatttaattagagttttgttatcaatatctggatttttactatataattcagtaacagcagaagcaatagatattgcgatatccataattccaccaagtgtacccactataagttccacaaagaatattgattcgggtggaatagtaagataatccatttcttcaaagtgtattccattccagttatttaagtatattactgtaccggaaataagaattgatacgaatgtacctgagagtgtaccaataatagcagaaaaacttttattactttttccacaaacaattaaaattgaagatacaataaacagtatacttgcaccaaatgaaataggaattaggtatgaactttcagcaaactgtacaattaaagtaaatgtaattattatatttataaaaacactaacaagtgatagaaaacctttagttcctccgattattatagcaagcataacaaatatacttaagatatataccatatatttgtctctcttaaaatctgttatattaaaagaaagattgttaacatcattgttaatcttgataaacacttcatcattttctttaagatccaaatcattggcatttgaaaaagaagtttcattatttaaatcaataatttttcctttgaattctccattcattataatagctttaattttctgaattttcatttgttcagtttttccattatctattgctttatcagtatagctttcattaattgaaaggatttttgcaattggtgttttataatacttttcattattgttaacaaatgcaatgctgaatatgaaaatgagaaagagccctgataaccatactaatttttttttatttatattgtttaatatatttgtaaacatgtaatacctcattaattgattgaatttaacttcaatcataggtgttaaaattttcataatttaacctttggttattattgtaaaatcattaaattaaattgtcaatgcattacttaaatatagaaacaatagacaatatattgacatgtaagaattttactgatattcttaatgaaaaaatagcaaggtgatgaatgtgaaggaacaaaaggaaatgcaggggttgtattttatttttgcatggaggtccaggataatctatgattgcagaacttcatatctatcaatatatatgggaaaaagattttgtatttgtaaattatgatcagagaagtgcaaatatgagttattatttgaataagaaaaattgggaggaagtatctaaaagtataacatacgataatttaatgaaagatgctaaagaggtagtagattatttattaaaaagtgctaagagtatagtttttgtagaataaataataaattcattgtatctattaatagtttggatttagatttagcttatataaaaaattgaacttataagattgaatcaataatgagagggatggggataaatgagaaaattaagaatagttttttcatcgatgatttgtgatgcaggtgaagttacaagagctttagagttagcggagggaataagacagtactgccctttagaatatgatgcagaaataatttttacgtcaaatggaagtagatttgaagataagataatttcatcgggattcagtatatataagtgcagtccagtgcttcctggcataggatttcatcaggatatgaagccgactgatgtagatataattggagatgtaaatcttgttacagaaatgctcaaaggtgaaataaaagctttcaatgatttaaaaccacatatagtaattcatggattttatcctattgcaagtcttgcaagacgtatgatggatgagaaaatattgggtatatgttatattcctcttccactaagcaaggaaatgcttgagagtagtatgataagagatattccagataatataaggcctttttcatatcttcctaaaactatgagaaaaatattagtcagaataattccaaagtcattgaaaagtaaagctcctacattaaagcagaggaacataattgaaggtcttaaaaaattcaactggaatgatgagcctgtaaacaatctttttgacatgcttaagtcagattttactatagtaaatgattttaatgagttttataacaatgtaaatctgccagaaaattttaagataacaggaccattatatgctacagggaggtacaatgaaatagacaaaaaaatattagaagtattcaacaatgataataatagacttaaaatattttgtacacttggaagttcagggaaaaagcaatatcttactgaggttttaaaatgtcttacaacaggcattggtatgaattggagcgcagttatactagccccaccatcggtatgtgatataaatgaaataaaattttatgaagaaataaataaaaatatctatattacagataaatttatttcagcacccgcagtaaatgaacttgcaaatcttgttattagtcatggaggtcagggaacacttcagacagcaattgcaagcagaactccagttgtgggatatggaatgcagatggagcaacaaataaatattgataatttagaagcctttggttcagcaataagaattcctatacacaagtggaaagctgaaaacatacagaaggcagttataaaaattgtaggtgatcctttatatagaagaaatgcagaaaaattgtctgaaatcttaaaaaatacagatggaaagaaaaatgcagcagaggcagtatggaattttatattgaaaaattatcatatttaacttcaggaaacgtagcggagaagaagacctgtgtcagatagaccatgaagctgatgagtagtattagtataaataaggaaacgcttttactgagatagttacagtgtatggattgaaaattaaattaaaaaatgaagtgataatatactagaaacaatatagccgattgctgttgcaagtgcagccccatccacactcattttaagtccaaacataaaaattacatcaagacaggtatttgttactatacttcctagaaaattatacattgccactaataggaattgcattatgctttagaagtatactgtcattagtagcatcattagtaataatttcttttatatactcatatagaatcataatagaagaaaaagcaatggaaaaaagttttggacaagagtatctttattatgaaaaatctacatggagaataacaccatttataatatgatatacatttaagcaattagggtttgttcgaaattgaacaaaccctaattatttcatgtcattttatattggaaattttgtttgattactgaattaaatatatcaattaatttaaataaagtttagcttctagttcatttgaaattgcaagattgtatatataagcattacttacttcgttaaggaatgcttgtttcatttcttcggataaattcatatcatctattttttgagcataattcattacataaccacgaatatctttgattgaatcacaattatagtaatttaaaccttcactttctacattataatgagtgcttaataaggatgcaaatgttctcccaccaaataaatcagcgataaaacgagtgtaagcataagcaactataagttcaggacttaaaattgtctaaatcaagaaaaattaatgcgcatttagaatttttattttgtttaagatatttttcaacttgtgtgaaaaatacagatttattacatgaaaaagcataaattattgacttataaagaattatattataatatttaattgataatgaatatcaattaaaaacgaagggggaatttatgatgaatataataattggaattctaataccatttttaggaacatcattaggagctgcatgtgtttatataatgaaaaaagaaatgaatgtttttattaataagatgcttttaggatttgcttcaggagtaatgattgcagcatcagtctggtccttgattatacctgctatagatatgagtagtcatatggggagactatctttcattccatcagctataggggtaggagctggaatactatttcttttaggacttgataaattagttccgcatcttcatgcttatagtgataaacccgaaggtataaagcaaaatagtttaaagaagagtacaatgcttgtattagcggttgttatacataacatacctgaagggatggctgttggaattgtttttgcaggtgctttaaatgaaggtacgctaataactcttgctggcgcttttgctctttctattggaatagcaattcaaaacttcccagaaggagcaataatttctatgccgctaaaaagccaaggaatgagtaaaaatagaagtttttattatggtgttttatcaggaatagttgaaccaattggagcaattattacaataatgttttcaagcattattacacctgtaatgccgtatcttctttcatttgctgctggagcaatgatttatgttgtagtagaagaacttattccagaggcatctaaaggagaacactcagatattagtacaattggtttttcagtaggatttataattatgatgattttagatgtagcactgtcgtaaccttaaataaaataaatattatatgtgtagaaagtgataaaatttatggatattcgtagattttatcacttttttagtaataaattatttagtgtcttattggagctatatatctttttggagtagaaagtcagttgatttaggggtattatacaaagtgtgggaaattattgaagataaagttttgcgttgataatgataatctatataaataaagagaaaggaagatatataaatggagaaaaaacaaatatcaaatgtgaggctgcttgattttgcaggaaattataaaatacttactattttagggtgtatactttcagggattagtgcagtattatcattaggtccttttatatgtatatggaaggttatacaagaaatctttagagtacttcctaatatatcagaagcagataatatttattattatggcataatagctgtaatattttctattgcaagtatttttatttattttttagcactaatgtgcacacatatatcagcttttagaattgctagaaatatgagaagcatggtattaaggcatatattaaaacttccatttggttattttgataaaaatggaagtggaaagataagaagaataatagatgaaagctctggagaaactgaaacatttttagctcaccaacttccagatatgactggagctatagtaacgcccattgcaatgatagtattattgcttatatttgactggcgtctagggttaataagtttgatacctattgctattggagtagcctttcttaatgctatgatgggaagtaaattaaaaacatctatggagcaatatcagaatgcactggaaaaaatgaacaaccaagcagttgaatacgtaagaggagtaccagtagttaaaacatttcagcagagcatttattcatttaaaaatttctataatgctattatggaatataaaaaatggactataaattatacgatttctatgagaaaaccaatgtgtagttttacagttagtatcaatggaatatttgctctattaattccagctggaatacttattattggaagtgcagtagactataaagaatttcttttaaattttatattttatatattgtttacgccaatatgtactgtaatgatgacaaaaataatgtttagtggagaaaatatgatgcttgcaagagatgcagtaaatcgtataagtgaaattttaaatgaaaaacctttagaagaacctgaaaaatctttcatgatacaaaactatgacattgaatttaaaaatgtttcatttagttatcctgggcaatcagaaaatgctattgataatataagctttaaaataagagaaggaagtacaattgcgttagtaggtccctctggaggaggaaagactacaatagcaagtctaatagcaagattttttgatacagacaaaggaagtatttcaattggcggtattgatgtgagaaacatgaaatgtgatgatcttatgaataaggtatcttttgtttttcaaagcacaaagttgtttaagacaagtctattagagaatataaaagtttcaaaacctgatgcatcaatagatgaagtttttaaagcagctgaagcagcacaatgtagtgaaatttttgaaagaatgccaaatggaattgatactatagtcggaaataaaggagtatacctttcaggaggagaggcacaaagaattatacttgcaagggcaattctgaaaaatacaccgataattattttagatgaagcaacagcatttgcagatgctgagaatgaataccaaattcagcttgcctttaaagaattaacaagaaataaaactgtaataatgattgcacatagactttctacaataagaaatgtagattctataattgtattaaaagatgggaaaataaatgaacaaggaactcatgatgaacttatctcacaaaatgggttatacaaaaagatgtggatagactatgaaaattcaattaaatggaagatgaatagtgagaaagaatagagacattgaagggaggtaatataatatgatacattattttcaaaataaatttgccttaagtgaaaaaggtgcaagggaccttatgagtgcgagtatttcttgtacttttacaaatttaagtcttatgattccaatagcgataatttacctattgttagaagaactaataagtcctatttataaaggaatttataaggagcccaatatattaaagtatattttattgtctacattagcattgagtataatatatatttttcaatacattcaatataataaaacttttttttcatcatataatgaaagtgcaaataagcgtatttttctagctgaaaaacttcgtaaattaccattatctttttttgcaaagaaggatttatcagatttgacaacaacaataatgtctgattgtgcaggtattgagacagctttttcacattatattcctgaacttattggttcagtactaagtgttgtaatagcaggaataggattgttattaatgaattggaagatggcaatatcacttctatgggttgtgcctgtagcatttataatagttgtagtaggaaaaagaaaacaagataaaggaaacatgaaaaataaaatatcacaacttgaacgtgcagataaaatacaggaatgcattgaaacagtccgtgaaataaaagccaataatatgtcaaaaaagtatatgagtgaactgaatgaatatttaagaaaatctgaacaagatagcatttcggcagaacttggaacatcaatgtttgtaatatcagcacaaatgcttttgcgtgttgggattgcaacagttattcttataggaggaaaacttcttataaaagctgaagtggatttgctaacatttatagcatttttgatagcagcatctcgcatatttgatccattaagcacatcacttattaatcttgcagctatatttggcacattaatacaaataaatagaatgaaaggaatagaagaatataaatttcaagatggtaaagaagaaaatataaaaaataattttgatatatgttttgatcatgttaaattttcttataacgatagtgaaaaagtattaagggatgtttcatttacagcaaagcagggggaggtaacagcattagttggcccatctggtggaggcaagagcacagtagcaaagcttgcggcaagattctgggatgtagatagcgggagaataactttaggaggatatgatatatcacgtatagagccagaatcactgttgaagaattattcaatagtatttcaggatgtggttttatttgacgatacaattatgaataacatacgtttaggaaagagggatgccagtgatgatgaagtgataaaagtagcaaaacttgcaagatgtcatgattttattgagaaaatgacagatggatataatactgtaattggggaaaatggatcaactttatctggaggtgaacgccagagaatatcaattgcaagagcacttctaaaagatgcggatgtaattcttcttgatgaagccacagcttctcttgatgtggagaatgaaactaaaatacaagaggccataacaaatcttataaaaggaaaaactgtaattgtaatagcacatagaatgagaacaatagcaaatgctgacaaaataatagttcttagtgaaggatatgttgcagaagaaggaacctcaaaagatcttataaaacaagatggaatatatgcaaaaatggtacatcttcaaaatatgagcagaaggtggtcaatttaaggcaggtgaaattatggatgctactcaaaatgaaaagttattttatggtagtcaagtgaaaatattaaaacgaactaaagagtttaatatatatgaattaaaaaatgaaactggctatgcaataatgaagagctatcatttatttgatgggattgatttaatatacaatgacattaatatgaataaaataagcaatgatttatgtatgccacctggattttttgaagtgaatcactgtcaagaaggaagaatagaatgtgaattcaatagagaatgtctttacatgacaaaagatgatttttcaattaatcgaaaagatggaacatgtcataaatcatactttccattaagtcattattatggtatttctatttgtataaatataaaaaaagcacagattgagatagatagatattttgaaagtaattttatcaacataaaaagtttatgtgataaattatgtggtgagagtggatttttgcttatgaaatcaaatgaatcaatagggcatatatttgcagagttgtattcaataccagaaaaaattaagtttcagtattttaaaattaaagttctggaggtaatattatttcttagcgctttggatggaaataataatgaaaagaggagttattattctaaaagacaggttgataaaatcaaagatattcaaaagtatataactaaaaatattgaaaaaaatatacattagatgagttatcggaaaactataatataggattaactacaatgaaacagtgttttaaaggagtttacggtgagaatatatattcatatattaggagatttcgaatggaattagcagcagaaaagcttatgggaagtgataatactattttagaaatagctaattctgttggatatgaaaatggtagtaaatttgcagctgcatttaaaaatgtaattggaatatcacctaaaaaatttcgaacactaaaaaataagaaggaagtatacaattatacaaaaattactgaataagaaaagcgtattgtcataataaaacacgggaattaagcatgctttataaaaagttactttaattctcgtgtttattaatatttaagagatatttaaaagatcagaacttttacaattaaaatttttatatgtattagttacaatatcatcccaattaataagtacagccttaactatatcaggatcatacattattgaagaatttttagcaagttcatttttacattcttcatcattcataatacttttataaggtctctcgcttttcattgcatcaatggagtcacatacagcaataattcttgattcataaggaatttcatcgcctattatatttagaggatagcctgtaccattataacgttcatgatgatgaagaactatcttggcgatataagataaacttttagattttgataatatattatatccgatagaggaatgttctttcattttcatccattcactatctgtaagtttacctattttatttaatatactgtctggaatgcctatcttccctatgtcatgaagatgtgcagcaatatggagtatttcaagttttatatcatctaactttaaatacattcctaatttatatgacatatcaccaactcgtgtagaatgaccagcagtataaaaatcttttgcatctaaagcagcagctagactatctattaagtcatggtaaaattcattttgtaacatatattcatcacctcaatttatacataattacaattacaaatattgattgcaattgatagaaaatatcatttgctaatttatagtaattataatatagatttatcaagtattcaatagaacagtgatatttaagtttattaaattatataattaagtgagaagttatccagttaaattacacaaataaatgttactttaatatttacaaaatatgctataattaatttcaaataagatatattagaaatggggcaaggataatgaaattgagagtagcaaaatctgaagacgcaaagcaacttgttgagatatacaaattttatgttgaaaagacagacataacctttgaatatgaagtcccaactgtagaggaatttgcacagagaataaaaaagacattagtaaagtatccttatatagttttagaaaaggatgatattatattaggttacgcatatgcaagtgcatttaaggaaagaaaggcttatgactggtcagttgaaacatcaatatatgtaaaagatggagaacgtggtggcggaatcggaacgcttctttacaatgagcttgaaagatatctcattaagcaaaatattattaatgtaaatgcatgtattacacatccaaataagaaaagtgaattatttcatgaaaagtttgggtataaaaaagtagctcattttacaaagtgtggttataaatttggagtatggaaagatatgatttggatggagaagtttataggagaacataaggataaacctgaagaaattatagaattttcaaagcttaaattataaaagtactgcattacaaagttatatagaattttgtgatgcagccataatattaacaatgataacaataaacaattgataaaaagttttaatttcatattgattagtagttaaggggtaagttataatttacagcatcataattatagtttgaaaattttagtctttttagaaaaacaaacttagttataacccatgatttaacagtgattacctatatatttgatagcttaatgtttttttaggatagaaaaataatagagaaattagatgacatgagagaattgaaaagtattcaaaatcattactagaagcggctttacagactgatataatttcgtaaaaaaaatgtgctttaaaaatataaagcacattttttttaatcattttattattttaatttaaatgatttacaatctgtacattcactcatagtaggattactttcgtgagttcctacttgaatttcatttaatgtacaataatcttttgattgtgcatgatgtgaacagttatttacagaacatttgatacatgaattaatatccataaaaaatcactccttttctcttgttacaaagatagtattacacgtaattctaaaattattcaaagaagttaaataatgacaatgattatcaatgtcgtacaatgttattatgtgatgaaattattatatttatgttagaaaggaatacgaaatagaataaaagttaacacaaaaacaaataatatgacaaaggcagtataaggataaattcacatttatattagagtgcctatatcataatttaaaaggaataacagctatgtatacttttaaaatgattcagtatacatatttattatataatttatttaaaatatatattaaacagaatgtagatttaaaatatttaaaataatgtttgcaatatgtttaataaagtgttattatgaataagaagtaaaaagaaaaaaagaaaaagatttttatagatttatacatttctccttaatagagaattatattagtcaatattggtctttaatgaaggagagttttcaatggaagataagacaattgtatgtaaagattgtggaaaagatttcgttttcacagtaggtgaacaagaattctacaaggaaaaaggttttgataatgaaccagtaagatgtcctgattgtagaagagctagaaagcaacaaaacaatagaagataattttatttgtttaaagagtcattacagatttgtaatgactctttgtttttgtaaaaatagtacaagtataaaacatgatgtgaaaagtaacagaaaaagtgataattcatagaataattaacccttctcctaaactcttcagaaatattgatagtaaattttggacatgttactatgagtttacaaaaacattgaagagaggatgaagaaattatgatgcagaaaattcaaaaatttggaggagcaatgttcacaccagttttactatttgcttttgctggtattacaataggtgtaggaacattatttacaacagaagctattatgggaagtttagcatctccagaaaatatgtggtttaaatgttggaatgtggtattacaaggtggatggacagtctttaatcagttaccattattatttgtagttggtttacctataggtatggctaagaaacaaaatgcaaggtgctgtatggaagcgcttgtgttgtatcttacatttcattattttttaaacactattctttcacaatggggaggtactttcggagttgatttttcagcagaaataggtggcacaagtggacttacaatgatagctaacataaaaactttagatatgggaatgattggagcactagttatatcaggaattgtaatatatcttcataatagattttttgatacagaattaccagattggcttggaacttttagtggatcaacatttgtattcatggttggcttttttgtaatgattccagtagcatttcttgcagcgttaatatggcctaaaattcaagtggcaatgttggtatttcaaggattcgttaagagttcgggagcagttggtgtaggagtatttgtattcttagaacgtattttaattccttttggattacatcatatattatattcgccatttttctatgataatgtagttgtaccaggaggtatttactcttattgggcaacaaaacttccagaaatagcagcctctacagcttctttgaaaacgttattaccagaagctgcattcacatctacaggatattcaaaaatatttggatgcccaggtatagctttagctttttatgcaacagcaaaaccagaaaagaaaaagcaagtgttaggattgctcatacctattacattaacagcaattttctgtggagttactgaaccgatagaatttacatttttatttgtttcaccaatattatttgtagtacatgcagttctagcagcaattatttcaaccacaatgtatcttgctggaatagttggagtttttgcaggtggtgttatagagatggcatctttaaattggattcctcttatgggaaatcattggcaacaatatcttcttcaatttgcaattggtttgtgttttacaggtgtatggtttatagtttttagaacactaatattaaaatttgattttaaaactccaggaagagaagatgatacagaagaaataaaattccgttcaaaagcagaatacagagaaagaaataatagtggaaatatagataagaaaactgaatttgtaatggatatattagagggattaggtggaaaggataatattgtagatgtaacaaactgtgcaacacgtttgagagtaaatgttaagaatgaaacattatgcaaaaatgatgcatattttaaatctataggagctcatggatgttcagcaaatggaaaatcatatcaagtaattataggattaaaagtagcatctgttagagacgattttgaaaagcttcttgatagtataacagtataattaatatggtgaatttaaggaagtgaatatatatggttagtacaattaaaacaaagtcattagataaatattataatatttcaaaagtattgcttactttgagcccttttgtatgtctactatatctttctacaggagcagctagaatgggtgcttcaatacagcaggttattgaagctgatccgaagtttttgataatgtttttagcgtcaatggtaaatccatttattgcatatctattgatttatatgcataagagaataaatgatggagatatatcatatgcagtagttaatttagtagtacttatagttgcagagtttatatttcaaaatgccttatacatgtttttgttaggatttattttatacaagactataaaaacttataatatttcaattaaatcaagttttaaagataaaataaaagacaaatttttaatggtaatatcaggtggcatagttgttataatatttgcttcaatatgcttatttgcaactatcagagttgaaatgttttagttgactttcaacatattaatgaatatacaaattaaaataatataaataattagaaatagtcccatagaaattcaaatttttatggggctattttgtggtagaatagtaaaagtgagaaaataactaaagtaaagttgatgttatatacacaaatgaaaatcacagtaaaggaaatgataaaaaatgaaaatagcagttacaactacaagacaatgtgacgtgagtttaataaataaagctcaaagtgtgtcagaagagttagatatatcatatataaaaagagaaaatataggaattaatcaaatattagaaaacacaaatatagaatatttattggtagtcgaaaaagataaaataacgcttaaaggaaaagatagtgtattgttttggcatcctaacatgtcagaacttaagattaaatcaataaataaaggcaataaggaagccttgattgaatcaactcaattaaaagatggtgatagtgttttagattgtaccttaggacttgcaggagattcacttgttttttcatttgttgtaggtgaaaatggaaaagtagtagggaccgaagttaataagtttatagcatatatttgcaaaaacggattgagctcttataaaaataataagggtgaaactcccgaatatatgaaaaatataaaggttattaatgtgtcatatgaagaatatttaacaacacaaagtaatgatagtttcgatgttgtgtactttgatcctatgtttaaaaaacctaataaaaaatcatcatcaattaatgcattaagaaattttgcaaaccataatagtataactaaaaaaactttacttgaagcactaagggtatgtaaaaaaagagttgttataaaggaaagacaaggtgaaaatgattttgaaactttggggataaaaacatattatggaagcgaaaaaagtggttcaattatttatggtattattgaaaaaaaggatatgaatcaatttgaagattaaacaaactgtcattctaggaggaatatgaaatatgaacttaaagataaaaattatttataaaaataattatgaagaaataatatctttaaaagtggctgaggtaaagaaaaatgaaaagtagaagcatatttgaagagaaatcaataaatcagttaatagtactattttcatttccaacaatatgttctttagttcttgaatcattatcatcaatgatagatacagtttttgcagggcatttaggtaatataagtactatagctttgtcagctatgggaatcataaatcccatattacttttattgatagcagctcaattaatatttggtgtatcaacaagtttattaatatcaaaaagactaggagaaaatagtcaggaaaaaataaataatacttttaaagttggattctattcttgttgcatatcaagtgtatcaatttcattattaatatttctctttgagaaccaaattttgagtgtacttggagcaagcggagaagttatcatattagctaaggaatatctaaatatagctttaatttttaatgtttttagttcaacaggttatatgttagtcaataatataagagcctttggatatccgaaaatagaaataatggttggagttatatctacaattataaatatagtatttaatgttatttttacatttatattaaatatggggattaaaggaattgctctatcaacattaataagtgaagttttctattttggattttcaattatttttttaataaggaaaggactatggataaagaaaagcaactttgatttcaaagagtcaaaggaaatattgatatcattagttaagattggatttgtacagtttctaatgcagtctttaaatagtgttagtggttttattataaataaagtattgataaaatatggaagtgtttcatatgtaggagcatggtcaatatgtagtaatatcaatatggtaatattgcttcctttaataggattaactcaaggggttcagtccgttatatcttattttcatggtagcaaggataaaaatagagaagacatggtaaaaagtaagattgtaaagtatagtcttatatattcaatatgtgtaacagttttagtttatatattttcacatgagattttaaatatatttactgaggacagtaatttaataatgctatctattccaataataaaaattgtagtaataacttttcctctagttggtcttatctatacattgattacattcatgcaagtattaggtcaggaaagtagtgcaagcaaattggaattgatgcgacaggttgtattgaccataccattagttattataattccaatactattttccaattacaatatactgaatgttgaaccacagttagctgtatttttttcaatgccaatatcaacaattttaataataataatatacttcaaaaaataaaaactattttgaagtgtattttataaatttataattagttatcaatatatacaaatctgtttaataatattattggtaatgttggggctgtatcaaattgaaattttttaaattcaatttgatacagcctattcttataaacgtaaattttattcatgtatatatttccaaatattttattttgaaataacacaaataaaggataaacattattatccatattttaactatatatttaaaattacgaagcttgctgcttatgaagcagctcaccgttacgattttgaatggttttatggtacaatttattaacattataaccaaacgccattaacaaaaattcagtacgaactttaatatttccacgcataaaaaatcttctaaaaccataatcttgtttaataactccaaatgctccttcgacttgaattgatctgttcattcttaaaagtattcctttaggtgtagtgatgtttttaagtgaatttgttcttagacgcataaaatttttagccacatgtatttgtttattaccttttgctttcgtacatttactcttatattcacagccatcacagtcttcacattcatagatgctaacagtagtttcatatccagattttgtttttttcttttttgttccttttagaagcatttttttaccagatgcacaaatgtagtaatcttcatctgtgttatagtacatattttctttcttactaatatcactcttgaatttctttgtctttgacttttcataatttgcaggtttaataaaagcttcttgtttcttagattcaagatatgcataattttcttcactttcgtatcctgcgtcagcagttacggattcatatttttgatttaaattcttttctaatctatctaaaaatggtataaaagtaagctggtcagatctttcacttgaaatgtctactcctacaatatattcaccttctacccctatttggatattatatgctggttttaattgaccgtttttcatatgatcttctttcatatgcatgaaagttgcgtcatgatctgtttttgaaaaactgtttcgtccattaaaaatgctattgtattcattatatttattttgcttttcaataaattcattaagttgttcagtatatctttggaatttactttttcttttaccttttccataaacaaattcaatattattggcttcaatcataattctgatactatctaaaatataattagcatcttgaactgatattttagcattagtaataataagacataaattcaaatcatgattcatttttattaagctttcttttattttcttttgtagtctatcttcaaatttatcaatagattttttccaaacaaaagtatatcgatttgcagatgcttcgattttagttccatcaataaaaatatttttaaattgaatttcattaagttctctaagttttttcacaagttgattaaataaattttctatacaaccagctaatcgttcacgtctaaatctatctatagaattgtgtcctggtggtagttgaccttgtaaaagccatttgaaatttatatctcttttgcatgccttttcaagagcacgacttgaatatattccttccatatatccataaactataattgcaaacatagttttaggtaaaagtgctggatttctaccaatagtagagtaagttctatttaattctgaataatctaatccctccataacatcataaagcactcttactgaatcactatcagatataatattttctatatttattgggaaacctatttgatgcataggtataatattattagtgttcatattaatattatgcgcaaaaaagagaattcaaatttatgaattctctttttttatcggctagtatcaaaattgttttgatacagcccctttttagatgaaataaaagtgaaaaaattaatcaacttgtaaatgagattgaaaaggattatctattttatgaaaaactaaatgacgcagttactttttatactaagagaatttatatacgtgctataaaaatataaaaactcttttttatatttatagtaaatataattcatgatattgataaataatatatatggggataagaatgttttaaaaacaaaggaaggagataatatatgaaaaacaaattatcaaaagaagcctatggtggtattgatagtaaaaattatgttccatatgtaactgataaaagcaaaaaaggaatgaattttttagtattaataataggcataatattagcagctgtttttgcggcatctacagcttattcaggaatgaagtcaggattaactgttgcagcaggaatacctggagcaataataggatctatgtttattggagtatttgcaaaaagtacagggatacttggaaaaaatataacacaaggtatgtctagtggtggtgaatcaatagcaagtggaatgatttttgtgttacctgcaattatattaattggaagtgatattacatttttagaaggtataagtgttggtattggaggaacattatttggaataggagtattatcacttgtatataattacttaattattgaagaacacggaaaactcatgtatccagagtcaatggcaatatctgaaacattagttgcttcagagggaggcggagacgctataaaatatatgggtattggctttgtaataagcggtattataaatgttttaactggatcattcttaaatataattaataatgtagttacatatataggaagtagattttataagtggaaattttctattgaagtaaatcctcttttattagggataggatttatagtcggtttagatgtatcattaaccatgtttgcgggttcaatattagcaaacttcggtgttgcaccattaatagggtattttactgatatggcagatcgtaatatacatacatggaatgatgctacagtgcttcttcactcaatggaggtaaattcaatagcaggaagttacgttaaatatattggcgcaggaatgatgctttgtggtggtataataggtgctattaaacttataccaacaataatactttcaataaaggaaacattgaaagctagatcaggaaataatgagaatggtgaaaagagttttggagatacagcaattttactagcaggtgttgtaatagcttttgtagcaggatttttaatttcacaaagtattatgatggctgttatatcagcaatagtttcattgatattatcattgttatttgtaatagtagcaggacgtttgacaggtacaataggaacttctaatcttcctgtatcaggtatgacaatagcttcattagttatacttacattagtatttgttataatggggtggactggtatagctgataataaatcattacttctatttgctacatttatggttgtttcaatatcagttgcaggaggatatagtcaatcgcaaaaggtaacttacataatagggggaagtaaaaaagaaatgcaaaattgttttgctatagcaagtatagtaggggtaatagttgttacaggaacaataatggtacttaaagatcagttagcagttactggtgcagatgcacaatttgcattaccacaggcaaatttaatgtctacactaacatcaggtataatgtctggaaacttaccatggccaatgattatagcaggagttgttatagcactatttttatttttattaaatctccctataatgactatagctataggattttatttaccaatatcaacaacaagcataattttagtgggagctctaatacgtgtgtttatagaaaaaacaagtaaaaataataaggataaagaggtaaaggttgcaaatggaataagcttatcttctggtcttgttgcaggtggttctataataggtcttttaggaataatactacaagttacgggaataatagctcctagaactccagtaggatttgcatctagcaatggtatggctataatactattgatactattgattatagcatttacaataccagtcattacatcaagggtgaagaataatgaaaagtaataatgaaatgattttaaatattaaatttaaaatttgtgataatataaattacatagttagcaaagatagagtagttacagtgtatgaaaaacaggatcataaaatacagaggatatttagaaaattaagatttaacattcctatgtataaggagattacattggatgaatatagtagtgaagtattccttcagatcgatgggtgtaaaactgttaaggaaattggtcaatttttagaaaaaaaatatggtgaaaatgtatatccactttatgaaagattattagtatttttaaactatataaatgtagaatgtagatatattgaaaagttgaaatattaataaatatagagtaataaacctgtatcagagattagttcttatgattcctgatgcaggtttaatttctattaagtaactatatatatgcaggtataaggtaacgatattgttaaatagaaagactgaataaaaaattgaaatatacactaaatgatagatgttttacaggtcaacataaataaaaataacaaagaatcttgctttaaattgatttatggtatactgtaataaatagtgaaattaaaataagcatagagacaaacaaaactgatttacttaatacagatattttttatttaaagtgttagggataaaattaataatgattattataagaatagataaggaagataaagacatgacaatggaattagaaaagtattataataaattttgtgaagataaaaggctaacgagaagacatggccaagttgaatatataacttcaatgaagtatattcatgagtatttaaaagataataaagatgcaaaaatactagatgttggtgctggtacggggagatactctgtggaattagcaaatgaagggtatgatgtcacagcaattgaacttgtaaagcacaatcttggagttttaaagtcaaagggaagtacagttaaagcaatgcaaggaacagcattagatctatcaagattttcagataatacttttgatatgactttagtttttggtccaatgtatcatttgtataaagttgaagacaaagtaaaagcacttaaagaagcaaaaagagtaacaaaagttggaggtattattcttgttgcatattgcatgaatgaatatagtgtaataacatatggatttaaagaaaacaatataaaggagtctgtaaaaaacggaaagttaagcaaagattttcatgttatttcagaaccagaggatttatatgattatgtaaggattgaagatattaataagataaatgatgaagcagacatttcaagaataaagatagtttcagcagatggaccagctaattatatgagacctattttaaattctatggatgaagatacatttaaacttttcatggattaccatttctctacatgtgagagaccagatttattaggtgcaagtgcacatacattagatattttaagaaaataataaagtgtcaaaactgatttttataaaacctataaatatgacaaattaaaaaacttatagtatttataagtggtaggaaagtttaacaaaaaatataagtcaagctgcagttttaactttgtaaaagtttaggctgcagctttgttatataagaaattaaaaataaatttttaggttatgcgattaacctttgaatttatcaatgggatatgataatctaattactgagggatacaaattatggaagtgtgccataaaggaattaaaatataaatgaaatggagatgtaataggtgtatgaaaatgagaatagaagagtaacaataaaagatatagcagatgaactaggtgtgagtacagcaaccgtttcaaatgtaataaatggtaagactaaaaaaatatcggataaaacaattgaaagagtacaaaaagcattagacgaaaaacaatatatacctaatatggcgggaatacttcttgcgcaaaatagttctaaaattatatgtgttatcatttcgaatcatgaaaaatatgaaggtaatattttgcaagatccttttatttcagcacttatggatagttttgcagttgaaatagagaaaaataattatttcatgatggttaagattacagataatattaatgagattataaaatattcatctatgtggaatatggcaggattatttttaataggattttgtgaacaagattataacagtctaagaaaacgaattcatataccatttgttgtaatggatggattttttgaaccaaaagaaaagtgtgggaatataagcattgatgattttcaaggtggatatttaatgggcgaataccttataaagcaaggacatagaaagataatgtatttatctgataacgatatgtgcatggatcacaacagatatttaggactagccaaagcttttaaagacaataaacttgatagaaaaaacttaaaacttgagattataccaacttatagagaggaaagacaactttattacgataaattggaaaatgaaatacacaattatactgccattttttgtgcatcggatgcatatgcaattgaagttataaattatcttaaggattacggttataatattccagaagatatttcaatagcaggctttgatgatatcccagcaggaaaaataataagacctgctcttacaaccattaggcaggatataaaaatgagagcatcaaaagcaatccttcttcttaaggagcttatagatggaaatgttaaagaaaataatttgatattacctgttgaattaatagaaagagacagtgttgcatatttatcagaaagtaggtagtagagtatgtttaataaagataagttttataaagatatattaagcatagcagttccaattactgttcaaagtttttttcaatcatctgtaagtgtaatagatcagattatggttgggcagcttggaagcgtaagtattgcaggagctggacttggaggtaagttttcatcgttattttcagttactatttcagcaattgcaactggagctggaatacttatttctcaatattatggaagtaaaaataaaaaaggaataaatgatagttttatatgtaatatgtatttttccttaattataagtgtattttttacagtgatttcttttgtatttcctataaaattaatgtcaatatattctactgatttagatacaattaatgcttcagcatcttatttaaaaatagtatcaataggatttataccaatgacattgacacttataatatcaacatttttaagatgtataggatatgccaaatatcctatgtgtgcaagcattatttcagtttttatcaatacgggtttaaattacttgttgatttttggaaaatcaagatttccagctatgggattagaaggtgctgcttgggctacaaacatagcaagaataattgaatttattttaatatttatatttttattagtaataaaaagaaagaaaaaattatatatttcttttaatcttaagttggattttaattttataagaaaagttattttaattttgtatccaatgttaatatgtgaatttttatggagtttaggcgagaatggatatgccatgatttatggaagaattggaacagaggcatgtgcagctatgactttaacagggccaatacaatctttacttataggaattttttctggaattgcatctgcatctggaattatttcaggaaaagcacttggagatagacaatttgaagacgcatatattatgtcaaaaaaatatttaaaattggagttgtaggatcaattattataggaatttttctttcagcaattgcttctttgtacgttaaaatgttccaagtaaattatgatataaaacataatacaatatatatactttatggattttccttaatactttttgcaaaggtatctaacatgatcttaggaggcggaattttaagaagtggtggaaatacaaaactagtaatgtttatagatattataggtacatggatgtttggaattccaataggattcattgcagcatttatatttaaaatgcctatatatcaagtatatttcttgttgtctctagaagaaataattaggctttttatatctttaattgtatttaagaaaagattgtggataagaaatataacataaaattatttatatattatttagagttttaatatagagaattaaaaaaggagagagtatttatgaataataatgagaaagaaagaaaaattattttaaaagaagatttaatacaaggttttaaaaaattaggagttaaagaaggacaatctataatggttcatacatcattaaaaagtatgggatttgtttgtggaggagcacagattgttatagaagcattacttgaatctgtaaaagataaaggaactataatgatgccaacacaaagttggaaaaacttagatccgcaaacaggtgtacattgggaagaacctaaagaatggtggcagctaataagagataactggcctgcatataataaggacatcactcctacaaatactatgggacaagttgctgaaatgtttagaaaatggccaggagcaaaaagaagtagtcatcctgcacgatcagtagctgcattaggaaggtattcagagtatttaacagaaaaccatgatctaagtaatatttttggaaaagattcacctatagataaactttataaattagatggatatgtattgcttataggtgttgggtatgataaaaacacgtcaattcatttagctgatgcaatagctgagtatccaggaaaacataatgttaatgaaagcagtgcagttatgattaacgggaaaagagaatggattacttatgagacgcttgcagtagatggtgaagattttgaagatataggaagagatttcgaaaaagcataccaagttaataaaattaagattggtaatggagaaatacgattcatgaaacagagagatatagttgattatgcagttaaatggattgaaaaatatagaaaataaaataatgttttttagataagtaataaattattatgaaaaaattaatttataaattaaattcaattactaaactactatgtaaaattacaattaataaatataaccttaaggctttaagaggctcttaaggtttttttttgaatgtttttaagtttaatgtatagttttagcaatctatgtataaaatatataaaaataaacatgaaaacttattgaaaaactgtaaaaaaagtgatacattggtatagtggtattaccactgtaccaatatatcactttttttatatgactttaatgtattgtgcactataaaaattaaagtaaattctcataatttatcaattgataaaaaagttttaaaagactttttatataaaataaatgtacaatctgtttatcaggtgtaatatgtgggggtgaagtcaatgaaatatttacagcaattaatgattattttagcagcatatcttttaggagtagtattacaagttgcacttaatttacctatcccaggaacagtacttggattaattatacttttcttaggattatacagtggaattataaaagtagaaatgattgaagatatgtgtgagatattaatatcccatatgtcttttttatttattccagcaggtgttggacttattacaagctttggactattaagtggaaaaattgtggctttttcgcttgtgataataatttcaacaattattgtttgggtagttacagcatatgttgtgaaatttttaagaaaggtgtgttcaaagtgaaagagataataagttctcctgtatttggagtgttaatatccatagcagcttatttaataggatgtttagttaaagaaaaattgaaatattcattttttaatccattactaattgcaataattattttaattattgtaatgtcaaatttgcatattgaatatagtgattatagtaagggtggagaaataatttcattctttttagcaccagctactgtagccttagcgttaccactatataaaaagttttctttatttaagaaaaatgcgattcctatactggtaggaattatatgtggttctgtatctggaatagtaactgttatttcacttgctaaattgtttcacttatcagatgatcttacaatttcgttaatacctaaatctattactacgccaataggaatggcattagcagagcagcttggtggattaccatctattactgttgttgcaattatagtaactggaatctttggttcaattattggtccatttttagataagatttttaaaataaatgataaggttgcaatgggaattgcaatggggaatgcatcccatgcagttggtactgcaagagcaatggaacttggagaaacagaaggtgcaatgagcagtcttacaattgcaatagcaggaattattactgtaataatagcaccgccattatggaattttttcagtcactttataaattaaatttttaaggaggaataggtgtggcttataattcaagaaaaaaaataatgccaattgaaaaaatactatactcgattgataatttgttgattgaaggaaaagaacagaaattaaaaggaaagcttgccaaaaaaattaagaatagtatttttacagaagagatactatctaagcttcatgaatgtgattttacagggttaatagatgaagaagacaatgtattaaaattatttgagagtatattcccaatatttataaaaaagggcaatactatttttagactatataaacataaaattgaagttgatttatctgatgaaatgagagataggtatatttatatgctttctgatggaagactaacatctggtttatttcaatgttatggtataagtcaggatgaatatgtatatggaataaaaaagattatagatgttatacctataataaaagaagaacttatgactacaatttctaattttaggaataatatagaaaagcagaatgtggaaataaataatattaaagaaagagaagaattagcagaaaaaaattacaaagaattaagctcatattttttagaaaagaattctaataatcaggagaagttataaatgcttaatccagttaagaatataaaggtatacgaagcaataatagaacaaataaaagatagtgttaaaaatggggaattgaaaagcggtgataaactgccttctgaaagagaacttgcagaaaagcttcaagtaagtcgaacctcagtaagagaagcattaaaagctttgagtatgcttggtttaatagattctaaacatggtgatggtaattttataaagagcaatgtggaagactgtttgttagaaccattatcagtagtatttttactcataggaaatagaaatgaggaaatattccaattgagaaggataattgagcctgaagcagcagcaattgcagcaaataatataacagagtatgagttaaatgagctaagattaattaatgagaaaataaaagaatcatctgatacagaatcaggagcagaattagatagaaagtttcattataagattgtaaaagcatctggaaataatctcctttcaactataatgttttctgtatctgtacttgtagaaaaatatattgataattctcatattcataatagtaataaagatatagtttacagtcagcatgaagatatttatatagcattaaaagaacataatgctgaaaaagcttttaatttagtaaaaaagcaccttgagctcggaagtatttaaaatcttaatttatagactaataattgtagcaatatgaaaaataaattttatgtaataatcttattataataataaatatggaaagaaggcatataatgatgttaggagataaagtattttttaaaacattatttaaaaatttattttcagaaacatttgaacttcaactttgggatggtagctcagaaatttatggagatggaattcctaaatttaaaattatttttaatgaacctattcctaaatcagatataattaatgatccatcaatagcatttggtgagggatatatgacaaagaaatttgatatacatggaaatattgaagaagttgtagaagcattatatgataacaaagaaagttttttaggctctacaagcaaattttctcatttaataaaggtagttaaaaataacttaaaaaatagcaaagaaaatattgaatttcattatgatattgggaatgatttttataaattatggttagacgatactatgacatattcttgtggatattttaaatctcaggaagattctctaacagaagcacaaaagaacaaagttaatcatattttaaaaaagctaaatttacaagatggagaaaccctactagatataggttgtggctggggcgagcttataatcacagctgcaaaaatgtataaagtaaaagctacagggataactttaagtactcagcagtttgaaaaagttaaagaaagaatagaaagtgaaggtcttaatgctttagtagatgttaagcttatagattatagagaattaaaagatattaaatttgataaaatagtaagtgttggtatgcttgaacatgttgggaaagaacatttatgcgaatatttttcagcagtaaataaattattaaataaagaaggtttatccttactacattgtataacaaatactagtgatgatggtgttaatagctggataaataagtatattttccctgggggatatgtaccatcaatacaagaattgatttcaaatatgtccgacttagattttaatataatagatgttgaaaatcttagattacattatgcaaagactttagagtgttggtatgataattttcaacaggcacttccagaaatagagaaaaataaagatgagacatttataagaatgtgggcattatatttaaattcttgtgcagcttcttttaagtctggaaatattaatctgcatcagtttttattttctaagggagtaaataacaatatcccatggactagagaatacatgtataaattataattaattctattaaagttgaagatgtatatcaacgatatctttagatttaaattacgatttgtgatcagtataagagatgtgcaagtgcacaaataaatatgtgcactaacatgttgaaagaaaacaatgataaagtttataatataaacagtaaagattagtgttgaaaagcaatgaagcttattctcagaataggtttcattgctttttgcttttttatatctattatatagagaatatttgtagatatgaataaatgtatattattaaaaacagatcttatttacctaaagggggtatgaataatgtatgaatgtagtttagaaagaatgaaggacaaaataaaaactttttcagcgttcggagatgctggccacggtggaataactagatattctttatcaaaagaagccattcaggcaagaaatgaatttaaaaaaagaatggagaacattggtgcaataattgaaatagatgatttagcaaatatgtatgcaacacttccaggtagtgataatcattcaaaaagaattgtcatgggatcacatgttgattcggttaaaaatggaggtaattatgatggtattcttggagtgatgtctgctatggaggtactagaaacagttgtagaagaaaaaattcctcataaacatcctcttacagctatgatatggacaaatgaagaaggttctctatatcctcccgcaatgatgtgctctggtatattatgctatgattatcttccagaaagtataagaattaactttaaagaaagtgatatgatgaattcaaaaagcattcaggattcaactaagacatttggagaggcacttaaaaattcgggatttaagggtgaaaagaggtataggctaaatcctgaaaagtacaaatatatgtttgaaactcacattgaacagggaccaattcttgaagataatagaaatcatattggagttgtcgattgtgttcttggaatgtttaattacagggtgaaattttatggacaagcagctcatgcaggaacatttccaatgaataaaaggcaggatgctttttacgcagcagcacaggcactttgttatattcatgatgaaattgacaaacttaaagtatcagaattagtatatacgacaggagaagttgtgtgtcacccatgcgtacatacagtaattccagatttctttgatttttcaattgatgcaagacatgaagatccaaatgttcttgaaaaagtactttcaatagttcaaagttgtgcagataaacaatggagtggatgcagatgcgttgtagaaaaggcttggaatagagatactgtttattgggataaagaattagttgaatatgtaaaaaaatcagcagaagaattagatattaaacatcagtatatacattctggagcaggacatgatgctcagtttgtatcgtatatgattccaactactatgatttttgtccaatctaaagatggattatcacattgtgaaccagaatactctacaccagaacattgtacagaaggtgcaactgtaatgcttaatgcaatattaaaagcagattttgaataaaagttaaaagaatagattgtttgtatattaagaaaactaagaaatttttttatcacatatatgatatgattttgcaatgacgcagaactattttaagttttgagtcatttttttattatgaaattactgataaagactaaaataataatcagtatagtaggaggtattattatggaaatgaagaaaagtaaagagaatttaggtgatatagaagaaaaagaacatgaaacttttaatataaaagagattaaaacagaaataaaaattgagaatgtaagtatgagatatccaaataaaaatggtggagagccagttacagcacttaaggatataaatttagatataaaacaaggagaatttatttcactattaggaccatcaggatgtggtaaaactacattattaagaataatagctgatcttctacagccaacagaaggaaggataacagttcgaggagaaactccaagagatataagacttaaaaagaaatatggaatagtgttccaaaatccggttttatatgattggagaacagtaaggcgcaatatatgtatgcctatggaacttatgggactgaagaaacaggaacgtacacaaatggtaacgaaaatgctggatttggttggacttcaggaatttgggaagcgttatccttatgaacttagtggaggtatgcagcagagagtaggtattgcaagagcacttgcaatagatcctgagatacttcttatggatgaaccattttctgcacttgatgaatttactcgtgaaaaattacatgttgatcttttagatatttggacacaaacaaagaagacggttgtatttgtaactcataatatttcagaagcagtatttttatctgataaagtagttgtgctatcaccccatccaggacgagtttctgctgttataaatatagacatacctagacctagaaatatggaatcaaaacaaagtagtgaattttatgattatattacaaagataagaaacagctttgagggggtataagcatgaaagaaaaaagggaaaagtattttataaatatagtatggactataggaatatttttagtgtgggaatttatagcctttttgctagatggagttttacatgatccaatggcagaagcgaagttgccttatcctcatatggttattgtatcattatttcagaatttctcagatctaatgagtgcagcaggtttgacactttcaagagcttttttaggatttcttcttggaggaataataggatttattttagcaattattatgagtttatcaaaaattgctgaaaaagtagcttttccatatctaatagtatctcaaatgatacctgtgttgggacttgcacctataattttcacacttgccaaggatatggatttatcaagaataataatatctggatatattacatttttcccggtttcagtaaacatgttaagtggtcttaaaagtgtagaaagtgataagaaagaattaatgtattcttatgcagctaagaaacctagtatatattgtaaacttatgattccatattgtcttccatatttatttgcaggacttaaaatagctgctccaatgtcaattactgcttcaattcttgtagatatgcttggttcaagtggaggaataggtgtaaaacttctttattcactatattcaggaacaaaagatgtattttggagttcagtgattacaagtgctataatgggtatttttagctatttcataattgtaatattggaaaagatatgtattccatggaaaaaagaaactgtgtagatgaaaggagattatgtgatgtcagaaaagataagaagtgtgttatggccattaggatttgggatattaattatagttctctggcaggctggttttatacatcatgtattaggattcaaaccatttcagttgcccatgccttcagtgataataaaaacattatcaagcaattttgttaaagcattatctgatacgtacatgactgtatcaggtgcagtagttggattaattctaggatgtattataggttttattgttgcagtaatagcaacattatttccaaagtggggatatacaggacttacagtaatatcagcttttaatgcaattccaatagtagctttatctcctataatgaatagatggtttgaaaatggttttgggcagaaagtaggtgttgtaacagttgtttgtatggcagcaatggcaataaattcttatagaggtcttaatgacttaaaaccattttcattagaccttttggattcatatgcagcagatgaaaagacaaagtttttaaaactacgtttacccaattgtattcccagtatgcttactgcattaaagatcaacatagcatcagctttgatggcagcaatgattagtgaatattttgcatcatcaacatcaggaattggatttggaataaaagataatttaagaaaaggaatgatggcaatgggatggtcgtacataattatggcggcattagttggaatcatttcatatttgattattacattagtagaacgaagagccattaagtggcatgcgtcacaacgataaagctagtataaaagtaaatttgtaaagtgatctataaaaataatattaaaaaattaattaatcaaattatgacttaggggaggaataaatatgaaaaagaaattattatcaatagttttagcggcaggaatgatggttatgatgtttgcaggatgtggaggtaattcaaattcagtcaaatcagatagtcaagaatcttcaacatcagctacagatgaaaagaaggatggagatataaaaaaaattaagctccaattaaaatggcttcctcagtctcagtttatgggatattatgttgcagctgataaaggatattataaagatgaaggacttgaagttgaaattcttccaggtggaagtgacattattccagagcaaaatgtttataatggtgtagcagatgtaggtgttacatgggtatcaagtttaatgacttaccaagctcaggggtatgagcttcaagaagttgcacaaatgtttcaaaaatcaggcttgctgttagtttctaaaaaggatacaggaattaattcaccatcagatttgaaaggaaagaaagttggtaactggtttggtgggaatgaatatgaagtactagcattattagagaaatataaacttaacaaggattcagatcttaagttggttcagcaggattatacaatggatcaaatacaagaaggttcaatagatgcagcatcagctatgacatacaatgaatttggtctattacttgaaaatggtgttaataaagatgatctaaatataattgacatgaatgatgaaaatgttgcaatgatggaagattgtttatttgttaattctgaatgggcttctaagaataaggatgcattggtacgttttataagagcatctattaaaggatggcaggatgcatgtaaagatccagaagcagctggaaagactgtttacaatgtagacaagtctgtatctttagaacatcaaatttatatggctaaggaagttgcaaaacttgtaacaccagaaggctttgattcttcaaaagttggagaaataaatatggatgcaattaagcagactggacaatttttaaaattatataataaggatttagcagcggatccagttgttaatgataaaacatttaattcatcatattggcaagaagcaacaaagtaaattaggaagcattaagtattataagaaattaaatatattttcagtggatagtatatgatgtttaagctattcactggaaaaattaagaatattataggaggaattaaaatgaatttaattataaaaaatggaacaattataacaccttctgaaagttataaagctgatattcttgtaaaagcaggaaaaatatcagctataggtacagatttctccgaagaaggtgcagagattgttgatgcatcgggaaaattagttttaccaggggcaatagatgtgcatactcatttggctatgccttttggaggaacaatttcatctgatggttatttagctggaacaagagctgctgcatgtggaggagttacaacagtatttgattatccaatgcaaagaaagggacaaggaataattgaaactgttgaagctagaaaggaaatgtgtgatccagaggcgtgtgtagattatgcatttcattgctgtattacagatttaaacaatggaaatgttttagacgaatttcaagcagcagttgattatggtataacaagttttaaatgctttcttgtttataaaaaagaaggaatgatggttgatgatgctactttagtaagagtgcttttaaaggcaaaagaaattggtgcaattactaatattcatgctgaaaatcccgatttaattgatttaaatattgaaagatttttgagtgaaggaaaaacatctccgtggtaccattatttgagcagaccagaatttgtggaagctgaagcagataaaagagctgtacattgggcaaaatcagtagaagcgccactttatttagttcatatggcagataaggaaggtttagaagcagcaattgcagcaaagagggagggacatgaaatttatatagaaacatgtccacaatatttggaattcacatgtgatgtatataaaagggatgatggaagaaattttgtatgttctcctccaatgaaaggaaaagacagtcagaatgcattatggaaggctatcgaagttggggcaattgatacgattgcaacagatcactgtccattccaaagttatgaaaaagattggggaaaggatgattttacaaagattccaaatggatgtgcaggtgttgaaaatttatatccttatatgttatcagcagcaaataatggaaagttgacttttaacagagtgattgaattatgttcatacaatccagcaaaaatattcggatgtactgataagggtatgttatcagtaggaaaagatgctgatattgtaatatatgatcctaataaggaatttactatttcagtagaaaatatgcattcagattatgatcatacaatttgggaaggaaagaaattaaatgggtatccagtaaagacttttgtcagaggtacattagtatatgataatggagaatttgttggaaaaccaggtttcggacaatttgtaaaaagaaaagcacataaatagaaaataatacagcacatacttaaaaatgtgctgaatcaaaatataaattttaaatagcgtcatgggaaatatgaaactttattgacaggaggtacgaatatgagcagtatttcatacaaagatattaatttaagagagtgtgtatcagcatgtttgctttgcaatgatgctccgtgtaaaaaagcctgtttgaatggagttgaaacagataaaattatacgttcacttcactttgaaaataaggatggagcagttaataagcttccagatatatctttttgtaatgattgcaaaattaaatattgtgaaaaagaatgtttaaaaggtaaaataagtgaaccggtaaaaattcaatctataatgaaaaatctttatgatgaatctaaaatagaagaaaatcaagttgacttatcaatagatttttgtggtgtacattgtgagaatccattttttctttcatcgtcagtagttggaagtaattatgaaatggtagcaaaagcatttgatatgggatgggcaggagtcgcatttaaaactataggattttttgtgccagatgaggtatccccaagatttgcatcacttacaaaagaaaatgttccatttataggttttaagaatattgaacaaatatcagaccatagcttggaagaaaatataggttttttaaagaagcttaaagaaaattatcctaagaaaataatagtagcgtcaattatgggagaaaatgaagaagagtggactaaactagcaaaaatcatgacaaatgcaggagcagatattatagaatgcaatttttcatgtccacaaatggttggagaaggtttggggtcggatgttggacaaaatcctgatttagtatcaatgtacacacgtgcaacaagaaaaggtactcatttaccgattcttgccaaaatgacacctaatatcggagatatgacaataccagcaaaagcagctatgaaatctggagcaactggagtagcagcgataaatacaataaagagcattatgaatatcgatcttgagaactttggttcagagccagatattgaaggcaaaacaagtattggtggatattcaggtaaagcaataaagccaatagctttgagatttattaatgaaatgaaaaagtgtaatgagctaaaagatacacctataagtggaatgggaggtattgaaacatggagggatgcagctgagtttatgacacttggatgtgaaaatttgcaggttacgacttcagttatgcaatatggatatagaataatagaagatttaatagaaggtactaagctatacttaagttcaaatggttatactagtataagggaaatagtaggtaaggctttaaataatattgtaactgcagataaacttaaaagagatagtatatgttatccaagatttaatatggaaaaatgtgtagggtgtggaaggtgctatttatcttgctatgatggtggacatcaagcaataacagtagatagaaaaacaaataaaccagttcttatagtagacaaatgtgtaggatgccatttatgtataacagtatgcccagtacaagcggtaaatccaggcaagagagtccataagaataataaaaagacaggataaaaaatattaataaatataaagttagagatatggcactatgttatataaatcagagttccatatctctttatttgtgattaataaatattattaatttatttttcataattctaaaagtttttcagcaatatcaagagatgtcataaaaatatcaacatatccactttttaaggcagcttttgttgcctcaactttttcgttgcctatggaaactgcaattgttgtggtattctcaagttcattaagggagattccaatagaacgtgagtttaagtctgtatctataattttaccatgttttgaaatataagaagtacaaactgaggcacaagcattgtgttttgtaagtgaagttacatcatttattgaaaaagcacctccaagataggacgttgataatgtatttatttcaccaataccaattagtgctatattgcaagatcttcctctatcaagtatttgggaaattgagggctcttttttcataagattacaggtctctttgttttgaaataatataggagcatttaaaaggcagtaatctccaccagtttttctcgcaaagttctcagcgattacatttgcatgccaagtatgaccttttgttcccatatttccaactaagggtacaaacattaatccttctcttgtaagtttatgtgcgaaattagaaatagatgctatggtacgtccgctcattactcctattgtagcgttatctgtaaaatatttatcaagttgcaaagcacaacactctccaagcttttctattccttcagtgatatttttatatggaaaattaaatacaaaaacctcttttaaagaatacctatttataagtttttcttccaagtcaaattcatgggaatagggattattaattgtaaattctacaatatgatttttttttgcatagttgagcattcggcatacttgtggcttagatatgcctaacacaagagaaatatctttttggctcatattatcttcataaaataacttgcatattttaatcactagcctatcattatcatatattgccattataactctccttttaaatttaattttatatattacaagtgaaatatatttcaataatagaaatttattctatttatatattatcataatattatagaaattaaaaaagaaaggaatgaaataatatgcagaataaaaaatatggagagttcggaggacaatatgtttctgaatctcttatgaatacactaaatgagctagaaaaggcttataatcaagcaataaatgatgagaacttttggaatgaatataattattacatgaaagaatatgttggaagagaaaatccgctttatctagcagcaaaattaagtaaaaaatatggtcctaagatatatttgaaaagagaagatttaaatcatacaggtgctcataaaataaataatgttatcggacagattttacttgctaaacgtatgggcaagaaaaaagtaattgcagaaacaggagctggtcagcatggtgttgctacagcaactggtgcagcactttttgatatggaatgtaaggtttttatgggaacagaagatattgaaagacaaaaactcaatgttttaagaatggaaatgcttggagcaaaggttgtacctgtaacatctggaagtaacacattaaaggatgcaacaaatgaagctataaggacatggtcaaaggaagcagaagatactttttatgttttagggtcagcattgggaccagagccatatccagaaatagttaagaattttcaaagcataataagcaaggaagcaaaaaaacagattttagagaaagaaggtaggttgccatcagcagttgtagcatgctgtggtggaggatcaaattcaattggaatgtttgcagaatttattgatgataaaaaggttgaattatatggagtagaagcagctggtaaaggaatagaaactggagaacatgcagcagccttttcagagaaaagacctggtgtattacacggaatgagatcatatcttcttcagaatgaagatggaaatattaagcttgcttattctatttctgcaggtcttgattatcctggaattggtcctgaacatgcttatttaggaagtattggacgtgtaaaatatgatagcgttactgataatgaagcaatggaagcacttttagaattgtgcaaaatggaaggtataatacctgccattgaaagtgctcatgctcttgcatatctccctaagctttgtaaaaaacttaaaaaagatgacattgtaatagtgtgtttatctggacgtggtgataaagatgttactacaattgcacaatatatagaagagagaggtggttttaatgaatagaattgaaaaaaaactaaaagatcttcaaaataacaataagaaagcttttattacgtatatgacagcagggcttcctgatatgaaaaaaagtggagaaataataaaggcacagtcagaagctggagttgatattattgaacttgggataccattttcagatccaattgctgatggtcctgtaattcaagatgcttcatatcgatctatacaaaaggggacaaaccttaaaaagatatttgagcttgtaaagcaagttcgagaggaatgtgaaataccaattatatttatgctttactacaatacagtattgtattatggtgttgaaaattttgtgaaaaagtgtattgaatgtagtgttgatggaataataattccagatcttccatttgaagaaacctttgaaataagagaatttttaaataaagatgaagatgcaccatttttaattccacttgtctcacctgtatcaaaggatagaattccaatgcttgttgaagatcagaaaggttttgtctactgtgtttcttcaatgggtgttacaggacagaatggagagtttcataaagatgttaaaaattatttgaatgtggtcaaaaattcatctaaaatacctgtaatgatgggctttggaataaagaatcctgaagatatagaaccatataaagatgttattgatggatgcattgtaggttcacactttatagaaattatgaacaaaagcaattatgatataaatgaaataaaagattatataagtacatttaaattaaaactaaataaatagcagtattagtactatatattaaaaggaatatctaattaaatttttaataagatattcctaaaatttattttaataaaaaatcaataagagtatccgcagcaatagaaagagtagagttttttttatatataattcctatatttcttggttcaatggtagtttcaattggaatttccacaagaattttatttttaagttcataagcaagaaattcttttaatgtagaagttattccaaggttatttattgcacattcaattaaaaaatccatattacttgcttcaatatctggaactatatctatattgttagaagcaaagtaatcatctatatattgtcgtgtggcattcggattttcaagaagcataaatgaacctttggtaaaaacatcatttatatcacttaaattcaaattattaagataagtattgcttgccacaaagatatcatgaatagtcttgactttgataaaacctatgtcagtttctactggtgcagtaccaataatcccaagatcaagtttttcttcttttacaagctttattgtatctaatgtaggtttatttacaattttaattttaaagttaggatattgacttataaagtctctgaagcgtggaagaaaaaaatgttttcctatagttgtacttacacctaaattaatttttcctatttctttgttttttaatttttctatgtaattttcaccaatgctcatatgattaaaagccgtttcaatatgttcatataatatttttccttcaggagttagagaaactcctttagaattacgagaaaaaagttgtatattaaggtgcttttctaatgtttttatagatttgcttacagctggctgagatacaaacaatatatctgcagcatgagatatattttgatatttagcaactgttaagaatactttatacaagtttaaatcaataatcatatttataaatctccattttaaatagaatatatttacattatacaatactacagaaaataatcagtattttaagtattaaaatactgattatttataaaattaaaatgatataacttatagttatagtatttataaacaatatatatttcttttatattaaattcaatagtaaaataattataaaatttagaatatattgtgaaaggaaaagattatatgaaaattggtgttattggaattggagcattaggtggatatttaagcaccatgttgtgcaaagcttataatgaagtatatattatttcagatggtgagaaaatgaaaaatataattgaaaatggaataacattaaatagtgatatacatggtaagtttaatgtacatccacatatggtaacaaacaatccatataatgtaggaatagttgatgttatgtttgtatgtgtgagagggagttcattaaaaagtgtagcaagactaattaaaccaatgattggagattatacagtagttgttccattaggatgtggagtagatagtggaacaagacttttttcatacttaaataaaggtaaaatacttgaatcagttgcatacataagagcaagatctttagaaacaggagtaatatttcataaaaatagcagtactcgttttataatttcaagtaataaaaggcgtcctgtatatgatattaacttagaaatagtacagaatattttaattaaatcaggaataaattgtgaaataagagaagatgttgaagctgaagcttggaatagatatgttttcaattgtgcttttaatattactgattcatattatgatgtaggggtaaagggaatccttgaagatagaatgaaatttgaaactttctgcaaaattgcaaaggaatgtgagagtattggaagatcaaaaggggtgaatcttcacaaaaacatttataaagctacaattgattatcttaaaaagctttcaaaatggactataagttctatgcataatgatattatacatggaagaagaatagaaatagaacagtactgctatgatttatgtagaatggggaagaaacaggtatttctacaccatatattaagatggcttgtaataaattaaaagtattgcagactgtataagaaaaacacgttaaatgtaattttaaaaataaaatttagtatattgttgatgaattaataagtgatacacgttaaaatattaaaaaatacttgaaatagctgtatataaatacttataataaattaaaataaggcaaaaaatttatataagagagagtagcaagtatgaatataactaaaaaggtaatgataatcataatttcaataacattaactactgtagctttaagtatttgtgcatctcagagcatattaaaaaaattatgttctggcgaagctactagaagtgttggaagaacagtaagtgtacttacgcagtttgattctataatgaatgaatttgaggataattgtgaacaattttctcaattgattcaattatcgttaaatgacaatgaaacttcagatattaacaaagctgatgaacaaaaaaaacaaaaactcatagatagaatatctaaaaacaaatattctaatttttatgtagtggatgaaaattataacataacatcaaaattgaaagaacattacaattataatgataatgaaatttatagaatattaaatacagtcgagaagaatacatataaatacgattttaatggtatagtatcgacagatgattatcaatatatggtgtgtgtaaaaccaatattaacacacatatcagggggaagttatttagtaattgttgaacctttttcaggagatatatataaagaatcagaaaatttttcaggatcagtttttattaaaaagatttcattaaatgatctaaaatccttcaataaaattaaagttaatgataggatcatctttaatagatatacagatgatttagtgacaagctatacaaaggttgattcatatggtgggtctgataatgtatatatttcattagaggaaaaatcaatggtagtacaaaatgtaaaaatgaatttatataaattcatagccataattataataatctttatacttgctaatttcattatttacttttcaattaaaactgtgattgtagacagaatgctcaaaataaatatagctgtaaataaaataattaatacttttgatttaaaaacacgaattttagatgatggcagacaggatgaaatatctatgttaagtagtgatttaaattcaatgttttctattctcgagcaatattctgaaaagatgaagtatatttctggacatgatactgtaaccagattattgaataggagaagtcttgaagaaataggtgaaaatctaataatagataataaagagttttcatgtgcgtttattgatattgataactttaaaaagattaatgatttttttggacataatactggtgatgaagtattatgtataattgcagactatcttctgtcatatggcaaggataaaataagctgtggaagaattggaggagatgaatttttagtaattattcaaggtgaaggaaataaggaaaagataatagatatggtaaaatatatgtttgataagttaaaagagaatatatattttagaggaactagttataatgttaaagcaagcataggaataagctattttccagaacatggtgaaacttttccgcagattttacaaaattctgacatcgccatgtataatgttaagaataatgaaagaaataattactgtatatttcaacatgaattatttaattctttggaagtagagtctaaaatacttgaaggtattaaaaaaggagaatttgaagcttattttcaaccaataattgatttaaaaactggaataataagtggagctgaagctttaataagatggaatacacgtgaaggggtaatatctccaaataaattcatatcattagctaaatcaaatggatatattatagaaatagataaaatagtaatagaacaatcgtgtaaacttattagagaattaattgataatggaatagaagattttcaaatttcaattaatacttcatttaaacttttaagtcagaagagatttttatcaaatcttatggaggtaataagaagatataatataggagtaaaaaatattaaacttgaaattactgaagatgaaacaatagaagatttagaatatatgactgatttattacgaaggataagagaatgtggaatacaagtttcaattgatgattttggtacaggttattcatcctttaattatattaaaacactaccattagatgttttaaaaattgacaaaagtttattaagggatatggagaaagatgagagaactgagcatatcataaaaacaataataaacattgcacatatattaaatttatcggttacatgtgaaggtgttgaaaccaaggaacaatttcagcttttagaaaaacttaattgtgacaacattcaaggatactatttaagtaggcccttaaaaataaatgattttaaagcttttatttctatgtatgtgaataattaatatatttatactggaagtttaagttaaacgctatacagataagcattacataagcttattagtatagcgtttataattattatgatttacaagtaaacagttttgtggaataatattaaaatgagctaaaaaatcataaatataagtttacattttaaaatttaataatataaactgatgaacaatgaagagtaaaaaataagtgagggaaaaacaatgaaaataggatttgaccatgagaagtatttagaagaacagtcaaagtatattttagagagagtagatagctatgataaattataccttgaatttggaggaaagctgtttaatgatagacatgcaatgagagtacttccaggttttgatgaaaatgcaaagattaaattattacataaattaaaggaaaaagttgaagttgttatctgcgtatatgcaggtgacattgaaagaaacaaaatcagaggtgattttggtattacatatgatatggatgtattaagacttatagatgatttaagagcatatgatcttgaagttaacagtgttgtaattacaagatttgataatcagccagcaactactgtatttataaataaacttgaaagaagaggaattaaggtttataagcataaatcaactaaaggttatccaacagatgttgatacaatagtaagtgaagagggttatggtcaaaatccttatatagaaacaactaaaccaatagttgttgtaacagcaccaggaccaggaagtggaaaacttgcaacatgtttaagtcagctttaccatgaatcaagaagaggtaatgtggcaggttattctaaatttgaaacatttccagtatggaatgttccattaaaacatccattaaatatagcatatgaagctgcaacggtagacttaaaggatgttaatatgatagattcatttcatatggatgcatataacaaggtttctgtaaattacaacagagatatagagagtttcccagttcttaaaagaataatagaaaaaataacaggaaacgaatccgtttataaatctccaactgatatgggcgttaacagagtaggttttggaatagtggatgatgatgctgtgaaagaagcttctaaacaggaaataataagaagatatttcaaaacaggttgcgactataaaaaaggatatgcagataaggagacttttgaaagatcaaaattaataatggaagaagttaacttaaaagaaaatgatagaaaagtggtaattccagcaagagaaaaaagtgcaaaactaagagaaaatgctgatgaaaatgaaatgtgtccagttgttgcattggaacttgaagatggtactatattaacaggtaagagctcagaattaatggatggtgccgcagcagtaataataaatgctataaaatatcttgcaaatatttcagatgatatattcttaatatcaccagtaatacttgaacctataagaaatttaaaatctaatacatttaatgaaaaaaatatttcattaaattgtgaagaacttcttacagctttgagtatttcagcagctacaaatcctatcgcacaagttgctatggaaaaactaccgatgcttagaggatgtcaagcgcattcaacaacaattttatcaaggtctgatgaaaatacttttagtaaacttggaatagatgttacaagtgatgctaattatccatcagcaagtctttactacaataattaatcaataattcatttcataaaataaagagtaaagtgtgaaaaaagttttacactttactctttgttttatcatggttttttacaatctatttatatatgtatttaaaaaaattatatttttagataaaaaatgatgaatgtttttatattcatcatttcaaaaactgatgggttttccccatattataagcaattcttattatagatttttcttcttttgtcattttacgtccaaacattttttcaaattgagatataagtttttctgtatctacttttagagaattagttggaatacggttataattagggttagaataaatacttggctttaaatttttattaaatacttttttaaatacatggcatgtataaaccgcatcattcaatgcgttatgaaaatcattttgtataggaatattccaaaattcaacagcagtttttaaaccaagtcggtttccttttggagtattgaattcttttgaagcaagattttgaatatcaatgtatttttttatgttattatgaatattaagactatgatagtggatattacgtattaactgttttatatcatctattccccatacacacattacaaaatcatttgatcctataaattttaaaaactctttatatactgatggaaaatgttcttcagttgcaaccatttcagtatttattcctgtgagttcttcaataaaaggatgaatttccttatataatgatggtttaatcaatctgttgaatgttgctattatttcaaaattatcattaagctttacagcaccaatttgtattatttcaaaaggcatttcacatgttttattatcacttgagtcagatttgttttttacagaactattttctattattttcttttcacagatacttttcgtatttatttcttcatttttttttgtatatagctgattaaattctaaatcaaatactatgtaattcatatttacttaccaacctttatgttaatcatcatgttttattatatcatgaaatttttatcataaaacacgatgaatctatttatatcaagaaattctcaatagcttgcaaatttaatatagaaatataactatattttgtttcaagccaattttgatttttaaagaatgataaggttttattaactgttggtcttgatagacctaggatttttgcgatatcatcttgagtataataaatatagaaaatattttctttaacaaagcaatgattgttttttatactttttacaatgaaatatgcaattttttgttttgcatctaagaatgttgaaattgaaatttgatcaaaaagtgagtttatatctcttgataaatcttgaattatacataaagaaaaatttggattaatagaaatatatttgtttacaatttccttatctattgagattatttcacatttagataaagctattacaaaagaacgtcttgtttcatttgtaaaaaatgaggatgttccaaaaacaccttgttttcttaatataaaaattgttctttcatctccgttaacggaagttgaaaatgttcttattgctcctgattttaagaaataaaagcagtcagctttatcttcctgatgaaatataaaatctcccttgttatatattttagcaggttgaattttttctaataatacacacattttatttatagaaatatcatttaaaaaagcctttatattatacatttttgtaatctccttaatacctatctatatattactatacagtttattttaataaatgttaactagttaacatttattaacataaatttttgataaaattagtaattgagaaaaacatagtaacaaaattcataataatagagggagatttatatgcagaataagaatataagaaaatttataatttatattatagggttgtttatattggcgataggaattggactatcagttaaatcaaatcttggagtttcacctgtaagtacaattccttatactattacacttactttaggaattgaaatgggacgtgctactgttttgttttatatagttcttgtgttaattcagatattgattttaaggaaaaactttaagattatcaatcttgcacaaattgttgtagcagtatgttttggatattttacaactttttcaaatgaattaatgtcattttttccagacccacataagtatatttttagattattatttctttttacaagcattgtatgtgttgcattaggtatattattatatatgtcaagtggattaattccacttgctggagaaggtgtgatgaaagctgtttcattaaaaacaaaaattgatttttcaaaatgtaaaatgggatttgatataactatggttgtaatatctacagtggtgtgtttttctgtcttaaatcagcttggaagtgtgagggaaggaacattaatatctgcaatttttgttggagttgttttggagatatttacaaaatgtttgaaagacaaaatcaataaattcattaatggagaaatggaattagcataattaaaaaactgaccagtggttatctaaaaattagtagattatccactggcctttttagttaagagttaagatatctatgaatcattagttcaaaagtttctatacagtatgcaaaaaacggattgggataatagttatcattatccattttctcacaatctggaattataaagattatatctgaatttttagcaagtgtactttctacattacctgtaaaagatattattttaagattacgttctttagcatgtatacatgaatttacacaatgatttccctcaccagattttgaaacaagtattattgaatttattgtatctgcatgattgtcaaaaagaatatcaaagtctataaaagtagatagaatgctttttttaccaagaactaataacttcatatacatgtatttggatacgatttctgaaaagccttcacctgaaataagaatattcccatcttttatgcattcaataaaatcttcacaagctttatcataatttgtgttaaatatatttttatcgttaataccatcaaagaaagtatccaaagtttcagtagaaagtttattttttaatgaatacataagttctacaaatccactataacctaatttttttgcaagacgtattatagtggagggggaggtgaaattatctttagcaatagatcttatccctttattgatacatatatcaatgttttcaataagatatgttagtattgtttcttctatttgtgacagttttacatttccaaaaagttttgttatatcaagcataaaaattacctcttaatcattttttatatcttaatttattagaaaatgccataattagttttataaaaattactagtaacagcatttaaatttaaattaaatggaaaaaacattaatatcaatataatgataacatgtttcattctacgataacatatttcgagtttgtctataattattttattctgcaatttagtatgataatatgtaggtataaaagatgtacatttttattatatattatttaataggaagagggaatgaaaaatgaagattattgttgctgataattataatgctatgagcagagctgctgctttaactataaaagaacttattaataagaagcatgatgcagttttaggattagcaactggaagtactcctataggaacttatgatgaacttataaaaatgaataaaaatgatgaaatagatttttcagatataaagacagttaatttggatgaatatataggtttaaacgaaaataataatcaaagctatagatattttatgaatgaaaagttatttaatcatattaatataaataagaaaaatacttttgtacctaacggaacatctgataatattgaagaggaagctaaaaattacgataaaatgattgatgaacttggtggtatagatcttcaaattttaggaataggtaataatggacatgtagcattcaatgaaccagattcttctttaagtgtaggaacacacgtaacaagtcttactcaaaatacaatagaagctaatgctagattttttgaatctatggatgatgttcctaaaaaagcaataacaatgggacttggacagattatgaaagctaaaaaaattatacttcttgcaaatggtgttaataaagctgatgctgttaaaggacttttatcaggtaagataacaacagagaacccagctacattacttcaactacattgtgatgttacattaatcatagataaggaaatatctaatgcaatagaaaatataaataattataaacatgctatttagtattgccttttatgaaaagaaatactagtatttgtaatatatagactgttaaagcacattttagagctttagcagtcttaatttttattattaatataaggttgaaatttgtatatttaatatgttactattagttctaaatataaaaaatctagaactaaataaggagaacatatgaaaaaaaatttaattttaatactgataattgtattgttaggtattttattagcttataatgcgtttgataacaagcataaacaaacaatagaaaaagagaagacaagtgaagaactaattagtaaagatagtaatttacaatcaaataatgataaagaaattggaaatgaaattaataaaggttcggaatcagaaaaagttagtatgaataatattgatgtagttattggtgatgaaaattttattagtgatatggataatatttttgttaacctagataattatgttggaaagactatgaaggttgagggctttgttggcggagttataggtaatgaatttaaagttttaaggttatatgatatgacccacgatgatcattcacatgaagtaacagtaggaataaatgtagtttatgatggtgagattccagcagaggatacttgggtagaagttataggagttataacaaaagaagcaattgatggaaaaaatcagccagttattaatgttcaaagacttgaaaaaaaatttactcatggtcagaaaaaagtttataactaaaaagtattaaaataaaagtggaatttaagaacataaaatcatataaagttcattgtattttatatatttagagtcttacagaaatataaattttctgtaagactttattttgtaataaagttatatattatgttgaaaaaggcaaaaaattttcatataatgtatgtaaagtaataaaattacagaatgggagtaaaagtatcttgaataatagagaatatacaatagaagatctagaagaacttttagataatattccatatgaagtatggatgaaggataaagaggggagatataaatatgttaataaatatttttctcaaaaaataggatgtagtaagaaaaagattattgggaaaacagatttagatatagagttagaaaagtcacctgttgtaaatgaagaaaaagtctattatgaaatatataataaagatataaaaagagaaaaggaaatcattcttggtagtatattaaaagagatgaacggggaaaaaaatatacaggatgctataattgaaaatcttatacatattacagataaggatgccgaaaaaaattataaaaagtatgatagtaaaattttatttgaattaaagaaaaaaataaaggcagacgatattgctatatatttatataataggcatagtaataatatgagtttgtatgttcaagaaggtagtacaaaaggaattttcactacaaaatatagctttaatgtttttggacaatttttgttgaactcaaaactaaataaaatagttaggaactttaatggatgccagacacattatttgtatccaattagagctaaagacacactgcacggaatgattgagatatattataaaaatgatgattcaaagcattatataggagagagtataataaagcaaatatcgattcttttaggagtaagtttagaaaatagaactattgctaaacatttaaaaacagagctaataaaaagagaagatgtacaaaagaagcttgaaatggttattgatacggttatagatatttatgcattgattaaaaagaaaaataatatgcttcaatggatagatataaataagaaatgtatgcagattatagagtggacagacaaggatttaatagatagatctccattagaattagttcatgcagatgataaagaagatcttaaatttgctgtggaaaatcataaagaatataagaattttgtatgtaggatattgtgtaaaagcggtaattataaaattttaagtattaattggagtaatatatcaaatggaaatattataattacaggaaaagacataacaaatgaaagagagcttttaaaggataaagaaaacttacagcaagcagttgaagttgaaagtttaaagactgaattttttgccaatttatctcatgaatttaaaacccctcttaatataattttatcagcggtccaggtgattctatcttgtataaacaataatcttgaatctcttagtttagataaactattaaagtatttaaaaggtatagagcagaattcatatagactattaaaattagcaaataatatgattgatataactaaaatagatggtggattttatgaagtagagatggataatcataatattgttgaggttattgaaaatatagttcagtctgtagctgaatatatgaacaataataaaagaaatattacttttgatacaatggaagaagaaattattacagcctgtgatcctgataaaatagaaagaataattttaaatttattatcaaattcaatgaaatttacaagtgttaatggaaaaatatatgtagatatggatattacaaaagattgtaaaaatgtaattattaaagtcagaaatgatggaccagccataagtcccgaagattctaaaaaaatatttaacagatttactcagtctgagaatcttcttacgagaagtgttgaaggaagtggaattggattagcattagtaaaatctttagttgaacttcataatggaaagatttatgttaatacacatattaataatggaacagaattttgtatagaattacctataagaaaaataatgaattcaactatgagtcctgtattaaataaaagtataaattctaaagtgcaaaaatatacaatagaattttcagatatttatactttaaatcagtaaaatatagtatttaataacattattgtatcattgaaataagacttaacttatatttttataatacaataatgttaaattatataatagtactttgtttatctaagtatatgaatttattttaaatagtaattattttaaactaaatataaatgtttttagaaatggtaatatatgaaaaaatcatatatatttttttattgccataaggatatagttccaccatttaatgaagcaatatctttaagcatagtcataactttatcattatttagtaaattttttattttactactttcaaaggtttgagaatttcctgataaatttatttcaccattagaattcacactaatatctgttttgtttttttctttactttcttcttcttctttcttttgttctgcttcaataatatagtcaagcattgttttagaggcgtttttataagcttccttttcttcttttgataaaggacattcaaatctttgtccattaataacaacccatcttttttcaccatctactccaagttcatcccacttacagctagcattattagtggaataggatactatattattaaacgtgtttttatcaacatataatgttgtatttgctgcagtacctttatctaatgataatgatccaataccacgtgttctttttgataaattaatttgatcatttgatgtttgagtatattttacattttgaaagtctgtttttacagagcttcgctcacttttatttgaaatttgttcttgtgaataatttaaagtattttgatatgagcttatattattatatatgttcattaaaaaatcctcctatagtaataatttgtaatcatttaattatcgatgttttcaattggttctttaattgaagatccacgtttaagctagaagttttaatttatataaataaaaattaaaacataatgtggaaaataattaaaaaatgtaacacaaaatcttaaaaatacatattatatactaaggttaaggaattaaacctaatcaataaacaaaatcaaaagaaaaaatagagaggtgtaatgtatgaataatcaatcatgcagaggtcataaatattatcaaagtagatatagttcagttagtggagctagtaattctgagagcttatcttcaagatcatatagcagtatagctagtagtgcttcatcaaatagtagttcaagaagcagatcatttagtagtgtttcatcaaacagtagctcaagaagcaattcatcatcaatgagtagttcaaatagtagttcaagaagtagttcatcatcaagaagcaattcaaatagtagctcaagaagtaattcatcatcaatgagtagttcaaatagcagttcaagaagtaattcatcatcaagaagtaactcaagtagtagttcaagaagtaattcatcatcaatgagtaattcaaatagtagttcaagaagcaattcatcatcaagaagtaactcaaatagtagttcaagaagcaattcatcatcaagaagtaactcaaatagtagttcaagaagcaattcatcatcaagaagtaactcaaatagtagttcaagaagtaattcatcatcaagaagtagctcatatagtagttcaagaagtaattcatcatcaaggagtagctcatatagtagttcaaggagtcattcatcatcaaggagtaattcacacagtagttcaagaagtaattcctacagcaaatcagaaagtggatcaagaagttattcaaaatcatatagcaacccatatagtaaatcagaaagttactcagaatcatatagtgagttttaattaatattaggaaaaagtaaaagaaatagtatggataagtattacaaacgaggagaaaaagtaaaggacgaatataccattataaaagaacttggtgaaggtagatatggtattgcttatctggctaaaaatgataaaaaagaaaaagttgtagtaaagcagcttaaaaaaaagatgcttaaagaaacaagagaaaagttgttttatgagcagaagattctgcaaagtcttgataatcaagcattccctaattttattggaaaatttaaggaccattatagagaaggctatatattagagtattttgaggggactgattttgaagatttaatagtaaatgagaggtgcagatttacaaaagaagatatttatcatattgctagccagcttttagatttaatggaagttttgcataaaaacaatatagttcacagggatattcgtcttcctaacgttatagtaaaaagaaatatggaacttgctgtaatagattttgggttggctagatttatagataataaaagatatgtaccacagacagactactggtatttaggggattttcttattcacctgtattatactagttataaaaatattaatgatgaagacaagccttggtttgaagagcttgatttaactactaatgaaaaaatttttcttaaaaggcttatgggattagaggatgagtataataaccttcaggaaatcagagaacagctggagaaaataagaaataacaataactaataatcagtaaagtaaaccatgtaatttatatagattcatgattgcatggtttatttcaaaagataaaatagggaggcatatattgtggccaattcaatcggtataatgaaaatatatcctgatagtttcagggccaatatttacggactacaaccctttagaatgataggtctaattgatgttgggataatatataatgaaagcatagaaagagttactttacctttttttagatcgtcaggtacaaatagcggtaaaataaaaggattgtggtatcctattgcaggaattaaaacaaatgatgggagatttactgaattcacatcatatataaactatgtattatcccacacaacaaggaatggaagagcaaataaaggatggcttgcgaaatctttattttttgataatataagagcacatgatgattctaaagttagaggattttcaagtggtagacattatgaaagtttatattggataggacagacacttagagaattatatgaaaatggtcaatataaagagatggagtctctgaatcctgaaacattaaatagaactgtaacttcaaaaaaaatatatcacggaaataaatattcccaaaaagaaaatttcgaaaactatattgaagatatatttagaggagtatagtaattaatacaacttctttagtaagattgtaagatgaaaagacttttgcagaaatgcaaggtcttttttatttgtatttatcaagtatattgaaaagatttatgagaattaatttatatatacaagtataatttttgtagtatgattttagctttatataattattagagagtagtaatgtttttattatcaaaaggaaaatataatataactacaaattacttgataaattatatggattattagaataataaaaattatgaaaaagttttctgaaaatgttgacaaaacatatacgtataagttattatgaatttacacaaacatatacgtatatgttttgaataaaacaagggggagtttaaatgtcaaaatatagtaatgatataagagaacttttggattacatcggagggaaagataatattggagcagtttcacattgtgctacaagaatgagatttgttttaaaagatactaagattgcggatgaaaataagataaaaaagattaagagtgtaaaaggtacatttacgcaagctggtcaatttcaagttattattggaaatgatgttcctacattttataatgaattcacagaaattgcaggaatagatggagttagcaaagatagtgtgaaaaatgcagcaaaatcaaatatgaatttggctcaaagattaatgtctaatatagctgaaatttttgcaccacttatacccgcacttataattggaggattaatattaggctttagaaatataattggtgatattaagatgtttgatgatggaactaaaacacttgttgaaacatcacaattttttgcaggggtacacagttttctttggttaattggtgaagctatatttcattttcttccagtaggaataacatggtctattacaaaaaaaatgggtacaactcagatattaggtattatattgggtataactttagtatcaccacaacttttaaacgcatattcagtagctggtgcagatactattccattttgggattttggatttgcaaaagttaacatgataggatatcaagcacaagttataccagcaatacttgcaggatttacattagtttatcttgagaaaactatgagaaaaatatcaccagcttcaatttcaatgattattgtaccactattttcattaattccagcagtaataatagcacatgttgttttaggtccaattggatggacaataggtagctgggtttctaatatagtttatagtggtttaacttcaagttttagaagtatatttgcagcaatttttggttttttatatgcacctcttgttattacaggtcttcatcatatgacaaacgcaatagatttacagcttgtagctgaatttggaggaacagcattatggccaatgattgcactatctaatattgcacaaggttcagctgtacttgcaatgatttttcttcaaaaaaataatgaagaggaaaaacaggtttcagtaccagcatgtatttcagcttatttaggtgttacagaaccagcattatttggagttaatatgaaatatagatttccatttatatgtggtatgattggttcagcagttgctggaatattctcagtatctacaggtgttcttgcaaattcaataggagttggaggtataccaggaatactatcaatacagccacaacatatgtttatgtttttaatatcaatgttgatagcaatagttttaccatttgtattaacagtaaccattggaaaaagcaaattaacaattaaataaggcttagtattatagaaaatatttttctataataccttttaaatagattataaataaatttggaataatgtttcattaatagaataaatagtataaatattttattccatatagctatataaggagaatattagacatgaaagattttaaaaaaagtactatatatcagatttatccaaaatcatttaatgattcaaatggagacggaattggagacttgagaggaataatcgcaaaattggattatttaaaagaattgggaatagactgcatatggcttacaccattttatatttctccacaaagggataatggatatgatattgcagattactataatgtagatcctttatttggaacaatgaaagatttcgaagaattagttgaagaggctaaaaaaagaaacatagaattaatgttagatatggtttttaatcatacatctactgaacacaagtggtttaaaaaggcattgaatggagatgagaagtataagaatttttatatatttaaaaaaggaaaaaatgaagaagcaccaacaaattgggtttctaaatttggaggaagttcatgggaatatgtagaaaagttcgatgaatattatcttcatctcttcgataagactcaaggcgatttgaattgggaaaatgacgaggtaagatcggagatatacaaagtagttaatttttggattaataaaggggttaaaggattccgtttggatgtaataaatcttatctcaaaaccagatatttatttgaatgacaatagtgggatggaaagaaattctatacagatggacctaaaattcatgaatttttaaaggaattaaatgaaaatacatttggaaaatatgaggatattgtaactgtgggggaaatgtcatcaacaacaatagaaaactgtgtacgttattctaatccggaagaaaaagaattatcaatggtgtttaattttcatcatttgaaggttgattataaaaatggtgataaatggacattaatggattttgattttaaacaattaaagaaattatttaaggactggcaaaatggaatggaaagcggaaatggatggaatgccttgttctggtgtaatcatgatcagccaagaattgtatcaaggttcggaaattgttctcagtatcataaagaaagtgcaaagatgcttgcaacatcaattcatatgatgagaggaaccccatatatttatcaaggggaagagtttggaatgactaatccagaatatacatcaataaatcagtatagagatgtagagtcaataaatttttataatatcttaataaataaaggtgtagataaagaaaaggctattgaaatattaagggaaaaatcaagggataattcaagaacgcctgttcaatggaataataagaaaaatgcaggatttacaagtggagaaccatggattccagttggaaatttatataaaaatataaatgcagaaaatgcattaaatgataaagactcagtattttatcattataaaaatctaataagtcttagaaagcagcatgatgttatttcagatggaagcttcaatattatattagaaaatcatgataaggtatatgcttatacaagaagttataaaaacacaaatcttatcgtgttaaataatttttatggtgaagatactgaagtaactatagaaaaagaacttatagagggaaatagcaaaatattgatatctaactataaggatagtggtagcttaagtaaaaatataaaattaagaccatatgaatcaattgtatatataatagagaaataaaaattaaatgagtttcagaatcatatactatatgattctgaagcttattatattttcagtaataatagtaaattaaaatatagtattacaatttatcattattattattattattattcatttcattgagaaaaatatatagagtatggtaaaatactattggtgatgaagatgagtagtaaatattcaattatttataatgaaatagtgaataaaatagaaaatggtatatataaaataaatgatcaaattccatcagaaagtgaaattatgaatgagtattgtgtatcaagagatactgcaagaaaatcaataagtcgtttggaacaaaatggttatattttaaagaaaaaaggaaaacgtggcatagttttagatcgaaataaatttgattttccagtttcaggggttgtaagttttaaagagttgtcagataagctaggacaaaatattaagacaagtgttgaaatattggaatgtattatgccttctcagtctataaaagataaattggaaattggaattaacgataaagtatggaaaatagtaaggacaagaaatattgatggtgaaaaaattattttagataaagattatcttgttcaaaaatatgtagataacattacacatgaaatatgtgagaactcaatttatgaatatattgaaggaaagcttggattaaagatagcttatgccaagaaagaaataacagttcaaagtgcaacagaagaggataaaagatatcttgatatgaaaggttttgatatggttgtagttgtaaaaagttatacatatttagatgattcgagtttattccaatatacagaatcacgtcataggcctgataaatttatatttgtagattttgcacgacgtcatgcttgaatattaaaatagataagtgaagtatcacttatctattttaatattctaataaataatataaatgcactaagttaataatttcgctaaactcagctttagcgaaattatttaactcagtagtaatctaaaaacaaataaagctccgtattcaaaacagagctttatgataaatagagaataaattatttacttaaaatttcatttgctaaactattcataatttcaatgtcattagctttagctacagattttattgaaattaaggaattgcagattgagatattcttcataccttcaaaaatagctttcatgcatttcccagcagctggtgcccatgaactattttctataattccaacttttctattttggaagtttttatgctttaaatgtaataagaaatcttccatacaagggaacattccaccatcatatgtagcagcagctactattaatttatcgaaacggaatgaatctgcaattacttgtgacatatcagctcttgaaaggtcatataatacaacattttcagcacctttatctttaagtatttcaaccatttttttagcagcatctgctgtatttccatgaatagaggcataggcaacaacaataccttcttcttctggagtatagctgctccatttatcatatttatctatataatatcctaaattatcttttagaattggaccgtgcaatggacagattgttttaatatctaatgttgcagccttttttaataatgtttgtactggtgcaccatatttaccaactatatttatataatatcttcttgcttctggagtccaatcttcatctatatcaagtgctccgaattttccgaatccgtctgctgaaaataaaatcttttctgttttttcatactcaaccataacttcaggccagtgaaccattggcgccataaagaattgaagagtgtgacttcctaaagataattcatcaccttctccaacaacaatttttttatcgtcaatatccatatcaaaaaattgtggaagcatgttaaagattttagcatttcctacaatcttcatatcaggatatttatcagctaaatttttgatatttgcagcatgatctggttctaaatgtgaaactactaaatagtcaatatttcttccatcaagagtagtttcaagatttttgagccattcacttccggccctcttatcaactgtatccattacagcgactttttcatctaaaattacataagagttataagaaactccatttggaattttgtattgactttcaaataaatctagtgttttatcgttgactccaatatattttacggaatctgagatataagttttgttcatatttaaacccttctttcaaaatattatatttatatacaattactagaaataattaaataataataattataaattatatcataaaattagtcaaaagatttaacttattggctaaaaaataataattatcgataaaaaataaatatattactacttttatctatataaaaaatatattattgatttctataagtatattctatatttattatactataaataataccatttatatttcaaatatgagaatttattgttgtaaattaacaaatatataactgaaatatatttaaaatatatgaatatttatatataatatataagatgtaaagtaaagatagtaatattaaataggaggcgttttatgacatatttaagttatatagtagatgtgtttttacatcttgataaatatttgggggtcataataaataattatggatttgaaacatatcttatattattttgtataatatttttagaaacaggtctggttgtaacaccatttcttccaggtgattcattaatatttgcagcagctactttttcagcacttggaatgttaaatatatatatattgataatagttttaattgctgcagccattttggggatactgtaaattatgaaataggaagacatttaggtaacaaaataattaaaagtggtaagtttataaaaaaagaacacatagataaaacaaataagttttatgaaaagtatggtggaaagactattatttttgcaagatttataccaatagtaagaactttagcaccatttgtagctggtataggaaagatgaattataaaaaattcatttcttttaatgctgttggggggagtttatgggttctgattgtgactttattaggttacttttttgggaatataactattgtgaaagagaactttactatagttattatggggataatattcatttcagttcttccagtgatattgaatttatttaaaaagaaacagcttagctaaaaacattacttaaatcaatgatggtttatgaaatacttataaaagtttgatctttgaaaggggcacatttttagaagggaatagtagaatgttagaaagaatatgtgtacaatgtgggaaaaaatttaagattgaagattcagaaatagatttctataataaaaaggatcttaatttacctaaaagatgtaaagaatgtcgagataaaaataaaaatagtaacgataaaagcgaattaaaaaaagagacttcaaataaaagtgaaaatataaaattaaacaataagaagaataagaatttatggaagataataatagcatcaattgttgttattatcggattatttgaaggaggcgctaattactatagtagtttacactcaaataaaaataattcaactgtacaaaaaaatactagtacatcagaaaataaacaaaatcaagataagtctttaatatatgagtttagaacagcaaaagattgtgcagatcactttaaaaaacatgggaatgagttcggatataagactgagcagcaatatttagaaggtgcaaacagagtaattaattcttccgattcattacataagaaagaaaaggaagatggggatgatgtgtattatcttaaagatagtaatgaatttgtaatagtttctactactggatatataagaacttactttaaacctgatgatggaatagcatattataatagacagtaatttggaaagaaaacgtaaaatataatatttgagttagaggttttaaattaaatacacccattatataaattatttatgtaatgggtgtatttttaatataaaaggttttgaattagattaatttattaataccatttacattagcttgatctgtatcatcaactggaattacaagatatttcttaccctcgattatttgatattttatctgatcaagcttctcaggttttacttgaagtactatatcataatctgaggaagaagaattttctaaatcagaagcagcttctaagtgtgcatcagaatttttgacatatgatgaatcgctatttatatcttcgtcagtattttcactttctaataatgattcattttctgaagctatatgactattttgatttatagattcaagattagtttcagaatcgtctttaaggatttttaaagatgattctgattcattatttagagattctgattcagacatagaactttcatcatttaagttagagctattaataaattctgcagtatctgaattttctatatcagatttgaatgtttgttttgtaatttcaagtttattttcaagcattttaacttgcttttctagtcttttttctctctttttctgctcattttttgcaagagtcttagaatcaattaaattatcagctaaaggaggtgtatcaccaaattcatctaaataggatttctcaatttttactgatatttcttcagggacaccactttcaataagaagatctgaaatagtattgtcagtaagtagaatagggtctgcatcatcaccatttacggtattatgatcatctaccagtgtatttaacgtatcttgaatttccatgaatatattttcagatttttcatcatcacttcctacagcattacgaataatatttgtaaatacctctttttgttctgcagctgtttgttttgaagcacatccaagggtaccttccattaattcaggatgtgtatcttttggattttttgtataatatataacagaatgtatgtcagaacttctttctataaaagcaggaaatataaaactattagtgggactttctactacccaatcccttgtacgagcacctattctattatcgtctgcatgatagcttaatcctggttttgatagtgatactggacatatagcacataatatatattcataaacttcttcagattcatctaattttgaattatctgtagtttttgtaataacatcataagcatcatggaagagaagtatcaagaaatttccagtataatcgtaattgtttataatattattgtaaaattcatcaagtagagcttcattttttagtccgcttttttttagttgcataagactatactgtcttccaccttcttcttcctcgttaaaaggaaattcaagttcaagcaggttgttacctattgttcctgataatgatttttttgcaatttctaaatatttaaaaaattcatcttcttcaagattcaaaaaagtttcattaaattttaataggatgtttttttctccatttacatagcatccacacattttagtaaatgtacagtcatctttttttaaacgtcttttcaattctaatatatctttctttctcatattctatcctctcatttcatgagttttaattagtatataataaagaatattttaccaaatgaaagtacattattcaatcaaattgtaataagaatagtaagagattatgattatataggtttatacattaattaatttgtaaatatattaatgtataaagttagttattgcgcgaggttctttatgtggtaattttaaacctgctttttttccaatatttatagattttaagagccaagccatgtttcggcctagagttctcataatttgcattccttcaagatcttgtctaacttcatctggagtgttcccgtgtaccatattccaatattgagatgacacaattggcatattagaaatagtgaaatatttatttaattgatcaaaagcagctgttgagccgcctcgacggcagcttacaattgctgcaccaggtttgtatgcaagaaattttcctccgtaagcatagaaaagtctatctaggaatgaagttaaactgccagaggcagcagcatagtgtacaggtgatccgaagataattccatcagcctctttaactttttcgatagctttatttacagtatcatcattaaatacacatctattattagatttacatccaccacagccaatacaccctcttattggctgattaccaatatgaaaaatttcagtttctatattttcagcttctaattcttttgcaatttcatttaaagcagtataggtacagccttttaatttaggactgccatttataagtaatactttcatttttacacctcattttatttataaacaataataaatttgatactattactatataacaatatagttaaaagaggaataacgtactttaaagtaagatactatacagaatgatagttattagtgataggaaaaataatttttagatatattagaaaaggagattaaagatggagtttagaaaaacaattgaagaagatattgattatataatgaatattattaagcaggctcaggaatattttaaagaagaaggtattgatcaatggcaaaataattatcctaattatgaaacaataaagaatgatattaataatggagaaagctatgtattgatagaaaacaataatattatagctactatagcagtttcatttaaaggagaatcaacatatagtaagatatataatggagattggcttactaatgatagatatgcagttatacatagggtagcagttgataatagctataaaggattaggaatatcatcaaaaatcataaaatatgttgaattactttgtttagataaaaaagttagtagtattaaagtggatactcatgagcaaaacatgtctatgcaaaagttgcttgagaaaaatagttttgtatattgtggaaagatctatttagaagatggtagcagtagaatagcatttgaaaagatattataaaatataaaataatatgcgaaaaaatattattaaaataaaatgagtgagggttgaaattttaaaatattactgtattatttaaatgtatataaattaaagaacgattatttgtaattaatacacttagaaagctataaatagattttcatatttaaaatctaaagattagtataaagattcacttaagatttagggggacgttatgaaaaaattaaaaggtgtactatttgatatggatggagtgatttttgatacagagaaagcttatcttgaaacttggaccgaagtttttcaaagatatggatatgaacttaagaaagaaacatatatatctataatgggaactggaagagataacgctgtgagaacttttaaaaatgtttttggagagatgcttccaatagaagaaatgtataaagtaaaagataagatgcttaaagagatagtagaaagtggaaaagtttgtatgaaacctggagttaaggagctgcttttatatttaaaaaagaataacataaaaactgctcttgccacaagtgcgagaaggtggcgtgcagaaattcagcttgaaatggctgaaattaatggcttgtttgatgttgtagtatgtggagatgaaataagaagattaaaaccaaatcctgaaatttttattaaaacagcaggaaaacttgaattagaacctgaggaatgtattgttattgaagattcaccagctggtattaaagcagcttttgatggaggaatgtatggtattcatgttgaagatttaaaagaggctgatgaaaatatacttaaatgttgcaaggcaaattttaaaaatcttatagaaattaagacatatattaaggaagaagttcttaaataacaaaattaaaatagctttgataactataaattaattggaaaatgttagagagttatcaaagctcctcttattattaatagtaaaaatataaaataacttatttactttttatacgggttttttcccaaaagtttgacattttatattgaggatcatccgtaacctcttctccaaaccatttaggtggtgtaaataaaacagcatcttctgatgaattgaattcaatttctccataaaaaaactcagttgaccttcctatatctgtgactcctagggttaattcatgattattaactgaatatttgtagaaatgtttttcaataaaatcttcttcttttatattgcctacaaccataagttcattaaattctttttctgtaagttccttctgtacttcaattcgttcaagagttcctttgcttttaatgcataatgcataggtgaaattatcctcgtctgctttccttcgtgatcttatacgaacttcaggatttatacttatatatgcttgtttataaaaatattctccgagaattttagttcctttaggtgcagcaattgatttaaataaccattttctttctatttccatatgtatcaacctttctaaatagtatatgattaagtttctattagtgtttataattatattagattaatagtatattctctttaagcctaatactcaagttactattattatgatttactttaatattttacataattagcttgaaataatttgaaattaaattatagatgaactaattatatttatttgatttttaccatttgtttttgatttatacatggcactatcagcattgttcatgcaatcatggatattatcacaagtattttcataaacaccaatacttaatgagattggtctttcggattcgttaagagtatttagacgttcaatttttttcataatgtcttttccaatatctatagcttcttcttcactagtattaggaagaagaagaataaattcatcaccaccaaacctacctgcatatcccttattatcagaaatatatataagtattgttgcaacatcaaggattactctgtcaccatataaatgtccataagtatcattaattgatttgaaattatcaatatcaatcataattacagaaaatttttcattccaataaatatatctatctatcatattggataatagtattttaatgtatttgttgttaaataaagaagttagtccatctgtatttaacttttcgagtttttttatactttgaagataatcaataataatataaaaggattctacaattacaaaaagaataccaccatataatgcagaataaggattaggaataacagagttattaactagtatatcatttaatgcagttaagcataatacaataaatgatataaagttaagcattatatttttatttttgttaattaattcttttatcataaaaattaagacatatacaataaatattcctactattatctgaggaacggtttggattctatcatatataatatttggtgttaaaagacataatattgtgaaactccaaccaaataaaatagcaggtttttttatatagagtctattgttaaaaatatcattcaaaaaaagaacataaaaagttgcccaaagataaaaagttatagctgcagttttacttataacttcaaaagggatgttgggaaaaaattgaactaataatcggctattaaatactagacagcgcaaaattagtactaaacatattatggaaaaatatagatgtcttttttgttttgttctagcaaagaaaaatccagcatttataataaacataattaacattataccaatagtgaatccatcgacagaagtttttataaaattaagttttgttatgttatcttttactccaaatattggagaacgtaaaaatggttctatttctctatatacacttgtatttataacaatatcaatttgattattctctgaaggaaagaataaatattgaggtctatagctagctttttcatcattaaagttttttccaattttaccgtgtcctccatagttaatattgtttatccatatttctgaagaagtaaaaagaccgtaaaaataaataccatagatatcgtcttctggtacttgaatgcgtaggtgtaatgtcatgtatccacttttaacattttctatttgattacttaatcgtcctggtatagcataaaagttactaggggatctcttttctgtatcttcaggagttaagagttcattatagtataaatcccattggccattgagttttacattgttattttttaaaatggaataatctgaatatgtgattgtcccattttcagcctcaatagtatctgaaaagtttgctattggaataaatacagttgaaatcataattataataatcaataaaaaaaagtgatttttgtattttaaaaacatagttattagctcctttaagagttcagataaatgtatatataattttaaaaatattttttctatatattaaagaaaaattacaatgtagtatacaaatatgattatattatacaatattttcattaatttgtaatttaaattagaaattcactaatgctatctgaaaataagaataaattattaagaataattataagaaattagtatttattacttgggatactttagatatatagaatggattgtttgataaatattatgaataaggaggtttcatatatactaaacctccttagattttagaaatgttattaactcatgctaaaatttgaatactttttaggagatacacctacagcttttttaaatgatttaagaaaattgctgtaatcattaaacccacaattagaacatacatcatttatactcattccattactaagcatagattttgccattgaaattcttcgtgccgtaatatatttattaattgtggttccagttgataatttaaatattcggcatatatatgattcgcttaaaaagaaatgttcagaaagatgttcaattgacatattttcagaaatattatcatttatataacgtattatttcttgaatttgattattatatttatactgtgaacttgataaatccttattatcaacataaattttagttatagatgtaataagttctataaaagttgcatgttcaatcatgtccgaaccaaatccttcacatgcagctattttatttataaaatacatgaatctattttgctgttctttatcaagactgattttatgtataaaattattatcacgatgagtaaagcaataatttaagtctgtttttgtactagatatttgttttaaaaaatcaggatgaatagaaataactattctttcatgaatcatttgacttatctgagatacatagtgactttcaaactgattgattacaaagagatcaccaggattgatatcataaaatttattatcaattaaaaactgtttacctcctgagattgaataataaatttcataacagtcatgtatgtgtattttcatagtttcttcttcagtgtgtagatgagctattgaaaagctttttgttttgagacagttatcgattgattctttgcaggatgtacaatttttcatcataaactcctttactatataattaatatttataatttaattatatatctatgttcaatatttgcaatattttgagtaaaaaatcacaagaaatagagaatatatatagagtataatgaattcagaaagtaaaactaagaaaaaaggagagacaaatatggatataatgaaaaacttctcactagaaggtaaaattgcattagttacaggagcatcatacggaataggttttgctattgctaagtcatatggtaaggcaggagcaacaatagtatttaatgatataaatcaagaactagttgaaaaaggtgtaaaggcatatgcagaagagggaattgaagctcatggatatgtatgtgatgttactgatgaagaaatggtaaatgaactagttgctaaagttgaaaaagaagttggaataattgatattcttgtaaataacgcagggataataaagagaattccaatgcttgaaatgaaagctgaagactttagaaaggtaatagatgtagatttaaatgcaccatttatcgtttcaaaagcagtaattccaggtatgattaaaaaaggccatgggaaaataattaacatctgttcaatgatgagtgaacttggaagagaaactgttgcagcttatgcagctgctaaaggtggacttaagatgttgactaaaaatatagcatctgaatatggtgaacataatatccaatgtaatggtattgggccaggttatattgctacaccacaaactgcaccacttagagagttacaggctgatggttcaagacatccatttgatcaatttattatagctaaaactccagcagctagatggggaactccagaagatcttacaggtccagctatatttttggcatctgatgcatcagattttgtgaatggacatgtattatatgttgatggtggaatattggcttatattggaaagcaaccacaataatataaattattttctataaataaattaatattaaatatgataatagagtttgatattaagctaacaatgtgcgatataatctgtcttagtaatatacagattacgtcaaattaaaatattattaaactatgttttataaaactataatttaaacaattggaggaataaaaaaatgaaaatagctttaatcaatgagaacagtcaagcagctaaaaatgaaattatatattctacattaaaaaaagttgtagaaccaatgggacatgaagtatttaattatggaatgtacagtgctgaagatgaagctcaattaacatatgtacaaaatgggattttaacagcaatattattaaattcaggagcagctgattatgttattacaggatgtggaactggtgaaggtgctatgcttgcatgtaatgcattcccaggcgtattatgtggtcatgttgtagatccatcagatgcttatatgtttgcacaaataaatgatggtaatgctattgctatgccatatgctaaaggatttggatggggagctgaattaaatcttcagtatattttcgaaaagttatttgaaggagagagtggacaaggatatcctaaggatagagttgttccagaacaaagaaataagaaaattctagatgaagttaagaaaataacacatagagatatgctttcgattctaaaagaaatagaccaagatttattaaagggtgcagtaagtggtcctaaattccaagaatacttctttgcaaattgtaaatgtgaagaaattaaatcatatatcactgaactattacaataatcaaataaatttttattaattacactatatattacaactttatatgtaaacgcatataaaaagccgtaaggaaattttcttacggctttttatgtgttaacatttctctggataaagttttaaaaatatatttctcacaaatggagaaactataagtaaatttgaatatgttgctataagtaagtttgaatttttatattacattaagaaaatgcttttaaaagatttaaataagaaattaaaagttatatattgaggagagatatcgatgaagaactatcttgataatatgaatcttgtagatcttataagtgaaatgcataaaattttacgaaataaggttaacaatgtatgggataaaaataatattgaaaaaataaatcagacagagtcgcatatactgggtattttgggaagagaaaaaagaactgtagcagagctatcaagagacataaatatatcaagacaggcagctcataaatgtgtacagaatctaattgaaagaggatatttaacagttgaaagcagagaggggagcaataaagagaaactggtacgtctaacagttaagggagaaaagtgtaatgatgatatgttatttataaagcagaaaattgaaacagaaataattgaagaaataggggaatcctctgtagaaattattaaacttttgttgaagaagaagtggattgattagaaaaaattacgaataaatgtaaagtaagctgactaaaatatgtgtggttttactttataaatagtatacaattaataatcaataaattaattattgacactaacctaagggatgaatttataataatcttgtgagaagtatattaagagaatcgctcaaaataatttcaagcatttgatagtaattattattaaatttgtagatttagaaatagcttaaggaaaggatgaatatacaatgaagaagatacctttttcaccaccagatataacagaagaagaaatacaggctgtatgtgaagttttaagaagcggatggataacatcaggaccacagcttgcaaagtttgaagaaggaatagaggaatactgtaacgtagagaaagcacttgcattaaatagtgccacagctgcaatggaattagtattaaaattttttgatataaaagaaggagatgaaataataacaactccttacacatatacagcaacatcaagtgttgccgttcatagaggaataaaacctatatatgtagatgtaaaaaaagatacatttgaaatggacatagataaagtggcagaaaagataacagaaaaaacaagagttataatgccagttgatatagcaggagttccttttgactatgatggacttaaaaaagtattgaaggatcttggaagagaagatattatgatactttgtgattcggcacattcatttggtgcaaaatacaaaggaaagccagttggttcacaatgtgatttccattcgttttcattccatgcagttaaaaatttaactacagcagaaggtggagcgcttacttttaaggataataattataaaggaaatgaagatcttttaaagtatttaagatttacagcaatgcatggtcagtcaaaagatgcattaagcaaaatgaaagctggagcatgggaatacgatataataaatgatggtcttaaatgcaatatgacagatataagtgccgccattggaaatgttcagcttaagagatataataagatgttagatagaagaagagatatttttaaagtttatagtgatatattaggaaaagaagatttttcaataataccatttactaaagatgacaatggaacagaaacttcatatcacttgtatctttatagagtaaaaggatttaatgaagaaaagagaaataaagcaattcagattttagcagaaaaaggaatagcaacaaatgtacattataagccacttccaatgcttacattgtataaaaatttaggttatgatattaaagattatccaaatgcatatgctatgtatgaaaatgaaataacacttccagtctacagcacattagctttagaagatgctgaatatatagcacgtgaagttgtaaatgtaataaaggaattaatattataaaacttgaaccgaacatttagaagactggtacaatttagtgccagtcttttgaaattaaaaataaattaacagcaagtttgttgaaaagtttctattgactttacatatatatttttgagtataaattttcaacatatgtttatagttttaatcaagtgagttttaagaatagtttatataaagttaaacaaatcggataaatacaaatataagtatgactttttgtatactttttgaaagtttttaatatttgtcgaacgaaaaaatgaaaaaaatatcaaaaaaagtagaaaaaacatgaataatatgataaacttaattcaagcaaaagataaaattattaaaaaacaaaagataagatttaataaagaacaaaagagaaaaaattattgaaaacatgagataaacttttatagattacaaaagaaaaaagaatgtagaaaaacaaaagatagaattttaatgagaaactaaggaaaaatatattagataacaaaagataaaatttattgtaaagcagcaagcactggatattttattcagcttgttgcttttttgttaagaagttaaatattatcttaattttgagggtgaattcagtttgatttttaactatttttaattttatatttgacacttacctaaggtaagatattaatatagaggtatatgaaaaactttaaaattttaatattactaattaaagtgtcatagagggggaagaaatttgaaaataggtgaatttgctaaaaaatcaggagtaacagtaaagactttgcttcattatgataaaatagatcttttaaaaccttcatcaaaaactgaaagtggttacagaatttattgtgaagaagattttctaaaactacagcagattacaacgcttaaatttataggattatcattgggagaaataaaaactattttaaatgagagtggtgaaaatttagagaatatgatcagtattcaaaaaaaggctttagaagaaaaaaagagacatattgaagaagtgataaatgtttttaataatgcacaaaactctgctaaagaaaagggatttcttgatgtgaaaaatttgatagatataattaaaataactggcatggaaaggtctgttaaagaacaatataaaaatgataaaaatcttaaaattagaactaaccttcatagttataatataaataaagttgattgggatcaatggtgctttggtaatatttcatttccccaaaatgcaaaagtattagagttaggatgtggaagtgggaagttttggtgcagaaatgctgatagtttaagaaaagatttgaatatttgtgtttcagatttttctaaaagcatgttaaagattgcaaaggaaaatctaaaagatataaaacacaaatttatttttaaagaaataaatgcggaaaacattccttttaatgatgatacttttgatgtggtttttgctcaacatatgatttattttgttccagacatagataaagcactaaatgaaataaaaagagtattacgtcctggggtatattttatgtgactgcaaattcaaaatattctatggaagagttaaataaacttgtggaaaattttgattcaaagagtggtcttaatagtaatggatattctacaagatttgaattagaaaatggtaaagaagtacttgaaaaatattttaaaaatatagatgtaaatattcttaatggtaaaattattattgataatcctgaaccagttgtttcatacaaagcatcaactattcaaggcagtaaaattcttattggagataagcggaaggaatttaaagaatacttaaaaaagtatattaagattaataagacgatttctattactactaaaacatgtatgtttaaatgtgaaaaataaaatacacaattattatatatttgccatatttaaaagtcacactatcatttattagatagagtggctttattttttatacaaattaatattgacactgaccttaggtatgagagtattcttttaaagaacctagaaataattaaaggagattaaaaaatggatatacaattagttgatttgaaagctcaatataaaatattagagaatgaattagattatataacaaaagaggtgttatgcagtacaaattatattatgggaaagtatgttgcaaactttgaagaagaatttgctaaatatataggagttaaacatgctatatctgtaggtaatggcacagatgcacttgtactggcgcttattgcttgtggtattggaaaaggggacgaagtaattactactccatttacttttttctcaacagcagaaagtatttcttctattggagctataccagtatttgtagatgtaagaaaggatacttataatattgacccaaataagattgaagaaaaaataacagaaaagacaaaagctataatgcctgtacacatatttggtcagccagcagaaatggatcaaataaaagaaatagcaagaaaacataatttaatggttattgaagatgcagcacaggctgcaggttccgtatataagaatgaaaaaataggatcaattggtgatgttgggtgtttttcattttttcctactaaaaaccttggatgtgctggagatgggggatgattacaaccaatagtgatagtattgctacaataattaaggcattaagaacccatggaagtggagaaaatggacagaaagcatataatcttttaaataatatagatgaaaatatagaaaagagtgaaatatatgatgatactgtttataatccacaaaaatattacaattaccttattggatttaatacaagactggatgcaattcaagcaggtatattgagtgtgaaattaccttatttagataaatggatagaaaaaagaaatcttaatgcgaaggtgtattataaaaatttaaaacatacagatttaattcttcctaaaataatagattctgtgatatcaggttttaatatgtttgttattcaatctgaaaatagagatgaacttgtagaaaaattaagagagaatggaataagtacaggtgtttattatccagttccaatgcacttacagaaagtatataaaaaccttggatataaaaaaggagatatgccaaatgctgaatatctttcacacagaacatttgcaattcctatttatcctgaaatatcagaagatgaacaaaactatataattaaagttattaagaaataatttgttatatgtaacttattatatttaatatcaataataagttaaacatataattaatattaaaatagctacctctggctaaaggtagctattttttaatatttataaataaaggtagtaatataagtaaatgaaaacctaacattttaattcttgacttattatagaaatttattcaaaaaattatgatttttattagaatttataaaaaatatgattaattataaaaggttagatttgattcacaaaatgaaaataaggtaatttaataaaaatttgtgaaatttacatttattattttgaatatttgtgattgctaagaacaaaaacgatttttttgaatagtatagctattatggataataaaaagaggtaaattatgatgatagggataattgttatagtagtatgtgtattatttataaatatagaaatttcaagaaaaaaatatgatgagacgaaaaaagaagacgaaaaaaagttactaagtaaaattgctaaagaaaataaaaatgaaactttaatgaataatatagtagattcttcaaaaagtgaatatacatacgagaagatgattaaagatttacttttattaaagaaaaaatacagagacaaaatagatttaaatatattaggaacaacttatgataatagaaatatatatgaagttgtttttggaaacattttatcagaaaaacacattcttgtacatggaggaattcatggacgtgaatatttaaattctttgttattaatgaaacagcttgaacattatctacaatcatacgaaatagctgaatataaaggagttccttatagggaattgtttaaaaatattgtatttcatatagtacctatggctaatccagatggagtaaccattagtcagattggaattgatggtataaaaaattcatatttaaaaaagcttataaataagtgttattatgaagatattgaagatgcatatactagtgatgattatgaaaattatctaaaaaaatggaaagcaaatgctaaaggtgtagatttaaatagaaattttaatgcttcatggaacttaattaatcaatcaccccatccatcttttgaaaattataaaggaaagtgttatgaatcggaattagaaacaaaagcactgataaaattgactaataggtatagatttatagctactataagttatcattcttcaggaaatataatatactgggattatactaatagtctgaagaaaaatgagtgtagcaatctagctgatattgttaaggaatgcactaaatatgaaaaagctatgagtgattctaattatagtgaagtggtttcaggtggatataaagattgggcttcttcgaaaagtaaaaatccaatacccagtattacaatagaaactggagaaggtgactgtcctttagatatatgtgaattcaaaaaaatatggaaatataatgtggatatatgggtggcatgtgcatatgaattaagtaaacataagaaaaaataatctatatttattgcttaattatgttattataggaaattttaataatacattttgtctagttttatggttataatataaatggacaggatatttcaatataaaatataatataactatttagacaacattaaagcagtatatgaaatctatatactgctttaattatttgaaaaaaaaaccacaataagaagtgaataagtaaacaaacataataattatatttgtggattagagtatatttataggaaataagattctatttaaaatttaaatttaaaatgttagaatgatttcaatgtctaacaaatggacatcaaaaattaaatattcagggggtacctatgataaaaagaattagtaaattagcaacattaattatggtagcaggaacaactatttcaataataccaacagtatctgcaaatgcagccgtggcattacaaactttagatggaacaatgagttctgttcaggcatttgataatggcagatatctatatgatggatataaagatgcaacagatgatacagaaatttatttttttgatggacataaagatatagcattaaagaatttagatggagcttataaaaagtatggtaaaaattatgttacttttttaaatgataatagtatagttgatttaacaactggagaagtcttagatgaaactactgattacaaaaaagaatttttagaaacaaagctaaaaagcaaagtggtaaaaaaagcagaaagatattcgaatacacaaaatctagaatatgttgggcaattagataataagacatttgataatgaatggtttgaatataaattaactaatgaaaatagtagtgaaacatatacgttatttgtagatgaatctgggaagtatattgattccacagaaaatttaaatattatacattatttaaaagatggaagaaaaatagaaataaaaacatatgaagatttaaatttaaatggatatgatgttgtttttggaaaagcaatattttcagataaagattatatatatagaactgtaaaacttgcaaataaagcagattcatctgatactgaaacatatattcaaaaaataagcaaagaatcaggtaatattaaagatggagcgtatcttccaaaagatgtgaaaagttatagtttgtctgattttgggagttttgatgtgaattcagaaaaattcaatggaatagacatattagcaaaaggcgaatctttatatactataaattttgtggattccaaaataacaatgaaaaaatatgattttgttaaagaaagagactttagtgatacagcagtaactaacgacaggttatataaattagttgaagatacagaatataaaggcattaataatgaaaagatagatgcatacgatatagataaagataataatttatggattttaaataaaggaaaaatatctagagtaaatggaaataagcttgatgaaatgtatactgtagaaagaaatatgaaacaaatttctgtttatgatgaaaatgatattgttgtctggaatggagaagagggtatatattctacagttggaggtacaactttaaagttaggatggactaaatacccagatggaacttggtcatatttaaaagaagatggaagtaaaactacaggctgggtaaatgatagtggtacatggtattatttagatgataaaggaataatgcagacaggatggcttaaagaaaaagacacatggtattatttaaatgaaaatggttctatgaaaactggatttttcaaagaaggcaaaaataattactatttagataatacaggtgcaatgaaaaataatggatggaatatgattgatagtacatggtactattttaatgaaaatggaagtgcaaaaactggatggtatcttgaaaataatttatggtactactttaatgaatcagggcaaatgttaacaaatacagtagtagatggatataagataggtaataaaggtttttgggttaaatagaagaataatcttttacaaggctgattggaattgtttttaatttcaatcagccttgtatattttttaaataagtattcttagtagttaattcctgctggttttacatttttcttatcatcttgtgaacatggagtaacaccaaatgtcatgtggcaatttggacaaactgtcacaaaggtcttcattgtaaattcattaccacatgagcaaagaattgaatggggaatatttaaactcatatctgcctttcctttttctcttactttatctacaatagctttcccatcttttttatgggttccacaaccacaactcatagttaatcctccttaataaatatagatgatagaagtatatattatattttaataaaaagcggtatcctatgttacaaaataaattatagttatataaaatttaaaaatataaagtatatgataagttttttagaatttaacagaaatttagatatttatacgtttaaatgaaaaaaattaaaaatttaagtaattgatataaaaatatattgtggtaaaatgatttaaattaataaatgagtttcgtataattccaataatatggtttggaagtctctactaggaacctataattcctaattacgaagaaaattttatgcaaagatgcatgttttttcttcgtagttaggaattttttttataattaaggaggaaattatggatatattaaatttacctaaaatagaacttcattgtcatttagatggcagtgtaagaccagaaacgatgattgatatagctcgaaaggaaaatataaaaataccttcttttgatatagaagatataaaaaaaagttataataccaatagagtgtgaatcattaaacgaatatttaaaagcatttacaatcccaaacttagttatgcagtcaaaggaaagtttaagaagaatagcatttgagctttatgaggatgcggcaaaagaaaatgttaagtatatggaaataagatttgcaccaatacttcatacaatggaaggtcttaaaattgatgaagtgatagaaagtgttttagatggaattaatgatgcagaaaaacaatacaatattaaaggaaatttaatactcggatgtatgagatttatgtctatagaaaaagcttatgaagttatagaggcaggaaaaaagttcattggaaaaggcgttgttgcaattgatttatgcgcagcagaagaagaaggcttttgtagaaaatttgtagagccaatgaaacttgctagaaaatatggttataggattacaattcatgcaggggaaacaggaatcggtaaaaatgtattagaagctgttgagcttttgggtgctgaaagaattggacatggagtatttataagaaattgtaaagaagcttatgatattgtaaaagaaaaaaatgttactttagaaatgtgccctacaagtaatgtacaaacaaaagcagttaaagattttaatgatcatccaatgtatgatttctttaaagatggaattaatgtaacagttaatacagataataggattgtatcaaatacagatatgactaatgaaatacatatagcatttagtgagttcaacattacatatgaagattatattgagatttataagaaaagtgttgaggcaagttttgcggatatcaaaataaaaaatgaattgtattcagtgatataaaatatttaacaaataatttaaaataaagttttagattgattttatataataaatttatctgaagctttatttttatgtaaaaagacttaaatagtcgtttactattggatataaacataagattattaaaaatattgtgataaatacaaataatattagatttatttagtaataataaaaataattgacaaaaaaattaaattaattataatagttagtatgctacgtatttagtttaatacatatataggttaaattccaaaagttgctattataataaaaaagaaaaatataactaaaaacttagtacatatatgtactaatattaattaactactttaaaaatatggaggagaatatggaagaagaaataagattaagtcttttattaaaaatggtcactaatctttttgaaagggaattaaataataaagttgcactaatggatttaacacatgctcaatgcggaatattagcttatttacacagacatagaaataaagaaatatatttaaatgatattgaaaaagaattttgtttaaaacgccctactgtctctggtcttacaaaaagacttgaagaaaaagaatttgtattaattgaacctaaatttaatgataaaaggtacaaaagaataagtttaacagataaaagcgaagaaattcttgaacttatggaagaaaatttattaaattcagaaaaaattttgtataaagatcttacggataatgataagaatgaactttataggattcttagtataatgtttaaaaatatgaaaaaagaatagatatttgatattatgagtatttgtaaatagctattaagttaattagcggtgagtttataaaaatgttaactaaataaagtatttagattggataaggaaaggagattagtatgattaaaacattaatgtcacaagtaaaacaatataaaaaagattcaatcctgtgtcctatatttgtaatattggaagttatcatggaagttattataccatttttaatggcctcaatcattgataaaggtgtagaagcaggaaatatgatgcatgttattaaaattggtacaattatgattataatggcaatgatgtcattaacatttggagcattagcaggaaaatatgcagcaagtgctagtacaggttttgcaaaaaatctaagaaaaactatgtttcaaaatattcaaagtttttcgttttccaatatagataaatattctacagcaggtcttgttacacgacttacaacggatattactaatgtccaaaatgcatatcagatggttgtacgtttatgtacaagggcgcctattatgcttatatgtgctatgtttatggcatttaaaattaattctagactttctatggtctttttaggtgcagctttatttttaggagtatctttatatttaataactaaaaatgtacatccattatttatgaaggtattcaaaaaatatgatgcgttaaatgcaagtgtacaggaaaatataaacgcagtgcgagttgttaaagcgtatgtaagagaagagtatgaaattaataaatttcatactgcatgtgagaatatatataaactttttgttaatgctgaaaaaatacttgttctaaatatgcctataatgcaatttgctgtatatacatgtatacttcttgtttcatggattggtgctaaaatgattgtgggtggatcattaactactggagaacttatgagtttattcacttatattatgaacattatgataagtcttatgatgatatcaatgatatttgttatggtaataatgtctaaagcatctgcagaacgtattgtagaagtaataaatgaaaaatcagatttaaataataaagaaaatccagtttatgaagttaaagatggttcaatagctttcgaaaatgtaaatttttcatataaaaaagatggtgaaaaagtacttagtaatataaatttaaatattgaaagtggacaaacaattggagttattggaggtacaggaagtgcaaaatcaagtcttgttcagcttattccaagattatatgatactgaaagtggtcaagtaaaagttggaggacttaatgttaaagaatatgatatagaaacattgagaaatgaagttgcaatggttcttcaaaagaatgtcttattttcaggtactattaaagataatcttaagtggggaaataaagaagctactgacgaagaaattagaaaggcatgtattcttgcacaggctgatgaatttattcaaactttccctgataaatatgacactttcattgaacagggaggttcaaatgtatctggaggtcaaaaacaaagactttgtattgcaagagcattattaaagaaaccgaagatacttattttggatgattctacaagtgctgttgataccaaaacagatacccttataagaagatcttttaaagatgaaatcccaaatactacaaagattataattgctcagagaatttcatcagttcaagattctgacaatattatagtattaaatgaaggtacaattgttgattttggaaatcatgatgaattggtagaaagatgtgaaatttatagagatgtttatgaatctcaaatgaaaggagctgataaagatgaagaaaaataatcttggaagaccaaaacaaaagacaaaagaaaaacctttagcaataatgaagcgattattttcttatatattaaaaagatataaaattcattgtatagcagttattcttttaataattatcagttcacttgcgaatatcattggaacaatgttcatgaaaaatcttatagatgattatattctgccttttataaaagaggggaatactgattttagaccattactgaaagcattgattatgatgggagcagtatattattttggagcattttgtacatgggtttacaatagaattatggtaaatgtaacacaaggaactttaaagaacataagaaatgatttatttaagcatatggaaaagcttcctataaaatattatgatactcatgctcatggagatattatgagtatttatacaaatgatactgatgccttaaggcagatgatatctcagggaataccacaatttattgcttcaggaatcacagtgtttggtgttcttgtttctatgattattttaaatgtaccattaacaattattactttaataatggttggaataatgttttttgttacaaaaaaaattgcacaaaagagtggagcctattttgtaaaacaacagaaatctcttggtaaggtaaatggatatattgaagaaatgatggaaggacaaaaagttgttaaggtattctgccatgaagaggaaagtataaaagagtttgataaaataaatgaagaactatgcgaatgtgcagataatgcaaataaatatgccaatatcttaatgcctgttatggctaatataggtaatataagttatgtacttactgctataagtggagcacttctagcaatttataatgttggaaactttactttaggtggactagcatctttcttacaatttaacaaaacctttaatcagcctatagcacagctatcccaacaattgaatggtatagtaatggctcttgctggagctgaaagaatatttgaacttatagatgaggttcctgaattagatgaaggttatgtggaacttgttaatgcaagtattaatgatgatggaataattaaagaagtaaaagaaagaactggtatatgggcatggaagcattatcataaagaagataatactacaacttaccaaaaagtagaaggtgatgttgtatttgatcatgtagactttggatataatgatgaaaaaataatacttcacgatatagaactttatgcaaagccaggacagaaaattgcttttgtaggggcaacaggggcaggtaagacaactattactaatttaataaatagattctatgatattcaagatggtaaaataagatatgatggaattaatgtaaacaagattaaaaaggatgatttaagaagatctcttggaatagttcttcaagatactcatttatttactggaagtgtaatggaaaatattcgttatggtaagttagatgcaaccgatgaagaagttattgctgcagcaaagcttgcaaatgcagattattttattaagcatcttccaaatggatatgatacaattcttactggagatggaaataatctttcacaagggcagagacagcttctttctatagctagggcagcaattgcagaccctccagttttgattcttgatgaagcaacttcaagtatagatacacgtactgagaaaattgttcaagaaggtatggataatttaatgcatggaagaacagtttttgttattgctcatagattgtcaaccattaaaaactcagatgttataatggttcttgataaaggacatataattgaacgtggcaatcatgaaagtcttattgataaaaaaggtatttattatcaactttacactggagctttagaacaagactaattttagtattaaattaagaaaaaataaagatattaatagagaggtcatacaagatgtatgacctctattaatatctaacgttcttttcctaaaaagaaaactccaacagttccttgtccggtatggcttccaatggctaatccgatgtagtttattttaagatttttaggtgtatatttttcttttaataattgacataaatattcagcacctttatggttatgggcatgagttacaaatatatcattaagttcttcatttcctagattttcatctattttattaattaactcttttattgcttttttttcaccacgaatttttccaacagtatctaaagtaccatcatttttaacttcaagaataggcgttatatttagtatacttccaaccattgcagctgcagaacttattcttccacctctttcaagatgctttaaatcttttactgtgaagtagcaatataatctcttctttagtttttctatagcatccactatttctgttattgtttttccttctaactttagttggacagctgtataaacaagaagtccatgaccacctgatgcggattttgtgtctattatttctatgttgcaatttggatatttatcaattagttcatcttttgcaattaaagcactattatatgttccacttaacatcgatgaaaatgctatatacaaaatatcatatccatcaattaaatatttttcaaattcatcaacaaatctgtttggattaacttgacttgtttttggaatagatccttttgaaagtttatcataaaaatctgagtagcttaggcttttaccacaatcttcaattatattttctccatctaaatcacatacaagacctaaatagcctaaatctagagtttttatcatctcatatgaaagatcacagcctgagtctgttattattttaaattttttcattaaatttacctccggtaaaacttaaagtaattatactaaattttattttgacttttttcataattattacacatatgtggtttatacctcatcttttgtagtataatctatgtattataaaatcacaatggacaaatgtaatcaattcgttacttagtacccattgtatacgtaatctgttacttaaaaggagattaaattatggagaaaacacatgcaaaagaagtcaaaatagataagagaagcctaaaaactaaaaaagcaataaaaaaagctctaaagaaacttatgtgtagtacagatatatctaaaataactataaaagaaattgcaattgaagctgatattaatagaaaaacattctatactcattatacagatgtttttagtgttctaaaagaaatagaagatgatcttacttcaaagctcatcaatatacttaatacatatgagatatctgaaaagaaatataatccttatccaatttttgcagaacttacagacgtaattaataaagatattgaattctataatttacttttgagctatagtagttttagtaatttgattaataaaattacttttgttttgaaggaatatatatataattattgtactgcaagagctaatattaataacacctcccttccttatgttgttaattttatttcagctggtgttatatcgtcttatcaagaatggcttaattcagagaagaaaataacattggaagaattatcagaaaccttaagtgtattaatagctggcggaattaattctattgtatagagttataacattttagctattattttcttactaataatagtttgacactgaatatttgatgtgatatgctatatcacatagtatggaaaactacttattacgaaagataaatattttcgaaatacaaaggagataaaatcatgataagaataatttcagattcatctacattatatacaattgaagaaggtaaaaaacatgatatagatatagcacctttagcagtaacaattaatggaaaatcatatttggaaaatgaagaaattacatctgacgagtttataactatgataaaagatggaaatattcctgtttcatcgcagccagctgtgggggacgtaataaatttatatgaaaaatatcctgaagatgagataattaacattactatggcagatggactctctggaacatataattcagcgtgtatggcgaaaaaactatgtgataatggtgaacgtatccaggttgtaaattcaaagactttatgtttacctcaaagatatattgttgatacggctgttagtctgtctaaaaatggcaaaactaaagaagaaataataaaaataatacaaaatttaatagaatcaacaaaatcatttcttattccaaaagattttgaatatttagtaagaggtggaagattatctcctttagcaggaaaaatagcaggggttataaaattagtacctgtagtgacacttagtgatgattctacatctctagttaaatttactactaaaagaacatttaaaaaggctgtggaaaaaatttgtgataacttattagaaaacgggtttaataatgctcataaaatatttatttctcatggtggggatgaagaaagtgcaaaattagtaaaagaaataatatgcgaaaatataaatgaagcagaaatcgagatatataaacttggtccagcatttataactcaaggtggaccaggctgtatagcaattcagactataaaaaaatactaataagaatatatatacttttctattacaaaatgttacaattaataaaaggaaatccttttaagacatcattagaagtaccagattacataatgatagaaagagggtggagctttatgagaaataaaatatttcgttttacaacagtgatagctttggttatgattggtaatctatatgctacattagcaactggtaattcagtaatatctgctcatgcagaaaatattactgaaaatattttaaatgtagagaataaagtatcaagtcaaagtgaaatggaagatatcgctgtaaatctttttactagttatatcaaagaaaatagtacagattggaaaaaagttcaatatgaaaaactagatagaacaccattaaaaacaatagaagactataaaattataaatgcatcattagtttctgtaaaagaagacaatttttgtgttaaaattatctatgatgtaaaatgtactgaggaaagtgatatgtggcttgcaggaaatggttttaaagatacagataattggattagaaataaaagcaattatgtaagcgttaaaaatgaagaaaataaatgttttattataggtatagatacttaaaaaattgcacctggttttcaggtgcaatttttaaaaataatatatctggaaactacaatttattgtaaacgttttttgaagagttatattgaggatgatataaataaggtggtataataaggtaaatagtaactatggggggaatttgagatgatcagctttaaggaaataaaaccattagaattaaccaataatccatttgaaatgataggcaaagattggatgcttattactgcaaaaaaggcttgtaaggtaaatactatgacagcttcatggggaggacttggtgttatatttaacaaaaatgtagccacaatttatgtgaaaaaacaatgttacacaaaagagtttttagatgatagtgatagattttctttaactatatttaatgatgagtatagaagagaactatcgtatttaggaatagtgtcaggtagtaatgaggataaaatatcaaaagtgaatttcaatatttctgaagaaaatggcacaccatattttaatgaagcagaaatagtattaatatgtaaaaaaatttattcgcaagatttaagtgaagattgttttgaatacgataccatacattgtaaaaactacagtgaaaataacattcatacaatgtatattggcgaaatagaaaagatcttaattaaagattaattaattttagataattataattaaataatataaaaataaaactttagaatattttatatatttatgaagttttatttttttatatctttaacgaaactatggttgtttatttgatgttttttttataaattatatgcattcacaaatctatatcactgaaatattgaaaaaagaataataaaattataaaaacttatatgaaaaattacttttattgacatacgatgttatttctaatattatttaagtagaggtaattctatttagaagaaaataatgtgttaatagaatatatggttattttatggagggagattgtatattatgagagaacttttattaaaaacagtattgttatttaaaaatgtatttagtagtaataaatttgataaaaaaataatgaaaacagataaaaaatcagatcctaatggattatgtatggcagagaaaatagaagctcaaatatgtggaattaaaatggccataaaaaatactgaagatggcatcaaaatgttaaaaaaagctgatgaaagtttgttgcaggtacaaaaaatacttcataaaatgaatgagcttgctgtacaaagtgcaagtggtacatatagcaaggaacagagagaagaagccaacgtaaattttcaagtatataaggaagaaataaatcatataggaattcaatcacttcacaatggaataccaatttttgatccatctaggaatcccaacatagataatattgattatactttaaaacttcaaataggtgcaggagctaaagaaaccataatgataaaaatagatcctatgaatatttcaataataggtcttgcagatgcatctctcataactcaagaaggtgcaagaattgcaatagatggagttcttaaagcaatagatataatttctaatagaagaataataattagtactacacaaagtaaattgaaagatattatagaacaccaaactataatgatagaaaatctttcaaatacaacgtctttaaatagggatatttcaatgacaaaaattaataacaaatacagctataatgtaatacctttaatgaaagataaaaaagctaactaagaagaattataatcaagaacatgctcttaaaattgaaataatttcactaaaaatggacctattgcacaagagggcactgaaaaacttaaagtttttttagtgcggttatatctagataaaaaagagttaatgaaacttaaaaaatttagtttcattaactcttttttctttagatattaatcaaattaaaggatatttctatcctaatagcttcaatattcttttaacatttactgaaaagatggctaatgctccttgcatttccatgttaattagacctgaggatgatgcagtatcatacccatgcctatgttttaactcactatttttagcctctatcttatatctctctttagatttttccttgaaaaattcactttcttgaaactctatttgagatttatgaacatcactttttatagtaactgagtaggttttgcttttagcaccttctttatagcatccgtctttttgcagacaatctctacatttttcaatatcaaaataataagtatctacttgatttgtagaaacattcctttttccttgacgggctttgcggatagccatatgaccttctttacatacatacattccagcatctttattaaattgaaactcatcttccttttttctaaagccttgcgttacagaaggattcaacttagctacaagtttaatattatttatatttgcaaattcaatgttacctttttcagagtacgcagcgtcaccaataattgtttcaatctctattccagcttcttgacttttattaattaatgtttctaattctttaccatcatttttttcaccagtagtaatagttgcagctgttattattctttcctcagtcattgcaatatgtgttttatatccaaagaaagatgaatctacagatttatgtccaatcctcgcatccgcatcggcgctagcctgaatgtgttgaatatcatcttctaatatttcatttaaaatatttaatttttctctaacttttggataagatgaaataccttcgttcttttctataatttctattaattccttgcaatatttaatttcgcattctaaatcatcaactgtatttttagatggaaaagtattcttaatgctctcatctatttcataaactgattttcttaatcttttagaacgttcttgtaatacttcacgtggtgatttttgattatatctagctgctgtatgcgtagcatcaacaatgatagattttgattttaggattcctttttcaagagcaatttcaactgttttatttattaacatatctaaaatatttatatctttaagcctaagtctacgaaatttagttaatgagcttggctcaataacagcttcttctggagccatgccaagaaaatatttaaatgacatatcatattttgaacgctcaacaatatccacatctgacaaatcaaatatggattttaataaaagatatttaaacatacgtatcgggtcaatggcatttctaccattattagagcaatacttatctaaaatctcatcatatataaatgaaaaatcaattaattcattaatctttcttaacagattatctcttggaacaaccaaatcataaattcctgaatattcacttaaaatcattgtttcttgcttttttatcatacgaatcacctacattattttataagttaagtataacataaaagacctaaaaaattgtttttaaataattttttaggtcttttattccgaaaggcactttttcagtgccctcattgcacaaggtctattttttattaacttaatttcatattaatcattataaaatataatatttaatatttttagttaaattatgtgacaaagtcactgaaaaatttaagtattggaaatataattaggacatgaaatgagaattatattaatgttaaataataaatataaatttaaggagggaattatatgtctaagaaaattattattgtaggtggagttgcaggaggtgcatcaactgcagcaagacttagaagattagatgaaaatgcagagataattatgtttgaaaaaggagaatatatatcttttgcaaactgtggtcttccatattatattggtgaaataattaaagagagagaaaagcttattgttcaaacagtagatgaaatgagcaacaaatttaatatagatattagaaaccttagtgaagtggtgaaaatagacaaagaaaacaataaaatcactgtaaaaaatcttaaaaataacgaaatttatgaagagagctatgacacacttgttttatcaccgggtgctagtccaataaaacctaatatacatggtatagaagattgtgaaaatttatatacactaagaaatattccagatacagataaaattaaagcatatgtggataataaaaaaccaaggaaagctatagtaattggtggtggatttatagggcttgaaatggctgaaaatcttagagaaagaggtcttgatattacacttattgaagctggaaatcaagttatggcacctcttgatatagaaatggcagctattgtacatgatgtactaatagacaatgatgtaaaattgattctaaatgatggtgtaaaagagttcaaggataaaggtaaaagagttgtattaagtagtggaaaagaaatagaaacagacttaataatattatctataggtgtgcgacctgaaacttttatagttaaggaagcaggcatagagcttaatgagcgtggaggaataatcgtagataagcatatgaaaacttcagtagataatatatatgcgctaggtgatgcagtagaaataatagactttgtgaataaaaaacctgctatgattccacttgcatggccagcaaatcgccaaggaagaatagtagcagataatatttgtggaaaaaattcttcatataaaggaagtttagggtcatctgtggcaaaaatatttgattatacagttgctacaactggaaataatgaaaaaacactaaaaaaattaggcattgattataaagcaattcatatacatccaggatctcatgcaggatactatcctggtgcctttccaatatcatttaagatgctttttaatcctaaagacggtagaatattaggtgcacagggtattggaattgatggagtagaaaaacgtattgatataatatcaacagcaattaaaggaaatttaaatgtatttgatttacaggatattgaaccttgttatgcacctccatacaattcagcaaaggatccggtgaatatgttaggatactatgcttcaaatataatggaagatcttgtggatataatacaatggaataaagttgatgaattagataaaaataattctataatagtagatgtaagagaagaatttgagttagtaacaggagtatttgaaaattcaataaatattcctttaggacaattaagagatagattagatgaaatacccaaaaataaaaatgtatatgtaacatgtcaggttgggcagagaggatatgttgcaagtagaattcttagatctaatggtataaatgcaataaatattgatggaggaataaaaacttatatatacgtaaagagatcacaggaaagtataaaaaatcaatttgacaataaaaatgaagaaacaataaaagaagaggtagcggctatgaatctagatgatttagatataactgaaattaatgcaaaagtaactttagatgcatgtggacttcaatgtcctggacctataagaagggtatttgaagaaatgacgaaaatgagtgaaggtgaggttttagaagtaaaagcaagcgatcctggattcagcaaagatataaaatcatggtgtgaaaaaacaaataatacccttttaaaatcagaatttgataagaaaaacaagaatcttattgctgtaattcaaaaaggaattaaaaggaaagaaaatacaacaccaatagaagcatcaaataaaaatggagctacccttgtagtatttagtggtgattttgataaagctattgcttcatttataatagctacaggagcagcatcaatgggaaaagaagtgacaatgttctttacgttctgggggcttaatatattaaagaaaaaaggaaaaggtaaagttaataaagacactatggaaaaaatgtttgatgtaatgcttccaagtcatgctggcaaattaccattatctcaaatgaatatgatgggaatgggaccagcaatgattaaacagatcatgaaaaaacacaatgttgatgatttagagacattaatagctaatgctataaacatgggagtaagagtagttgcttgtgcaatgagcatggagcttatgggaattaagaaagaagaattcatagatggagttgaaattggaggtgttgcttcttatttaggtgcagctgatgattcaggattaaatttatttatataataatatgtaaatattattaaaatataaaaaagctttgtaatacaaaatgcaaagcttttttatgtttttattaaggaatattttcaaaaaataaataatataataaacaacatatctaggaagtttatatataaatcaatttttatttaactttaaatataacagtaaataatgaaatttgtataaaatagtaacaaatgtagtataggatgaatagaatggtattatattttttaattcaaatccaatataggaattgagataacttaaatattcagaccgaatattaaatataaacttagaatagatatatacagagaagaacatagagtattatataaaaagcaagctatacatagagaacatagttaacaagtaatgatataaattacaattaacaaatgaaaatataaattcaataataaagcaatgtaaataggagaaatattatgaatattattgcagcttatgttatagctaaagaaaaaatgtgtagggaaattgccgaaaaaactgcacagctttatcttgaaggtatgagttatgaagaagcatttaaaatggcaaaagaaatggcaaattatgatgattttattgaaaatgaagaatatttagaataataattaagtaaatattgagatgtgaatcgtatatgtacttactgaaaatatgtaaaaaagattattaaaaagctagagtatgatactgttgacaaataaagtaaaaaagagtatatttaattcatactaaatttatcataattatataaataatatttttatcaagaaagacagagggactggccctatgaagtctagcaacctgaattattaattaatttaaggtgctaattccagcagatattttatatctgaaagataagaatgtaagtttaaaaatgtttaaggctgctttcttttaaaagaatgcagccttttaaaagtttaaatagtaaagtataaaaaaagataaggagaaaaaaatgacagatattaatatttataatagagatgaaaaaatcttaacatcaaaaattattaatgaaataggaaaggttatatctaaaagtaatactaaaaatataacatttattattcaagggggagttttatttaaatttgaacattagaattataaaagctctttattatgaagtaaaaagctttttattgataacaataatttcataatgaaaatgctgaaaaaacagcaaagtaagtagaattacttattttgctgtttctcctagtataaattaaaattatatatactaaataatagatgtacattatacaattaatctatattcttatcaatatatagaattaccaattacattttcagcaatattggttgagtggtcacctattctttcaaaatcagttataagatctaagaaaattgccccctcataagcgttacaacatccatcatataatctttgaatgtgtttttctctatattttttttgatatgaattaattgaattctcaatttctttaatacttttagctttttttaaatctctagttgcataggaagttatagctatatttaacgagttaattactgctgtatatatttcatttatttcctctagtgcatctgaactatattttaattttttgttttttcgttcaattgcaaggtcagctatattttctgcatgatctccgattcgttctatgtcaataactatgtgaaatgttgatgcaacaatgactttttctttatctgataatgtacattttgataattttacaagatagttagttatagattcttctaagatattgataagtttttcattttcataaacttgattgattaattgttgatcttcagttaaaaatgcatccatagataattggacattcttttttgccttatttgccattcttatagtttctttaattacctgacctgccgcgataaccggagtttctaaaaacctttcatcaataaatttagggcctaaattttcaattttatcttcacatggaataactttatttacaaatttaattatgagatttccaaaaggaagaagtactgcagcattagtgatattaaagatagtatgtgcattagctatctgtctacttatatcagtacttgttgtagcaacaaaatctcctaaataaccaataaaaggtataaatataattgttccaacaacattaaaaattaagtgaagaaatgcagctttatgagctgttttatttgttccaatacttgcaagcatggcagtaacgcatgtacctatattacatccaaaaagaattggaattgcaagattaattgtaatagcatttgttgatgccaatgctattaaaatacctgtggtagctgatgaactttggataatcgcagtaaaaaaaactccggttaaaattcctataacccagttgtctcctacagcaagaagaagttgagtgaattgtggagacgatgaaattggctccattgcacttgtcattgcacccattccggtaaacaggataccaaaaccaagaattatatttcctatttcaactctctttttggcttttgcaaacataaccacagctgcccctgtaaatacgaataggggagcaatttgatcaagtttaaatgcaactaattgagctgttatagtagtaccaatattagcacccataataactccaagagcttgtgataatgtcataagtcctgcgtttacaaaacctactaccataacagttgttgcactactactctgaattactgctgttataatagtcccaactgcaacacccataatacggttactagtaactttttctaaaatattcttaagtccttcacctgcagcattttcaagaccatctcccatgagcttcatcccatagatgaataaacctaatccgcccataagttcgattaaaattttaaatgtatccacgagtttatctcctttttatataaaaattgtatgtataactaaattttaacttaaatttatcataatgttaatatacaagcttaatatttaacttagatttaatataaaaatctttatataatatgtaatacaaactacagaacgtaagttctgaaaataaaaggaggaaaatatggcgtatattataaaaataaagttaaataaaattataaattaagtaaataattcaaaagaaaaataattattgattattatgaaaaaattgtatataattatgttattagttaataattattgttaattagtattttttataattgttagaataaatgatatatacaattattgctaattataaatattttattattttttataattcaaggagatgataaaatgggaatagaatttgaagcttctaattttagtaaagtagcggacaagctacatggatgttgtttgagtgaagatgtttgtggcagttgtgaagcaaataattgtcttattaagtacggaaaagattgtataaagtactgtatgataaataaagtaagtggggttttagatggttataaaaacattccacttatggatacaaaggtatatgatgaacttatggtaatagagggaattgcagatatacttaaaacgtgtaaaaattgtagtgagaaccattatgagaattgtattattaatattttaagaaattgttatgaaataatattaactggtcatgaacaagaatataaaggaagtactcttttgtatcttagtgaattaaaggaaaataatcctgaactttctgataaaatttttgcaagatttatggctaaataagaaaaattatttaaactaaaataactatgtaattaattatttattaaatgttattttgagtattataaatgtatatatattcattttgtatacaaaaacacgaaagtatactataaaaatatacatattaacggtataattaaacatattaaatattatagaacataaaaacaaagaagtaatttagtttaataatacttctttgtttttatattttatatagctgtaattttcttggaaatcttagttgttgattacagctatatcaattccgaaaaattgtgcaattgtaatgcatacttttgtactattcatatttagaatttaaaagttcatatgcacatatgctcaaatagagtgagaaaactttgttataatcattaaaatctatatttaaaatatgtttgattttttcaagtcttcctgaaagtgtatttctatgaataaaaagcgcatcggatgtttcgctacaattgaatttacatctataatatgtttttagaacctctacaaggtttgtttcctttgcctcatcatatttagtgagtagtgatatattatcatcacataattttttaagttcagctcttggaagtttttttagaacatgataatgaattaaatcattgtacaaaaggatatttttattttcagtaaaaagaaagcttaatcttgatgtctctatacaatcattaaatgcagttgtgattgtttttattccttcatggcatctgcttatacttactgtatacttgcaggttaatttgtcatttaattgttcacataatatttttagattatcaatagttttattcattatttcaatattatttttatcagtagaaaaaaatataaatattgtcattatatcattattagtgcatacaaatgagttgtggctagtgcataaagtttgtaatgcagatttatgtattattttaaatatctgctttggagtaaattcatcttcggtattgttaactgtaaaattaacacatattctcttttttgaataatcaaatccataataattgcagagttttattatttcaccgtcacttttagcttcatttgatataagatattcaaaaaataagttattataaagagaagtatgtgccttaaaatttttatctttttcaagttctagagatattatattaattagtttttttaaaacagatttattctcagatgaaagatcttgttgatttaataatatgcataaagatccagccatgctagaaagcgttagagcgtaaacgtcaaattctacattgtttatagaaaattttttataaacctccataataccatcattagaatttattgaaataggaaatgaaaagttagaaagctcaaattcatcgttatcagaaaagtttattatctgattatcttctggaattagtctaagtgaaataatttcattatttgaatttgttaatactattgatttgtgaataatttcacttatctcttttaacatatgatcaattccaagattattaaaataacagttggatattttatttatgattgtatattcattttcaatagaagttaaatttttattatacaattcattatatattattttacttatatccgaaaaagaatagtaaaaagggatttctattataggtagtccaatatcatttgcagcatttataatattttctgggatagtatcaaaaaatcttttgatttttattcctaatccactacatcctatattttttaattctcttaatatattgaactgaagatcttcgctatctttaaatatatatcctgtagttattacaagttcatctttttttatccatttaagtacgtcaggattatctaatatatttacactatctattttaacactcaaaatatcagtattagtaaggcatttcagattgtttagggaacttctatttataagccaatctaaagttaaggccatagttatcactccttatgtttacatctaaaattactctagacatatttatacttatatgaaagtatatcattgtaatatttgtcaggcaatatttttatattattatgcattttgtatattattttatattttaatatgcatattgcacttgatggctgtttttagataatatatactggagatagttcagaaattaaaaaaatccattcacagatgaattggaattgtaaatttattatgagaaattaaatatataaactgcaatggtgcaaaaacagagaaatctattttgcacttttttatttatattgttttatacataaaaagagtgtatatacatttcaattaattgatatgtgaggattttagtatatataactgaattcttaaataggaggtgaatttgtaataatgttaatgagtttaaaaaaaggtatctatagttacaatgaagaaattatagttagtaatataaaaaaacacctagataatttgaaagaatttacatccacaaaaggctatggagtcacaagactaccttttacaaaagaagcaaagcaagcagtatcctatcttgaaaatgaaatgaaaaagatagggcttaaaaccagagtagatgagtcaggagctataataggcagacttgaaggaaaaaaagaaaaaaccattattattggatctcattatgattctgtttcatatggaggaagctttgatggaattgcaggtatagtatgtggtatggaagttgcaaaacttataatagaaaataatatatatcctgaatactcattagaggttattggtacaaatgatgaagaaggtgcaagatttagttctggatttttttctagcaaagcaatgataggtgaattaaacattaatcttttaaagagccttaaggattgtaatgatatttcaatttatgatgctatgaaagattatggtcttaatcctgaaaatatacattatgcacaaagagatcttaataatataagaagttttctcgaaattcatatagaacaaggtccagttcttgaaaatcatagatgcagcattggtattgtagatacaattgtaggaatgaaaaggggaatagtaacaattaaaggtagggaagatcatgcaggtacaacccctatggatatgagaatcgatgctgttgaaattgcttcaaaagtaatatgtaagatttctgatatagcaagaaaatataaagatgcagttgccactgtggggtatattgaaactatgcctaatgcaataaatacaattgcaaaagaagttaaattcagtttagatataagatcaaccaacagcattgttaataaaaaatattaagtgaaatcatagaaaatcttaatgagataactgtaaagcacaatacaatttatacttttgatacaactttacaagttgaacctgtacatatgaataaatatataagaagcataattgaagagtgttgtaataagagaaaattttcttatgaacatatagtaagtggtgcaggacatgattctcttccaatagggagagttattgatactggaatgatttttgttccaagtaaaggtggacgtagccattgcaaagatgaatttacagattatgaatatcttatgcaagccgtaattatagccacggatgttatttgtaatacagattaaaaatttttagattattaaaattagtatatctatctatattacagaaataaatattatgaaatcaatttataaacttaaaattgccaattaaaatatattttagattagaggagagattgaaatgggatatccaaaggatttattatcgacaagggcagtggtgaagcctggattatatgcagtaataccaaaagatggacttgttaataatgttatacctaacatagtggattgcagagtcagtatagttgcttcacctaaaatgggagcaagctttgttcaatacattattgatgttaacataggaggaggaacatcatcaccttttgcaacagaagaaaatattgaaagctttatatattgtgtaaatggaaaaattgatataaaaattggagataatacagatattcttacagatggaggatatgcttttgcaccagctggatgtggactctcatttaaaaatataggagatgaaaatgcaaagattcttttatacaaacaagtgtatattccattggaaggaaaagaagcaaagatatgcattggaaatgtaaataatatagaatatagaatatacgatgatatggaaaatgtgtatataaaagatcttcttccaacagatcttggatacgatatgaacatgcatattttagcatttgagcctggaggatgtcatccaatagttgaaactcatgttcaggaacatggagcttatattttaagcggggaaggaatgtatcttcttgatgatacatggatgggaattaaaaaagaagattttatatggtttggaccttatgttgcacagtgtgcatatggagttggacgtgaattatttgcatatatatattcaaaagattgtaatagagatgtttctttattatgagtaaaatagtatatatacactatgtatatatttaagtgagaataaaaggaggatttattaatgaaattatcaatattagaaccgctaggagtggaaaaagaaaaatttttagatatggcagaaaaagttttaggggacagagttgaaataacttattatgacaatagagtggaagatagtgaaacattgattgagagaagcaaggatgcagaaatcgttgttttatcaaatttccaatatagaaaagatgtaatagaaaaatgtccaaatcttaagatgatatgtgtagcttttacaggagtagaccatgttgatatagattattgcaaagatagaggaattactgtatgtaactgtgcaggatattcaacagttgcagtagctgatcttgtgtttgggcttcttataaatatatatagaaatatagtagaatgtaatattgtcacaagaaaaggtggtactaaaaatgggcttgtaggttttgaacttgaaggaaagaaatttggagttataggtactggtgcaataggaatgagagttgcaaatattgcaaaagcctttggttgtgaggtttatgcatatagcagaactgttaaagaaggaaaagaaataaaatatgtagatttaaataccttattatctacatgtgatgttatatcccttcatgtaccattaaatgaaaatacaaaaggtctaataaatgaagaaaacataaaattaatgaaaaaaaatgcagttttaattaatacagcaagaggtcctgttgtagatagtaaagctctatcagatgcattaaaaaacaatataattgcgggggcaggtattgatgtatttgaaattgaacctccaattcctgtagatcatgttttatttaatgcacctaatcttattgtgactcctcatgttgcttttgcaactaaagaatctatggtaaaaagagcagaaatcgtattttataatattgataaatatattaatggaagttctcaaaatgttattgtgtagaaaaatagatattattataaaataatgaaaacctataataagggggctacatatatgtttaaaaaagcagattataagaatattaaaaggtatcttgaagatattgatacttttaattcaacgcctgattttggtaccacaagagtactttttacggaagaagaacttaaagcacgaaaatatgtaaaaaatgaaatgaataaaattggattagaagtttctgaagatgctatggggaacatctttgggatacttagaggtgaggatagttcactttcgccagtatggacaggttctcatattgatacggttttaaatgctggtatgtttgatggcatggctggagttgtaagtggtatggaggccttaagaattattaaggaatctaacttgaattttaaaagagatattaaagtaatagtatatacatcagaagaacccacaaggtttggcctttcatgtcttggaagcagggcaatggctggagaactgactttagaagatattgaaaatttaaaagataaagatggtaaatcactttcgcaagtattaagagatttaggatataatcttgaagagtttaataatgtaaaagtgaaaaaaggagacgtatttgcagcagtagaacttcatattgaacagggaggagtattggaacatttaaatcttccaattggtattgtacacacaatagaagcaccaactaattttgatgtttttgtaaaaggcaaacaaagccatgctggtggaactccaatgaatctaagaaaagatgcatttttagcatgctgtgatatttcgttagaacttgagagactagcaaaagaatccctttcagaagatacagttgctacagtcggggttgtagatattattccaaatgcagctaatgttataagtggagatgttcattttacaatggatataagggatagtgattatgatataaaatgtgatcttattaataaacttaaagaatttataaaagaagttgaaaaacaaagaatggtagagattactttaaatatgataaatgacgatattcctaccaagtctgatgaacagatagttgaacttcttgaaaatatttgtgagtctaaagagattccttataagaaaatggtaagtggagcatatcatgattcaatgatggttgggaaatttgcacctgtttcaatgatttttgtaccaagtaaagatggtgtaagtcatagtccagatgaatggactgactttgaagacatagctcttggcactgacatacttgcagaaacattatttacgcttgcaaatagttaaaagattattatataaatgtaaaataagttgcaaagaggcaaatattaaaattttaatatttgtctctttttgtattctaaaattaatgtttggaggatttaaaatgtttgatttattaattagaaatggaaaaatagtaactaaagatagtgtatttcatgggcatataggcataaaaaatgaaaaaatttgtgcaatttttcatggagaaatagatgaaaatgcagaagaggtaatagatgttggtggaaaatatatattcccaggcgcaatagactgtcatgcgcatttaaatgatcctggatatacatggagagaagattatgaacatggttcagaagctgctgcagttgggggaattacaactattatagatatgccccttcaaaataagcctgcattaacagatggaagaatatttaatgacaaagaaaaagctgttaaaaataaatcaatagtagactatgcttttttaggtgggctagttcatgcaaataaagaaaatataaaggaactacataaagagggagtagttggttttaaatcatttataggaccagtttctactgattatagatctttgaatattggtgaagcgagatatgtattaaatattatgaaagaattaaattgtgttacaggttttcattgtgaagattattcaataataaaatttgaagaagaaagagctttaactgaaggaagagtatcaagaaaggattatcttaatgcaagaccacttgaagctgagcttatagcaacaaaaaatattatagatttatgtagagaaacaaaatctaaagttcatatatgtcatgtaagtcatccggatgttgcagaagaaataaaaaaagcaaaagaagaggggcttaatatcactgcagaaacgtgcccacattatcttgtctttacagaagatgattttttagaaaaaggtactttatttaaatgtgcaccacctttaagaagcaaagatgcaaaggaaaaattatggaattatgtagttgatggaacattagattgcataggttcagatcattcaccagcagaaaaaggtgagaagtgcgaagaagaattaggtgtttttggagcatggggaggaataagcggtttgcagtcattggtaatggttatgataagtgaaggaataaataatagaagattaagtccaacaataattgcaaggatattaagttataatccagcgaaaatatttaatttagaaaagaaaaagggtgcaatagaatgtggctatgatgcagattttacaatagttgatttagataaagagtgggaaataactgcagattctttaaaatataagaataaaatatcagcttttacaggtttaaaaggaaaaggtgcaccaatatgcacaatagttagaggcaaaatagtttcagaaaatgaacatataacaattcatcatggatatggaaatttaataaagaaataaaattcaaatgataatttaatgatatttggatataaagtacaaattaaaaagaaataaggaggaaatattatggaaagtataactaatatagattattcaaacaataatgatatgagtgaagattgtttacaccctcaaaatgagagaataatgggaaaaatttcatatttattcgcatggcttggaggatgtgtttcaattggtacatttacaatggggtcaagcctaattggaacaataaatatttttcaggcagtaatagcaatgattttaggatgtactataactgcaataggtttaatgttaaatggaaaggcaggtcataaatatggaatttcctttacagtacaaacaagatcggcatttggggtaaaggggagtaaaattgcaggaataatacgtgcagttccagctgtggtatggtttggttttcaaagctgggttggttctcaagctctaaatgaagtatcaaaaagtcttattggctatgataatatcatagtgttctttattggatttcaaattatacaggtagcaatggcggttggcggatttaaagggataaaatggcttgaaaatataggatgtatcttcattattgtttcattaatatatatgttttacagtgtagtaaaaatgtatggagcacaactttcagatattcttataaatgtaaaaggaacatggggaatgcctttttttgcagctgtaacttcatttcttggaataaataccactatgatgctaaatgtatgtgattattctagagaattgaaaacagatgtaaaaactagtacaactggaataatatattggattgcagtaatcccagcaactttatttatgggattgattggtttgatggtatcaagtgcaacaggtatagcagatcctataaatgtattttcatcagctgttgataataagggacttgttattataactcttatctttatagcttttgcacaagttactacaaatattctaaacaatataatcccacctgcatatgtaattatggatgcgtttaaagtaagttataaaaaatcaattataattgttggaatattatcatttttcacatttccatggcttcttgtgaaaccagaatcagcagctggacttcaactttttgttcaaatttattcagcatttttaggacctatatttacagttcttatagttgattattttatattaaaaaagcagaatttagaaatagatgagctttataatgaaaatgggaaatttaaaggggtaaataaatatgcagtaatatcaattattgtaggagctgcatttgcatttttaaatgtacagatttcatggttcttaagcataattcctacaggaattacttattatatattaatgaagaaaagtagaagtaatacttaaataattttattctttaagtactagatattgataaatagacagatatgtacataatcatgtatgattatgtacatatctgtctttgtataattacaagtttaagttatttatgcttattaagtggatttaattttacaatatctcttatttgatcaacgtcaacatgagtatatatctgagttgtagcaacactttcatgtcctaatagtgtttggatactcctaatatccgcacctgctttataaagtagtgttgcgcatgtatgtcttaacttatgagcagagtagtgcttgtctaaacatgcgcttttaactgcttttacaacaatattttctacagatcttggatttattctttgcttttgttcgcttaaaaaaagagcatcttcatgaccttcctttatgggaatatatttttcagatctatatcttaaatatacctctaattgacttaggcatgattcatttaaatagatataacgttctttattacctttacccaaaaccacaagagtatcatcttttatacttgaaatatttatgctgcataattcagatagtcgtaatccggtatttataaacaaagtaatgatacatctatctctaataatatttcttcctgtaatattatttaaaagagaaacacactcattttctttaagataaaccggaagctttggctttgcttttggtctttctaaattttcacataggtctgtatctatcatgtgaagttttaaataaagaaatctaaaaaaggatttaagacatgcaatttttctacgtcttgtaacattggaattatttcgttcaaattctgtataagatagaaatgaataaatatcagaactatcgatagatcttataaattctttatttatatcataaatttctatttcctcaaaaggaatatctatattaacaaggtttctatctctttttaaaaaacgaaaaaacagaataagatcagtagtatatacatgaagcgtttttttgctagaacctttaattgatgacatataacttaaatagtttgtaactacccctggcaatcttacattaatcttgtactccataatattttaactcctcaatttttcttatagttatacatgtaaaaacatgatttgatagtgaaatatttatttgagattttgtaattattttaagaaaagatataaaaaataacatctaaaagcacaaaatactaaaaaaatatttcatctaaaaacctaacataaaaaacctcttaaacgctgatgtttacttatattataccgtatttcactatgattgtaaacacttcgtaaaactaaggttttacgaagtgttataaatattaggaattagagtattctagtttaatttctaatattttttgtgttttttatatggttccccctaacagtttctgttaatttatttaatttctaatttcacaaataaattagaaattataaagtcaggtcataaaatcctagctatctataagaaaataactaaatttaagaacctgactttttatttattttgaattttcaagtatcgattataagaaaaaaatgaatttgaaaaaatgtataaactatattttctataacttaattcacgtttaaattctataaatcaacaaataaatatctattaaatttttgtattatttacttttataggtaatttcattaactttaatgcttgttttattttttagtttcttaaataacttattaatttcttttttatctttctccgaagattttttcatgaatatatcacctcttctttttttataatactgtcaataaaataacaataatatttaaataattattaaaagtattgacataaaatatgatttatattcatataattttacataataataaaaatcttcttatactccgcttcccctctgctatttaattagataataaatcatttccgaaggagatgtaatgtatatgtatgaaattatacacacaaacttaataagcaaaattacatactcaatttataattttatagagtattttgcaagagatgataaaacaaaaatcatttcagtttcaattccttctgatatattatatagaagtcaattaatttgtgaatatatcaaaggagaaatagatgaagattttgatctggataatcttttgatgatactctatatgaatttcataaaagaatgtgtaaaaaattacaatcccaaatcagtatatgccctattgaataaaacatattatgatacaaaaaatattataatttctgatggtaaaaatgatatttcaatagatagagctccagtgaaattatctgttctagaattaagtatttctactatggattttaaaaaaggccaattaatattagatgaaatttatgaattatatcatagccgatattctttttcaaaacttttagagtcgttatggatggattttatttattcctataagacaggacaaaacaaaagagcttatcattctattataaaaatgcttgaagaatgtttaagttaaactttttatatttaatttataaaaaacatccgaatattttattaccggatgtttttcaatgtcttatataatgttcagactgaaactattattatatttaaagatttattcatgtagctctaatggcaatccatcaggatcaaagaaaaatgtcatttttttattggtatattgatcaaatcttatactctctgttataataccttttctatttaactccttaacagtatgttctacagaatctactttaaatgctaagtgtcttaatccacatgcctcaggttttgttactcttttaggactattttcaattccaaagatttcaagttcgcattcgcctaattttaaatctaatttataatcatttctttcaggtctataattttctctaataatcttaaaaccaagtaaattcacataaaaatctttagatttttcataatcagaaacaatgattgccacatgatgtatcatatttaaattcataaaactcccccatttcttttaaaaattttatttacaatgtatacattgtaattcttttccgctttcatctttcgttccgttaaatataaccttacttctagatagagttctgcactgttttgatgtgtgataggcttttccaccagcagtccaataaactactgcactagtattttccttgctacacacatctttatatgatagcttgtctttatcaatataattatttaagctttctaatttcggattactttctttagacaattcactttcttttaaatttgttttaacatcataattggatttttttatttccatataaatttcttcctttgaagttttaaccactttattttttagatattcatctcttttatcaaatttaaaaatgccaagaggaatagttataatttcaaaagtaaaatgccttttttcattaaaatacaattttaaagcaaagtataacattatacatagtaatgttataaaaagcaaaaaaataagtattgagttatcattcattttaattttctcctttgtataatagcatattattaccttagcccctgatatttaattataacaaaattttagtatattaggatataaatttattatctagtcttaatattttttataaataatcgcagaataattttaatgaaaatatagatacttcatattatttttccatgaatataatataggcttctacagatattaatagtatatattataaaaaggaaggtaagataatatgaataatcataataattatggtaatatggccaaagtaggaaatttcactaaaaatgcaattgaaaactttgaagaaaacatagttaatcaaacagactatttagaaaaggtaaaaaatcaaagtaagaaaaattaatgtataaaaaagaagttctaaactattttttagaacttcttttttattatttatattataacttaaatttattgactatttctgaaagattagaggatttactcttattttctttagaatttttaacaatattatctttcttattattgatgctattcatattatctgctatagtaacggatgaatcagttactactgaaattgcttctgcaagttcatttatactaacagatatttcattcatagcttttgatacatcattagatgtactagaaaaatcataagccatttctttaacattatctccagtatttttatatgataaagttacattgattaatttttcataatctgtaagtatatctttttctactacagttaacaattctcttgatgacgatgataaatcttttacagctttaatggcactgtctatatttttttgaatagtattaactgttgaagcactttcttctgataactttctaacttcttctgctactattgcaaatccttttccatgctcaccagcacgagctgcttctattgatgcattcaatgatagaagatttgtttcttctgatatttcaagaatactattagacattgtagaaatgctttcaactatggaaattctatctaaagctctttcaagtttatctttacacttttcatatgtttcttctatactatgctttgaattaatagtttcagaatgaattaaactagcttcattttcaattgttttagctaatatcaaactatctttagcttttttatctgaatctttagatctttcattaattttatcagtaattctatttacttcttgtaatgaagcattacattgctgcattgtagctgatatctcttctgttgtagcagctgcatgttcaagatctaatgaaatttcatctatcatagaatctatatctgcactgctttcagatatttcttcactgttaactcttacttgattaattgttgaatttaatacatctaccccaaagtttaaccttttaactacttgtccaaaatcatcatttgtagtagcattatttctgtatgctaaattatataaagaaagttcttctgcatactcttctatatctttgatttttcttgataaaaattttcttataaaaattgaaatcacaataccaataactgcaaatattatagctaggataacttgctgaacagctagtctatttacgccactaaacacttcgtcattagaagcaactatacagagagaccatggggtattttttacttctgtataggaaacaaaaatatctgaatcttttaattttaattcttcaacattagtttctttagaggtaatctttttaaatacattttctaatatttgatcacttttttcatcattactcgaattaaaattctgtttaaaattaactttttcaaatactaaattcatatcattatgagcaatgaaattaccgttttcatttaacaagaatgcatatccatcatgtccaaatttaatagactgcactatattatttatatctgttaaatcaatagatccacataaatatccaactatttctccagaatcattttttataggtgtgaccattgttgttatagattgtttttcatcctcttttataaatggctctgttataaagcttccttcttttttcattgttaaaaagaaatcctcatttgactggtcttttatttctgaagtatcagggtaataaccataaccagaagcatccataacaaaaagattatcaaatttccattttttagcttcttgtaaaagaactggttgttgtacattccagtccatagattttatttctggtaacgatgccacattgttcaattgttcattacgatagtaaaattctctttcaatagatgaagaactatcgttggttcttgctttaagagtttcataagctgtagataaaatattatcttttgtcttgtgatacgataaatacgatgaaataaagcatattccaattactaaagtaattataaaaagcattattctatttccggtattttttaagaatttgttcataaattacctccttttctgtcaacatttaaattatatcataaaattatgtaaaaagtaatcgttaaaagttaaaaaattatagttaaaaaattatataaaaccgaacaatacagtaatacatactttttaaagtgattgtatattttatttactgcttattgatagtaatttttgttttaactgttcttctatattatgaagttcagcctgggcttcttgacgcttttgacgtccctctgtttgaattcttaaaacttcatctagagttgatattaatgattcatttgtattttttaatgtctcaatatcaacaatacctcgttcagctgcttttgcagtttcaatagtagacatttttaatgtttctgcattttttcttaaaagttcatttgtcatatttgtaacttcattttgtacttttatagcattagtagaatgagctaatcccaaagcaagtacaatctgactcttccataaaggaattgtattcactatagttgattgtatcttttcagacattaatgtatcattattttgaacaagccttatttgtggtgccatttgaagtgaaattgtttttgtaagttcaagatcataaattttcttttcaaatctatcgcataatgctgtaaaatcacttacctcttgagcatcttctgggcgaccactcaatcttgctttttctactaatttaggaagttcctcttctcttgccttttgtagttttttcttaccagcaagtatatacatataaagctctttaaaataaactttatttgtttcatacattttatcaagcatcgatatatctttaagaagctgtatttggtgattttcaagggaagtgcatatattatctatattttcttcaacttttgtatattttgttctcattgcatcaattttttgtacaggctttttgaaaattcctaaaataccctttttttcttcagtcttttcgaaagttttcaattcaccaacaacactagagagcatatctcctatacttcctaaatctttagttctaacattattaagtgctgcctgtgagaaatcagctatctttttttgagctccaactccatattgtagtattgagttggaatttgttaattctattttgtcaacaaagtcatctaccattttcttttcttctggagttaaaagattatcttcagtttcttttggctgattttgtgcagtagtatctaccttattattttcatcttcaaaagatggttcaaaaattagacttggctctggctgtttgttaaaaaaaccatcatcaaaattgttattcgtattattatcgttcatattctaatcctcccttttaagtctgctctatctatacccattagttgaatatattatctcaattaatttattttacttatttttctttttaaaatcatcttctgttaatccttcttgtgtgaaaagagtttcaagcactgaaatatctgatgaaacatctaaaacaacatcttcaaagagattatctaaaagctttctaaatgctgtgtttattaaatctatactattttctatctcattttttgcttttcttatgttttcaccttctatagtttgagtatttaattctctatatgaataaataagctttaatgatataggaagataatgattaaagaatttttttactaaaggaagattatcaggattctttcgtacattatcaataatatttctagttatattagccatttcattaagctttgtgcatatattatttccatgtaatgaataatttacactttctatctctgaaatatacttttcaccattttcaattaccaaacttaattcacttttatcttgctcaacagtgttgtctgcttcttcctttgaacgttcactatatgctttcattgaatttaagtattcttcatatacttcatcaccaagaataaaatatgatttatcctcactaatatgtccttctttaaacatattaagactcatcatcttttcaatatcttttaagacaaatttatttttctttgaaactgactctgataatttgcttatttcactataatttttaccttttaatatatcagagtatttattaaacctctctagtctttttcttattttccatcccctaaatgcaagtatgacacttccaacaaaaaatacaaataaagtaccaagtgtcatgtttactcctaatcgtataatcttactattgaacattgtaagaattgaacatgcaccaaaacttatggcaaatgcaacacttcctgttatgccaaggacataataaatcatacctttgtacttgcctgatggttttttagaaatatacttataaatttccttctgttcttttttatttaatttatttactccatgttcaaatttttcagacatcttttgaaatttcgtttcaatactatctgaaccttcatggaattttgatttaatgtcatgaatagtatcttcagcagtatcgctaatgttatccattatattttcacgtatgtctgtagcttttctattagcataatttatgtatttaaatgcactgtttattgcattctctatttgattttctatatcaaaaaaatcgttattattcatgccaaaactcctccattttgtttatcatataaataaattatatatcaatattataatgattacaatttattagagttaatataattttaatcatctaatcttattatagtatttaagagtatgaattgatattacacatataaaacttataacatatgtaaataaaaaatcatgagtcctttaaataaaattatatatttaaaggactcataaaaaatttgtaaaaattatttctatactgctatttttttattttcaattgaaatattgtatccataagagtatctgtatctatatattgctattactgataatatgactgataatatttcagaaaatgcagcaatcaaccatataccatctacttctaaaaatggcggtagaatagccatacctaaaatgaaaaatataaatgttctaaataaggaaagcaatcccgaaaccttcccatttgaaaatgctgtaaacataccacttgtaaatatattaaatccgcacaataaaaagcttattgaaaataaattaaatccattaacagttatataataaacatctgtaccttttccacaaaataatgtagtaagaggaacttttagaatttttgatacaataaacgttatgagtgaaaatattgtgattattatataactgtatttaactagctttttaatttcatctttatttttagccccataattatatcctattcttggtgcaactccagatgtaaaaccaatataagctgcggataataaaaattgtatatataaaattactgtaattgcagcaactcctgtttcacctagatattttagcatagcaatattatataaaaaagttgttacagccgtagacagttgagttatcatttcagaagatccatttatacaggattctttaaggacatttaattttattttaagctttgtaaaatgtattaaactatttcttcttgcaaaaaatatcattcctataatggacggaagtacatatcctattactgttgcaattgccgcacctgatacccccatattaaatactactataaaaacataatcaagaataatatttgttacaccaccaagaactgaaacaaataaaccaaaactagattttccaacagttacataaaagtaatcaaatattagcttaagcattataaatggtgtaaaaattaaatttatagataaataattcctgcaatactctaataaactatctgtagctcctaaaatttttataatatcatctataaatattattgatatcagcgcgattaatatgcctataactaatgctgatattataataagtgtaaaattttcttttgcttctttctcatttttttcacctataagtttagaaacaatcgcatttccacctgtagcaagcattacgcttattcctataagcatacttattactggataaacaatgtttattgctgaaagtgcattgggacctacaaatctagatacaaacataccatctactattgaatacatcgcaaagaaaaccatcattataacaataggcaaagtaattttaatgagtgatagtaaacttaaatttctatttaatgaattttccataaacacctcttttgattgattttttctttagtcttttatataataaggtatcctgtaacaggatagtcaagatgatttttaaaggatgatttttatggataaacatattaaatactatactactggtgagtttgcacaattgtgtggtgtaaacaaaaaaactttatttcactatgataatataaatcttcttaaacccgagaaaattactgagaatggatatagatactactcttctaatcagcttgagctgttttctgtaattaatatattaaaggatttagaaatgcctctaaaagaaattaaggaatttttagatacaaggactcctgaaaaaactgtagctctatttaacaaagaaaaatcaattattgaggataaaatctctcacttaaagagagtgcaaaaacttttggatgtaaaattagaaataatcgaagaagctcagacatgttctcatgaaattttcatagaacataatgatgaagaaattattattttaagtgatatagttaaaaacacaggtgaatcctatgatgtaaatacatttgcagaacatattaaatattgtaaaaaaaataatttatcttacggatatactataggttcaataataaagaaggaacgtcttataaatgaagattttaatattatgaataattttatactgtacgattactatttttcaaaggttccaaatttaaaaatgttcaataaatatcctaaaaaacctgaaggtgattatgcagtgatttatcattttggatactatgatactgtctataaaagctataagaaattatttgaatttttaaacaaagaaaacttaaagattgatggagatgcgtatgaagaagtactaatagatgatgttgttacgaggaatgtagatgattatgtgattaagatttctataaaaataaaaaatgaataagcagagataaatgggaattttaaaattgtaaaatccccacttttttctttttacaaatattaaatatttatgatataaatcatatattttgttttaagcaacatttcaagtcatcttcaggtgtacttataagttttatatcaaaagtatctacaagatattgaagaacattaggacttaaaaatgctggaagagttggtcccaaataaattcctttgataccaagtgataataatgcaagtaaatctgcaacagctttttgttcataccatgataaaatgatagaaagaggtaatccattaacatctgtatcaaatgcatcagataaagctgtagcaattctcactgctgaatatgcatcattacactgccctacatctaataatcttggaagtccagctacttctccaaagtttaatttattaaatctatactttccgcaggctaacgttaatattatacagtctcttggaacaagctttgcaaattcagtataatagtttcttccaggccttgctccatcacagccaccaattaagaagaaatgtctaatctttccttccttaactgcatttataatagtttcagcatgacttaaagtttcatgatgtgcaaatccaactaatatttcatgaacttcttcatcttccttatagccacctagttctaatgccttatttataattacactaaaatctttctttccatctttattcttaccaatatgctttactccatcccatccaacaacacttgtggtaaatattctatctttatatgattctcttggcttcataagacaatttgtagtcattaaaatgcatccaggtatattatcaaattctttttgttgattttgccatgcaccaccaaaattccctactaaatgcttatattttttaagccctggatatccatggcaaggtatcatttcgccgtgagtatatatattaataccttttccttcggtttgttcaagaatcatttctaaatctttaaggtcatgtcctgaaactattataaagggtcctttttttatattggtattaactttttgtggtgaaggattatcataaattttagtgtttgcttcgtcaagttttttcattattgcgacactcatttcaccagttctcatggtccagcgtataaggtcttctacacttagggtatcattacaaactgcttcaagtgctcttacataaaaagcatcaacttcatcatcataatatccaagttctcttgcttgatgcccatatgcactgattcctttaagaccataaacaatagtctgtcttaatgaacgtatgtctgggtctaatttttcatcatacataattcctgcaaatttagcatctttaagcatttctgatttagtgctgcttagtttatatgtagcatgaagtgtatcatttttaatttttccaactttctttttaagttcatttttaattttatcggattcctttagcagttctatatgattgtcagcatcaaaattaacattagtcaatgttgtaaataaacagttttctataaaacttacaatgtttttatcaagctcctctcccttttctataatttcttttgcataacaacttattccttttagttgaaaaatcaacagatcttgaagattagatacttccggagtttttccacatactccaagtttagtacatccttttccaccagctgtttgctcacattggtagcaaaacataggatattccagttccatattgtttcccatatttacacttctcctatcaattagtaaattttctctcaatcttttgaatactaatttaggtttccctcataaaagcctattattcattttcttgcttaggtaattctcatatcttattaatttttaatataatttataaaaaatattattcattttacattaattatattaaataacaaaacgagaacttataaacacaataagttctcgtttttttataatttattttcttcttgattttttaatatattttttatacatatatcattcataaaaattatataattatcaagattatcttcaaaattatttatttgtagccattttccataacacttaaaaattttaattatttcctcttccaatattctctcctcctataaacattatacaatatctataggtttaaatcaaacatatgttcgtagtgctgagattacttaactatatgtcaaaatcatatttttttagtaaaataatagcgtttccctgttataggatagttttctaaagtaaacacttctttatatccatgctttttataaaattcaggtgcctgaaaactaaaagtatctaaaaaagaatatatacatccacgactttttgctgttttttctgccttttttaaaagatcacttccaattctgcgtcccctcaactcttcactaacccacaaaaattttacatataaccaattaccatgtgtgtctccaattagccccgcaacttttttgccagtttcatcttgtaaataaactcctaaatcctttggatttttatcttcaatttttgatagattatattctaataaaccctgaaagataatattttcatcttcctttgtaattttatcggtaatttcatatttcatttattatctccttgcattaaagaatgtacttttatgattattttataccttcattctttctattgtttcacatagggaaagacattctgcatatctatttttccaaataaattcattataatattcataactttgcttagctgacatgaatttattgtcaactgtagtatttgaatgttcaggaacaataatattaaatccatgttcaaatccacattttattgtggcatctatgcaatagtcagtttgaagtcctacaactacaacatcttgttcatctttattttttaaatattctaataaaccagtatctttaaaagcgctatttactcttttatcaaatatcttttcatcatttcttggttgaaattcctcatatatttcaaatccatcaactcccttggtaagttcgctgcctatcccatcatcatgacgtacaaagataacttcaatgtgattttccctagctttttgtattatttcttttacattaaatacaaacttgtttaactcatataatttttcattggttatcaatttttgtgtatcaattactaataaaaccattgttatcacatccctcattaacacttttaatatacacttgtcctaatttgataaactcttctctaattcaatactagcaaatgtttcttctgaataagatacattgtatggtgtacatgttatgtgattaaatccacatttatgccaaaatcgtattccattccaattcttaagagatactaaaattcttactttattaaatattttttctttttttaaataacaacataacatatcaattattttatgtccgtatcctttatgcttttctacatcaacaatagaaaaatgacttatatatacaatatcatttttaggatattctttaatgagggtaatccatccaattagggtttcttctttatagcaagacaacatcataaaatcatttttacttttatttattgggtaccatccttctgcaaaacaaatatctggacttggccctatttcaccttcaattttcataaaatattttgattcttcttggaaaatctgattaagtttttcaagttcttcttcttttgaaataaaaattttcaaattaccatttactattttcattaacatgcctctataagtattaataatattacttactaaagtctaatatagataaaattttttattataaaatgaaaaaatatcgcaattatcttaatttttgaataatgcgatatctctaattaatattaagatttactttttatgtatattttcaatgctttaataagcaaaagcattgtataaaaaccagtaatactcaatataactgttatgatcatctttattcctaaaatcaaaaagcctaaattcattatatccatattttccccttaatatagtattatactgagtatattaacatattttacaaaataatactatatgatattgattttatttataaattgaagttttgttttttacagtatataattaatactaacataaaaatagagatatacatttattaatatactaaggaggtttatatggataaagagatgcccaaatgtccagtagaaataactttgcaacttataggaaccaaatggaaggtgcttattataagagatctacttacaggtactaaaagatttagtcaattaatgcgttctgttactggtattacacaaaaagtgttgacaagcaacctaagatcaatggaagaagcgggcttaatcatacgtactgtatatcctcaagttccacctaaagttgaatattcccttacagaaacaggttttactttaaaaccaatattagatgctatgttttcatggggcgatgcatataaagaaaatgctaagtaatttttgatatataaaaaatattaaaatatatattaaaatagccttgaaattaaaattatttcaaggctttaaaaattactttaagcacatatatgattatattcaaattaagtactaattgttatctgtaagttttacttaaacttgtttaactgctactaagtttttcttattgtcctaaaaaattagaagctaaattttttaggaggatttccagaaaaatctgctattgttgcctgtgcattatctaaataaaaaacttcaaagattggattgtcaggtgaattatattgaccttttactattggatttaacatacaagcttcttttacattcatattattttcaaatactgcttttccattgagtcttatccatgcataatttttatctgaaactgatatctctatctcaggattatttaacatatcttcatatacatcttttttgttatttgtacaaaaccataattttttttctgcttcaaaacagaacataaatggacggcattttgcttttccatctcttcctactgtggctaaataatttatatctttaaaaaacaatctatagtatttaaaattaatttgggcaatacattaaatgaataaggcatgtacactctttcagtccatttatgtgcatccttaccaaaacatccataattaattgctggtatatttagctttttaatcttatctaatggcacattatataatttctcatacattggaaaattatttaacaaaagtttaatagattcatcatcatcatcaattttcaagtagctgctgtcagtaaggcttggaaaaaactgatgcatttcatatttttcattggattctttttgaaaatcatttattatttttgaaagtttattaaataccatcttttcatcttcaacttctttttttaaagtattgtgaggacagtatggtgctgcaaaaaagaaaactattgtaggtatatttatttgtgcaatattacaaagcttttttactatattcataggtatttctcttttatcaatgtttgtagcaagcatttcttctgtatttcctgctataagttttttcaaattaccagtatattttctttctgcaagattaacaagttcatcatatgataaaacttgatttttataacttattttagaatatggtatattagtcaatctgcagtattcctgatacctttcatttaaaagtttttctgtattattaagtgcatcagtacttgcttgacgtaatttttctgttatatccttaatataagcattatggataaagtaattaaaataaacaaagctattaaatgaagtttgtacattatattcagtttttaaatccttcactttaagaactgatggaggaatggtatattccccattgtattcttcgcaaaaatgaggattcaaatcaatatttcttactaattctgctgctgttaatgatgcatcaaatccctcaaaacattgtcctacatgagtttcttttccttgaatataaaaacagggcagtatttttccaactgctcctacatatacatgtcttgttgtatcatttggataaagtgggcatatataatcattatttattgcaagtttatatttaaaattatatttttttattaaatcatctaagatttctcgtgcttctataattcctgtatgaagattttcctcaactggattaaacatagctattatatttccactaaattcacgagcatgttcagataagtatttcataagcaccataaatactgcatcaccacttttcatatcacaagcacctctgccaaaaagataatctcctgacataagatctttttttacatcatctggcaatttaattttttttaaattttccattaatttatctgtatcaaaagcatattcacttaaatttccgtaatcttctatacctactgtatcagtatgtccatgtaaaattatagccgtttcactagaacttttctcacctctaagtaaaactaatacattttgtctttcaaatggatcatttttaagtttttgaattattatattatctggatgatctttaaaatatgaaatgttcctaaaataattttctataaagaccccgatttctttttcaccatgtgaaccattaacactatctatgctgaccatttttttagtcagttctaaaatatctttaaacatgccaatcgctccttctaattttaaactttgtatcctgtatacagtttattaatatatactatactttatcaatgaatttaatgttaatattttgaatcttcatactcttatataattatgtatacaaaataaaaatgattattttattttggaattaaaacctataaactagaaacattatgaatttagtttgttcatatactagtaaatatagtgatattaataatatatgtaataaattaatttaagtatttttcaaaacattttataatttccatataaagtatatccataggaggaaatttatttatgaagatagttattagtgattatgaagataccttaaatagaaatttagattatgaaataaatttaataaaagctgcttttcctatctgcgatgttgttattcatgtatttaaagataataattcgctaataaaggaagtaaatgatgcagatggacttatcactgcctttttaaaagttgatgaacaaatattcaaaaattgtccaaagctaaaatgtatcagtattaatgctacaggatacgataatatcaatattgaagatgctaaaaaatacaatgttactatatgtgctataaaggaatattgcactatagaagttgctgaattcacaatgactttaattctaagtttggcaaaaaaaattaaataccatcagcactttattgaagatgaaaaaagatggcagtacagtcttgtagaatcagtttataagcttgcgggaaagacacttgccatatatgggttaggaagaataggacaatctgttgcagcacgtgcaaaagcctttgatataaatgtagtagctgtagatccatatattcctactgaaattgcatataatttaaacattcctcttgtaaatgatgattatgtttttaaaaatgctcatattatatcaaatcacatgaatgtatcaactagcaatatagcctattttgatgatagatattttaattcactacaaaaacgtcctatatttattaatgtaggacgtggtgcatgtgtcgttgaagatgcgttagttaaagctttagataatgaccgtatttcttctgccggattagatgttcttatagatgaaaatcctgatattaataacaatccactttttaatcgtaataatgtcataataactccccatgctgctttttattcaactcaatcttcattgttattacaagaaatatcatgtaataatttaattgaatttttcaataataacctagacaaaattaattatgttgttaataagaattaaaaaataagaaccatatcattccatacagctccaccatgttctgacgctgaaacaccttgatgcttaaaaccaaatttttcataataatgtataaggtgaatcttgcatgtaagaaccatccccttttttcctctttcttttgaaagttcaatgaaatagttcatgagttgtgctgcaactccattacgtctatagtctggaagcacatcaagaccaaagatagtctgataatctccatgctttttatgaagttgcacattatgataaagttcatctggtagttctggtaaatctgtagtacatccatttataaatcctattatttttccgttatcttctgctataataaaattttctttaaatgcatcaaatcttttttgaaaatcactttcctttgctgcttctgcctctggaaaacatatactttcaatttttattatttcatttaaatcttcttttgttgctaatctaatattcatatattatttcctttcatgaatgagttttttatttttagtatcaatgtatattctatcatgtatattcataattttaatatttatttaatcaatttcttattatgttattcttctatagcttaaatatttagcaaagtctttattatagtagttgtagtaacaccacactatataattcctgagaaaaaatcactaataatattttaatagttctaacaatcatattccaataaataacactctcttaatcttaagctaatataaaagatatataatttattttaagatgagaggagtgattaaataatgaaacaactaaatatatgcattgatattgatggaactataacagacccttattactggcttgattctattaacaattacttcaatttaaacatcactgaaagtgatgttacagattatgacattgcaaaagtaatcaatgttaaaaattatgaatatgataaattttatgatgaatataaggtacaacttcatagcactgaaaaattaagaaaagatgttaaaagtgtacttgatgctctaaatagatttaacaacatttactttgtgacagcaagagacagatccttagaattattaactaatttatatttaaaatataataaaattccttttgatgatgtattagtattaggtactcatcataaagtatctgcagcgcaaaaattaaattgtgatatttttattgaagatagctataataatgccattgaactagcatctaatggttttaaggttttattaattgatacaaattataatagactccctcttaagaataatataattcgtgtttatgactggaaagaaatttttcaagttgtaactaaacttacaaaaaatgaagaagtggtttaatttatttataacaaaatagaatcagctgttactttaaaaacagttgattctactaactcatttataaaatcttttttgcaaaagtcatattacaatacttatttttttcaatgtaatcttccatatttggaagataatttttatcatgttcaatagatctaccaaagatggaaataaattttataatatgttcttcactatctgtatccataatattattaatatatatcccaaaaagataaaagcgtataaatgaatatcttaaaacaagcattagatatccttcaaacatgtcttcactttctgaaaatgggaataaatagttatatataaagttaactatatagttttcgaaaatatatccatacttctctgttatttccctatcatatttattaaatgcattgatgtattttttcttatcttcccttgaaatattactatatttaacatcaaatccattaattagcacatctttaaattcttttaaagtatttcctgtgttatcttcactcatattataagaattgactatattttgaaaaaactcaacttgaaaaatgtaatcatttctatctctcacatagaccatagcagcactatccatatcaaaatctttaataaacattggaattccattacaatcataagctgatattttttctaagccctcaataaatgcaccaagaatatataatctctggctaatatcaaattttctattttgcattatctttatggaaaatattcttatttctttaaaatactttataggtgtatttctatatttttttgaatttgtattatattcatcatttattatatattttataaattctttttgaatcaattcaaatttaatttcttctttttccccaagtataagcttagcagcttcatagcaagctacgtctaatgatatttcataattattatcaaccttattcataattcttggaaaatgtgtacagatatttgacagatactcttcgccaagggttgaataaatagtgcaatatttatttttatctaaaaaaggacacatttcctcatgatcaagctttattaatccataatcaagatcactgcttatacattcttcatttacttgtatatttttcttaagcataagctttgcattttcatctgtaatagcgttgtattgttcaaaagtatttttatcaatttctatatcccatgctttgcaacatgtattttcacattttcctccaatacagctaaacttcttaaaatatgttggacatgctactttcattctattatacataaattcatttcctttttatttgtaattatattataactaacatattatcctattattattttaatgtaaattattaaaataatctatctattttagaaacaacacataaatctatgatattacataatcttcactacaaggttgatattctgtctcagagtttttctcaaaaccactactcataaatgttgcatcactctttaaaaagtatttataacttcccacgtaatcatcattagtaatatcaatattataccacttgccatctacatttacttcattccaagcatgtgggaccccattaattgaacctataacaattctattttcaatgcctaccatattaaacattttatatgctgtcatggcatatccctgacatgttgtcctacctgttgttaaagctaaatatgaattatttgattgtaatgtatcatcataatcatatctatttactaaataatcatttacagccttaaccttttcataatcactcatattagaatttgtaatagcgtttgatgtagtttttatttcgttatcaatatagtcttcttcggatttcgttgttctatattctacacttacttctgaattatttccatatccttttactcttaatccaataagtgatttacttaaataatcatcctttgcagctgactttcttataatatctattacatcataattaaaataaggtatttcaaactctgtatcccagttttttagatgattataaatgttatcttcgatactatttatatctgaaactgatgcatgtgctgattgaatatttaaagttattagaaataatgttaacgctaaaaattttatactttttcttaccataactgcctccagttcatatgattataaatctataatattttaatataaatattatagatggtaattatgtcatattattgtcaattcaatttaaacgatcttctgaaaaatttgataattattttgtaagagaaaaataattatcaaattcaatacttctaaaaaatcacaattgtttttatcttaatttgctctaaaaatacttttgttttttataaaagtaaacatttttctcattaataatatcaaaattaatattattatacatgccataatattgggttttattatactaaatgagtatgataagctaaaagaggttaacaattttgcaatcattgctatacttataaatttatatggattaatattagtaagtcctgcacctatacatattgcttcatctggaagtattggtaaaataaataacaatagtactactataagctcatttctttttatatatttattaaaacgctctatatattgattgtttataaatttatctataaatttagtacctgttactctaacaaaaaaatacatggttattatgccaagtaatgttcctaaaaaaccaaaaaacgcaccattaaacattcctagaactgaacttccagctattatagttactggttcaggtaatggtaatattattggttgtaaaaagctaacaataaaatatataaatatcgctttattaccatatgattctagaatgtgctcaaagctaaaattattatttataagaaatgaatttgatatataaacaattaaactaactactgtcatgcctatattaataattcttataaccttttctaaaccataaaatcttttaaagtgtgccaatatatacattaatattaaaattgtatatccactaatcattatattattcaaatatatttcttcaattttaaaataacaatttatcataataatattaaataatgttaatatactaaagattaaaatatttttatgattattttttagtttattcatatgatatctccttgtataattagtttttaattataattttatttattatatatatttgaaatagtaataaaaaaaatagctgtagcacttgtaataacgacaatatacaaattatggccaataaatttttccaaggttaatacaatcagtaataaccaacttaaaacaattaatttcattcctacagatacctctttcctttaaatacaataaaattatatctaaaaacttttaaattcttatctagaaaaagtttaacttttgttaataatttgaggcaaaaaaaaagtatagacttttactctatactttctaagtaaatattgaattttatatcttcatttattttttcagccaatatattgcctccataaagttctattatacgttttgcaataggcagtccaagacccgatccttcattacttctagatttattttttctataaaatttttcaaatatattttccaaatcttcttcctttatttctgtacatttatttctaaaagatattactatttgttctttctccagtctaactacaaccttaaatacagagttaatatcactatatttttctgcatttttaattaaattttcgaaaaccctcagtatctgagctgaatcaacattacaaaaaagttcatcatatggattatctaatacaacatctatatttttatcactgaaatttattatactttcacctacagcctgacttaataccactgaaatattaattctatctttttttagtgtaagttcattacttgctaattttgtatattcaaataattcatttactaattccttaagccttaaacttttattatatgcaatttgtatatattcatctttttttctttcgctaatttctgtactatttaataattctaaatatcctattatagatgttaatggagtttttaaatcatgggaaatatttgttataagctcatttttattattttcaatctttttttcatttgctatcttttcacctaattctaatgacatatcatttatactgccacacagttcagctagttcgtctcctccttttactttaatgactttgccaaaaccttcattttttattattttaacttcttttgttaaatatttaatataatttacttttatattcacaagtaatgcgaatgttattaaaaatgtagaaataccaataaaagcaactatataaaatatattaatagaaaagaagtaattattaatgatcttatattcaaaattaggatacagtaaaaatataattctacaaaatataaaagtaccttgaattgctactataatagacactaaaataactagtattaaatatagaccaattttatttaaatttatttttccaaatatttttgtattaaatataataacaataattataaagactactaaagctaacatctttaaaggattattaacacctgctagtaaattgacatcaaatatttcaccactctgttgctttgcagctaatattgcgtatccttctgctaaaaccatttgtgctaaaacaaagcctataataacaccaaaaataagattgtacttctttacttttataagttttatcatatcttatagcctatccccaaacagtcttaatatactctggttttttagaatcattttcaatttttcttctaagctttgttatatgaaccataatagatgtatcagaaactgaatatttttctttccatataaattcgtatagctcttcaactgtaaatactttatttctgtttttgcacataacttctaatattttatattcagtaggagtaagccttacttcatttcctttcactgttacttcatgcatttcagtattgagtaccaaatctccaactcttatgattttttcatcactatttaaatttaaaatagtatatcttctaagttgtgctttaactcttgctattaactctaaagaactaaaaggctttgagatatagtcatctgcccccagagtaagaccatttatcatatcaatttcctgacttttagcagttaaaaaaattacaggcattttatatttttttcttatttctataatggtttctattccatcttttttgggcatcataatatctaaaattactaatgaatactttttttcttcaagcttaatcagggcttctacaccatcagctgctttatcagtataaaatctatcagcttctaaatataagctgataagatctcttatttctttatcatcatcaactattaaaatattttcactcatttttaactcctttacagtccaatacatatgctggtgggaaatttctcataataaatttagttctaattccagcgaaaaaattttctatgaatttctttttaaataatgaatattgaaaagttataaaatctccatcttcttttaataatctgctcgtcttatttaaaatagcttcagatgtattcttaggtaatgatgcaaatggtaaaccagaaataacataatctattttcaaaatttcatgatgttttagaatcttatcaatattttctgcactttcatttataattattacattattcttatatccatactttttcttaagttcattataaaactctacattcaattcaattagaataacttgtgtttcttcctttgctcttgcaagtatcttttctgtaaatacacctgttccaggaccatattctactatacatcttgcagtactaaaatctatactttccatcatcccttcggctaaatatttactactaggagcaactgccccaattgtacttggattttttatatattctaataaaaacataacttcacctcatccattttttatacattataaatgaaatattttaaggtacactacataaaattattaatttttgttaatatttttgcatattataaaaagcaatataatatataaaaattataatctcatattacttattactagtggactttgaatatgttaataaataaagcagacaaattctattgcctgctttatttattagtatatatttaatacttattaaacattttcttcaatatttccatagtttaagaatgcattaagaagtacagcaactatagatgctgaaactataccgcttccaaaaatttctttaaatattgttggagtattgtcaagtatattaggtacaacagtaattccaagacctactccaatagaacatgcaacaactaacatattagaatttttattaaaatctacttttgaaagcatttgtattcctgcaactgcaaccattgcaaacattatagttgtagcaccacctataactggctgaggaataatagtagctaaagctgcaaatttaggaattaaaccaagcgaaacaagaattatacctgatgccacaacaacaaaacgactttttactttacttaatgctaaaagtcctaaattctgattaaatgttgtgtatggaaaggaattaaaaatacctcctaaaatagttgcaatcccttccgctctaataccacgaacaatgtctttttgagtaatttctttttcgcatactctaccaattcctaaaaaagttgctgtagattcaatcattactactaacataacaaaagtcatcataaaaattgaaccgagatcaaatttaggaaaaccaaagttaaatgggtgaataaagcttatccatttagcattttgtattaatgaaaaatctacctttcccataaatgcagctactattgtgcctaaaacaataccatttagaactgaaatagcttgaaagaatcctttcaaaaatttatttgataataatattacaatcattacaaatgcagctaataaaagattttcaatgctaccaaaatctttagcacctgaacccccaccaatgcttgtgacaccaacattaactaatgatagaccaatcattgtaacgactgtaccagtaactacagtcggaaaaaatcttaatattttcccatataaaggtgctatgattaaaacaataatagctgctgctattattgaaccataagctgtctgcatacctaaatttttaccaataattattaaaggaccaactgctgcaaaagtacatcctaaaattgcaggtaacttaattccaatataaggaccaataccaagtgcttgtattaaagtggcaagaccgcatgtaaataaatctgccgcaactaaaagtgctaattgctcaggtgtcaaacctacggcccctccaataactaatggtacagccactgcaccagcatacattgccaatacatgctgcagtcctagaactgttaattgatttaatggaagcatttcatttgctttatcttgtttgtttaagtttttagtcaacatattttccctccaaatagatttctaaataatttaataaaatacattttatatatatactgaaactttctgacattattttatcataatcgagaaaataagtcgaatatttttttgttatttatacaaataattcgtataaatacaaattatttgtgttttatacatctaatagttcgaagcgtattatcctaaatcttctctatctttgactattttattttttcaggaagaattgatactgattttatatttcaaaatagcatattgaatttgcaattctcataatttgaacttatataataaaaaaatcatactattcatttatattttgaatagtatgattctctactaacattgtatttttattttaacatttgtttttatataaatatattaaggcaaacgattaccagctgcacgataaatttcgtaccattgtgctcttgataaatctacattacttgcagtgcacatatcttttagtcgttctatattcgtagttccaaggattgtttgaattttagcaggatgtctaagaatccaagctattgctatagctgatttgctaacacctttttcatttgaaatacgtcctagaactttatttaactctggaaatttgtcgttatcaataaatataccttcaaagaaaccatattgtaatggagaccaggcttgtaatgtaatgttctttagacggcaatattctaaaatgctaccatctctatttacagaaccttcgaataaagtgttagcttgaataccgctatcaaccattccagaatgcataatactatattgcatttgatttacgataagtggttgcttcacacaagatttcaacaattcaatttgcatgctgttaaaattactaactccaaaattacgaactttgccactagattgtaaaatatcgaaagcttctgcaacttcttctggttccattagtgtatctggtctgtgaagaataagtaaatccaaatactctgtttttaatctttttaggctattatctacagaagttaatatatgatctttagaaaaatcatagtatccatctctaatagaacatttactttgaatttgtatcttatcacgaagtcctgatctagaatctaacattttcccaaaaagttcttcacaataccctccaccataaatatctgcatgatcaaaaagtgtaattccctctgacatagcaatatccacataatgtgataattcctctacagacattttatcaattctcatacatcctaatacgatttcagatgcttcaaatccagattttccaacattaattttcttcatcattaatatcctccttttatcataaccatgtacttgcttgtacacaggttttatcaattttatatgtagactatatataaacctttataatttatttgaaaatattattataactgtttatttaactatatataaatatttgtactttagttattacagcttgaaaaagttaaaacaaattatattgaattaaaaaaagctaatgttattatttcattctaagctcttctatcatatttcttgtttccttcaaatacttttcaacatctgagaaattctcttttgcaagtcctacaaatagtatatctataactgtaagctgcactattctagaagatatagcaccaattctcaaatccttttctacaaatggtacttgtatttttatatcacctaatgatgacactggattttctccaaactttgttattgtaatgcatttagctcctttttctttacatttacttaatgcactatatacttcttttgtttttcctaaataagatattccaattgctatatcatcatttgatatattagctgacattgataactgtacatgactttcaaggctaatcatagcatttttatgtattctaagtaatttatattgtaaatcaagtcctattaatgctgattctccaataccaaaaatatatatatttttagcattctttattgcctttatagcttcttctatagtatgttcatctagtagagatatagtatcatttatactctgtatatttttgtttgcagttttaactatgacttcccttatattatcttcagtgtctatataatcgtattctatattttcaactggattaatatcatctttagcaagttctattttaaactcttgaaaaccttcaaatccgagctttcttgaaaaccttaccacacttgaagagctggttttagtgatattagctagttcacttgcagaaaatttatatacttcacttgaattaactaacacataatcagctatttttttttctgattctgtcatcttatcataaatctgtttaattagaagggaacaattcatataacatatcacctcatatattcaattttctattgtattaatttaaatttttgccatggactaatataatctaataaaaatacctcatcatcaattatttttcctaccacattagttttacctgaatttttcatatcaagtttagctaactgaagttcaccagcataatgtccatagagggaactttctataagtatgtttcctttttttatatcatctggattaaatactttaaactcatgacctttatattttactctgctttgagtggaccttatcatatattcagatacatcgcccctattaaagtgaaattcttcaagaactatctttttctctatttcaggtaacccttcttttaatttacactttaaagttaaacaatatggatctatttcacttaatccttttaactcttcttcacttgcgaaacagtttgatattattatatcatcaattaaatctgttgcccataaatgttttgcttgtgctactatattcatttctctgtgcatttcaagtgtacataagccttcccttacaggccatgggccatattcagcagtatctgatgatataaatgcagcagttctgattcctaaatctttaaattgtctgctagttttcataaaatgttcataacttaaccccgtatatctatggggataaaagttatgacaagataatatattgtctttatttggtttataagataatatattatcaatatattttgttccattacttatatttaattcaatttttaattgttctttattaaaagacattatagattcttcaagtccagtaaatcccatatccaatctcaatccatataatccaagttctttaaaaaatcttaagtcattataacttatgcttaaatctttgaatactttaggacttatatctgctataacttccatattataattattggcatgttttataacttccttaaaattatctactatctttgttttatctccttccactgataaaagacaagtaaatactcttttaaaattatactttgcagctaaatctatataattttttatttctttaacactattatgcattggatatactgaaattcctaattttctcatactaatcatctccatttaaataaattttttaggtgcaggtgttatattacctaaaattactttttcataagcccctgttgcagcaggaatatttccaaaacttccttctaaagtttcattggcaagtattgcaaatgcaattgcttctttgctctctgaagaaaaaccaagttcttcttgtgttaatattttatagttaggcataatatctttcatcatacttagtagtgtattgttatagctaccaccgcctcctattattacttcttcaatagtatatttaggctcaatataattcttataattatattctattgattttgcagtaaacatagttacagttgcaattatatcttctattttttcattgtcacatttttttagtatcttatgaacaaactgagcaccaaataattctctccctgttgtcttaggtggtgactgatatatatatttattcttcattaaatcatcaagcaatctatatataatctttcccctagctgctatttcaccattcttatcatatttttctcctgttaatctaaaaactgtttcatcaataatcatattccccggacctgtatcaaatgcaaaaacatcatccaatctactatttttaggaataactgttacattacctatacctccaatgttttgaagtactctatttttattggatttatatagtatgtattcagacaatggcactaaaggtgctccttgtcctcctgctgctatatccattgttctaaaatttgatactacggtgcatcctatttcatatgctattattgctggttctccaatttgcaatgttgatcttttaaattctccaacatcatttggtatatgaaatattgtttgtccatgacttcctataaaatctatattttctacatcaaaattaatttttttacacaacacttttacagcgttactaaatgcatgtccaagttcaaaattcaaactgcatataagctgtgagtcagaatcctttattgaaatgcattttttgattttatttctaagttcaacgttaaatggtattgtatcaaatgcgacaacatgtaaatttgtatcaagtccatatccatctattttaattaaaactacatcaatgccatcaagagaagttccagacattatgccaatcccatattttctattcatgttctcacctcttttatgtttaattctatatattcatattaataacttcatagtatgctcctagtgtaggagaaatatcttcatcatatatactatagtttcctaaattcatatctaaatatttaataaaatttgcttttacaatttctatttttcttattatatttcctgaaattccaattttgatattttcttttaaacctgactgttttattgctcttaatgtcatttcacctaattcttcgcctgcatttattaatatttgtgtcgcagttgaatcattctctttggcaagttgtatcactaattttacaattgcagcaacatgtgctttatctgtattataaataaaattaataatatctaattctcttttacatcctaatttatttaatattctatctgtaaattctgattttaattgtccattatctttttcatatgcaatactttttaatgcctgtatccctatataatatccactgccttcatcgcctagtagatgtccccatcctcctgctcttatactttttcctgaaatttttccaatacatattgatcccgttcctgcaattgttaaaaagccatcttttccttttaataaagcagaaagtgctaagtcagcatcattaaccacaataacattgcatttgaattcatcttgtatatacttttttattatttcttttccattgccagcagtactcccagctattccagcataaatatatacacactcacttttatttaagcttttaatacatttctctatggattccttaatattatttaaagctttttctttattaattagtatatttccataccctgatatacttcgtgataatgaatttccatttaaatcataagctactgcttctgttttagttcctccgccatcaacacctattatatatttcatattattcatccttcttcatatttttaaagtaatactgaatatgaaaaaatcacacctaccagcatcttcttaatactagaagtaaaaagtttgcttgttaggtgttctttttttagtattcttattatttttaatgtagataatcacataacattcattaaagaaaaaaaattatttaattccacattctttttttaattcttctacagttccatgcttttttccatttaaatctgataaccattgttgtttattattaggttctagtgaagctgcattattaaaattttctggatgagtaatcctagtaattacagctcttgtaacattagaaaccctacattttgcaatactataacctgcatttatatctggtttagaaccatttgatgaccagtaatagattatgtcatcacgatttccattcttatcatatgaaactgttctatctaaaaatagaaccatatgtccacgttcatcaccaatactattattatcatcacacccaatgccatcattccaaaaaatttttaagaaatcaaatctttttgcttgttcccatgctctataataatcatcactattactatattcacttctacttccaatataataatttttaccagcatttaattcattgactaatacagcaaaaccaggtccattcgcattagctcttccccaagctccaaaaccatcatcttgcttttcttgaatcacattaccataagagtctcttttttcaattgtatacggttttaaatttacccaggcttgtcttgaaatagcactttctttttgagatgtattccaagttaaaaggctccttactaacaacatataagttgcagacgaacaaaaagaaggtcttgctttatcaacatcaataaccggaacttgaatgtcagtatctagttgataagcactatccataccttcccatgtagtttgaggaaagtcttctgtatgttttgaaccagtataatatccacctttatcattaaattgttccattgattttaatacagactcattccataatgataattttttagtatcaggacaagaggcgccacctattaataaagttatcaaacacataacaattccaattgaaaaacactttaaatactttttcatttatcttaccacctttcaaattattgtttaattttaaatcagtaagtgtttctatcataatcaaaaatagtatctataaaatgcaaacttaaacaaattgtactttatcttgtttttctaatatccatagtagctttaatacccttagtttctgatatttctctatttatttcgaaaaataataaatataaaacaataaaaatagcaaccaaaatagtccaaacaattggattaatattatcaaataatatcttaggaataataagaactaatggtgctgaaaatccaataatccatctatttactttatgtttttttattatttttctacataatcctaacgaacctaaaacaaatgccatcataagaattatatatactagccatgttagaactttcataatgccacctcattgataaatatacatcttaaaatatatttctaagatgtatatttacatatttagtattttatttttcatataaatttctatacattttaatcatttttccaattaatgcgttttcagatattgcagtcattaattgatcttgtgcatgtatcattaataatgacattttaatatcttgtccgtttatttctgattgaattaattttgtctgtgtattatgagctaaccctaattcttcttcagcttttttcattaaggtctctgcttctgtaaagtctttattttcagctgcatcaagagcctcataagcatatcctcttgaatcacctgcgtgtgatattatttcaaatatttcttgctccatttaatcatcatcctttgctattatttattaaactgtggcaaatattctttatttaattcatataactcatcaaataactttatagcagtatctattgatggaattaacggattattagctaaagccattattgctgcatttttatcaccatgtacagctgcctcaactgctaatatttcataagcctttacactttgtataagtcctaatattttttgctcaactggactctttaatgctagtggtgttgcgcctcttttatctacaatacaatttacttcaattactgaatcgtctggaattcctttaattgttccgttattcttaatatttactgtatgaatatctttcttatcgttatatattgcacttattaaagatactgcagcatcagagtaatatgctccccctcttttttcaagttcaactggcttagtatttaattcagtatttttgtatatttcaaataacttttcttctattttcttaacttgttctgctcttgttcctatagtttctgatgcttctttttcttcttttagtaatctgtctgtcatataataatatctatgatatggacatggtaccattcctaatgcatctaaaaattctttaggccactttaagtcagatatgtttttcattgtaagacttgcaccatcttttaatttttctataacttttttagttacattttcatccttgtaccaaacatttcttccccacaccaaatggttaagtcctacatattctataaatacatctttactatcaacatcaagcatagaaacaatatccatcttcatatgtattggcacattgcataatcctatacacttaatatcagtatattttaatactgcttctgtaaccattcctgaaggattggtaaagttaattaaccatgcactaggacaaatttcttttatatccttgcatatatctagtattactggaattgttctttgagctttagtaaagccccctggtcctactgtttcttgtcctaaaacatcatactttaatggaaatctttcatctcttgctcttgcatctaatcctccaactctaaattgtgttactacaaagtcggagttttccaaagcttctcttctatttaatgtaagaacaacttttacatctaatccagctttttttaacattcttttagctaagtctccaactatactaagcttttccttaccttcttctatatctactaaatctatttcaccaataggaagttcatcttttctttttatgaatccatctattatttcaggagtgtaactgcttcctccaccaattactgtaattttcaatttacgcatttctttatgcctccaatataaatatttttatattaatctagcaccgatttttttatcggtgttagattttatgttttatgttaattattgttttccataccttctttaattaatttcttttcataagctttaaagaatgggaagtatattactgttacaattgcaatattaattagtactaaaattatagctctccaatctcctccagttgcaagatatgcaccaattggtgctggcaatgtccatggtgctagtactactggttttgcaactaaattaagaaccattgcaaaatatgaaataattccacaaacaacaggacctaagataaatggaataattaataatggatttaacataataggtgcaccaaaaattacgggctcatttatgttacatattccaggtattaaacaagccttaccaatatcttttagatatctagatttagaaacaagcattaatagtaccaaacctatagttgctcctgatcctccaatccatacaaaccattgaaaaaatggttctggtgcaatattaggaacaggttgtccagctgcttgtgctgcaacattggcatcaagcatagctaaccatataggtctagctacagttccaacaacagaatctccatgaataccacaaccccataaaagtgtaataagaagaattggaacaactattcctggaagtgaatttcctgctgtaactaatggtttaaatatattaagaataaattcctgaatatcaaaatttaataaatctcttataatccatattggtataattattaaagttgcaggtattaatgcagcaaatgaatttgcaactgatgttggaacttccttaggcatctttattgtaagatttttttctttacaaaatctatagatttcaactgcaaagattgccattaaaattgaaacaaacataccagatccacctaagttagataaaggtaaaacccatccttgaggatcaatatttaatggaacattagtaagtaaaaaagctgctaaacctaaacttccaccagataaaggatctagcttgtaagatttagccaaattatatgcaataccaaatgatgcatataaagccattattcccatacttaaacgatatggaaacattatttgagttacatatggctttacaagtgcttttaacgtttcagatggtggaatagcaataactagaaagaaactacctacaattattaatggtatagtagatacgataccatccctaatagcttttaaatgtctttgttccgataactttgtcatcggtggtaataaatatttttctaaccattcaaaaaaagttttcattttttattcctccttttaaattaaagactatttacaatatttctttatttgtttaagaactcttgcccacctacctaatggtgtatagcccataggttcgatagtctctacttgtaatttaaattcttccccttgttctttaaaatcctttagtctatgtcttacttgtggggctaccaatgctaaatcgtattcattttgttttatttcatcataaaattcacttgtaccaactgctttaatctccaatttaaaattttctttctctgcttcttttttaattgcctcaactactattgcacttgacattccacctgaacataccattaatactttcataaataaaacctccaattttaatacattatttttgttatttatatattcactaaacattttgcaatgcttttgaaatatacccctcatttttttctaataaattctttgctgactctttatctaaaccactctcaatcatgaagatagataatttaacatcataatcagtttcatttaaatacttttctgcttcatctttagaaatatttgtagctaagcttactattcttttagctctttctaataattttagatttgtaggttttaaatccaccataagatttccataaaccttacctatctttatcattgaaactgtagataacatattaaggaccattttttgtgcacttcctgctttcattcttgtagatcctgttataacttctgctcctgtcactacttctatagctatatgagctatttttgacatttcagaaccagaattacttgtaatcgatatcacgaaagccccaatttgttttgccagttccattgcaccaattacatatggtgttcttccgctagcagctattccaacaagtatatccttagatgaaaactttattttttctaaatcattttgaccttgtaccttttcatcttctataccttcttttgctttaaacatagcatcttttccaccagccataattccttgaatcatgtcttctgaaactccataagtaggaaaacactctacagcatctaaaaccccaagtcttccactagttcctgcgcctatgtatataagtcgtccattatttttaaatgcctctgttattttttcaatagccatttctattttaggaagttctttttcaactgcactagcaaccttcttatcttcattgttaatcgttttcaaaatatccatagtagatagcctgtctatattgagtgtatctaaatttacactttcagtaactaaactttcaagattaaatttattcattaaaatcacctctctcttccttacaaattaagtatatacccgctgaacttttgtgtcaatatattttattatattgaaatattatttcaatacttatcttaaattaactttttaatgtatttataaatcttctctttatggcaatataattctttttccacttgtagtgaaagtattatattatataaaactctcatttttaatattcatatttcttgtaaatgacttaataattttaaaattatcgacatatctggccactatattaaattaatgaaatacaaaaaacagccagtatataaacactagctgcctgtatatcttaattgtacattgctcataacaatttaatttcattaataaattataattcattaactacgctttaaaatttcagttcctattaatgagtttgaaatagtcattgcacgtattaaggacgtaaagcttatattgtgtgcttccttctatatttcctttgtgccttgtttcttttaaagctatcgcttataaaacagctattcgctttacttttatacctcaattaaattttatttatatatttatcatctatctaataccatagtatattcaagttcttttgtttctgcattagctttttttctaatattctaaaattatttttacaataaaaatttactgcttttttattttttacaaaaacatccaatttaatatgttcatactttatcttacaataatttaatagattagatcctattccctctctctgatattccttttcacaaaaagtcctgcaatataacttttatctataactcctataaatccctttattatattttcttccttatatatataaacttcagctaatggaagcatttctttaactacctgaaaattattaatccaatattctttaggtacaaaattgtgagcttctatattagtttcaatccatattttcattacttcatctaaattatttatcttaaattcttttatcatatctttctctccaatttagtaaaatataaaaattgaagtattactcactcattcatttcaccctttcaaaaatatatatcttttcacattataacatactttaatattattaatatctactatgtcatcatcactctaagtattacccataaaaacgtagattaaatctcttttctaaaatagattttaatcttgcttaaattttaaatccaaaatctttaacacattttctaatagcttcttcagtttctaaaaaaacaattccattattttttaattttaagtttgatattcttaaatctcttattctttctttatatctttcttcatcccttattaatatatcattaattttatgtgataaattcatctcttctaaaataatttttgctacattataagtgcttaaattattttcactgccagtattgtaaactccaaagggtatttcaaatattttattgaagttttcaagtaaatcatgtacataagtcattcctctatactcatttgatggaactttcatattttcgccttttaaaactgcacgagtaacattccatataatattagcatttactttaccacacttttctggaaaaccaaataaccaattaaatcttaaaatccataaattttctgcaattttactgacttcttgttctgcaagaagcttttgcttgccatacactgtatctggaattggaatggtatcttcgttatatggaccttcttctaaatttccattgtaaacttgttctgaacttatatgaattagattcgcttttaccaaatctgaagcttttgcaatatttttacttcctgttacatttatttcaaaagaatactcaggattcttttcacagacttgtgtatctgcaatagctgcagtatgaactataaactttgggttaacttctttaacttttgatatgacttctttttcatgagttatattaagttcttcctttgataatgaaataatatcatacttatctttataatattcattaaatctggatgcaaagaaacctttacctccagtaattaaaatcttatccattagctatctcccccattcgcttctatattttttgtcataatttataaattatattatatcatataatttaccgtatcttatctttaccacatttaaaaagattttatataaacctaattaatgcaaaaaaattgcaaatccaattttttgaataatgcaatttttttattaaatatttattttttattattcataattatatcttagtgtataaactatataattatgataaaggaaactgaatttcagtaacatattcttctggattatttgtttcccattcacccttatggtatatttcacgaactggtccatctatcttataattatttttctcaatccagttatatatggctttataagtttctcctattgtattaaatgaaccttggtgaacaacgcaagccattttatctacagcaggtaactcataaactttaaaaattttattatcatcaacacgtttagttacaggttcagctacttcaatatcccatgattctgatgtttcgtagttccatgttgaattatgaaacaatatcatacaaggaattgtacgtttagtttctgatttatctataaaactattaatacttgtccacattttatcacattcttcaaaatcacatttattaattatatttcttattgatgcaataagcactgcttcaactctttttacagttatctcattcataattggcacacctccgtttttaattagaaaaatatttgttctaagacggttgagcctttttaattcattttctaatgcctgttcaagtatttcagctttatcttcaagcattgaaattatagaatcaattgaaggagtactttgtagaattgatgctatttcactaagtgaaaatcctgcatcttttaaagctaaaattttatttacattagcaagttgcattgcactataatatcggtatcctgtaaaatcatcaactttttcaggttttagaatacctatttcattataatgatgtagtgtgttaattgataatccacttaaatttgaaaattcacctatcttaaacatagtatacctccatttattaggctttacaggtgtgcacccctgtcgtctatattcattatatagtaatgggtaaccatagagtcaacatttatataatcattttttcttctagtaaatgaactctaacatatttattgtcttttctttttaattgaaatgattaaatatgttagagttttttattaagttttaactagaacaatgactcataataatgatatctaattatctacaagatttttagttgcagggctttctattaattttccattataatcaaatcttgatccatgacatggacaatcccatgttaattcatctgcattccaatgtagctcacatcctaagtgagcgcattttgttgatacgaaaaagacttctcctttgatgtttttataaactccaaccttttctccttcatgctcaacaattcctgcatgaccattttgaatatgttctattctattgctcggaatatatattttttgtgctataaaatttttggctgttttagatatgtctttaccaacattacttatagacaatgataaatcaaatctttttggtgaaaaaatttcagaataatcattttcttttcctgatatcatatcagatatgagcatagcagataccatagaacttgtcattcccatttattaaatcctgttgctacatatatattaggtgtatcatcagaatatcttcctatataaggtattccatctatagtcatacaatcctgtgctgaccagtaatatacttcttttgactttgggtataattcttttgcagcttttcttaacttttcaaaacttccaccagtttcattttctcctgttctctgctttattccgcccaataataataaatcctattaatctataaatttacaactctctttgcattaaaacagctgtgtatccttctttttcaaattcatctccagttttataaaaagaatttttcagccagaatgcttcactttgagaatttccgtttgcataagccaagcgaatatatttaaatcctagtgcttttagatatgtagcacattcctcaatgatgttagaaccaattccctttccttgatactcttgctccatcataaataatccaataaaagcagtcttattgtctggaaaattaattattaaatccataacagccaccaatatatgattatcaaaaaatcctatataaaatttatcttctttacttttattaggtggtaacatattcatatcttcatgaatactctcttttgtcacatacggtggacaatatttataaaactttggatttcctatggataaagtatatattaaatctatatctttatcatctaattttctaatttggtattttaaagaaagttcacttatattcattcttacctccacatatagattatcgatattttactattatcatttccgagttcatcctttatccaatccactattgtatcaatgtgttctggatgttattttaacattactatcttaataattatctcacctaccaattttggaatttttcgcttaaaccatcagattatacatcattatcataaatggcattgttataatacacaagataacagataatgcattaattacacttgccattcctggattattatcataaatctgtgcaaactgcgttacgcttgaagcacttggtgcacatgcggcaagaaaagaaataagcataatttcatcagcccctttaataagacgtgtcattccactaaatataaaaattaataatactatacctggtaaaaaaatcagcctgaaaaacgaaatcatatatgcccttttctgcatacaaacttcctttaaattcatatttgcaaggagcattcctataacaaacattgataatggtcccatcaaatttcccatactgttcattgcactttgaactggtattggtaaattaacctgacctataaaaataatgattcctacaaatatagctaatatattgatattaaaaagaatctttttaatatcaaagttacgatcttcactaattatgaacttacaatgtgtccatattaaaattgtctgtactataagatatgcacttgcataaaaaaccatttcttgtcctaaaaccagctgaactaatggaatgataagatttccacaattagaataaatcacagatgctttttcaattgtattaaacttgaatattttttcaagtatataacttataaatatgtaaacaatatgaacaataatagcagcaaatactgccaatacaaatcctttcactttgtcagctgttaattctatggtaaaagcattaattattgcacatggtccagaaacaaataagaccaatgttgataatatcttgctatctgaaatattacatattttctttctaatcaatatgtatccaacaattatcattaaaaacattgcagcaatttgcttcattaaactgatactaagttccataatctccccttgttttatcaataaccactcttctcaattccaaataatacataaatcctaatttaatgttaataatttaaactaatcatgaaagaaaaaatataatctattatactaacaaatattttaccatatcttaatattaaatatatttaaatttactattcttaattgcaaattattttgttattttagcttagtttttctaatttctctcgtaataacaactacaccataaacaccacatattaacagtataatatcttcataaacattaaatattactgacttaattcctgttagccccatatagttaatagaaaaagtaagaatttattttttctactataacccgaatacactgctatactaagacttataataggacaaggcattatataagtaaccatctttggataataatttcctaataaaattgaaacgccaggatatattgcatataataacaataatagaatttgccaaggattaggtctttgaagcttatcatctgtattacgtatgcattcatatagaaatattgctccgcaaataaaatataatggcaaagcaaatagcttttgaactggttcaattccatatatacaaaaaaatacaatacttatatagatattagcaatacctaatgccaattttgcaatccatttaattttcccataatatgataataataatgataaacctaaaaaaaacattagtataatttgaatagttacagtgtgtttattataattagctataacattccaaaatatttgtgaattcatataaacatctctttataaattacaattcattttagattaattataattcgtttggaaagcattacaaagttaaattttttaatagtattttatatttgtttatgcacaaaatctacagtgaatcactatatatgtattgtgccgtattttaaacaaaaaaatatcacactatccatttattatttttaataatgtgatatataaatattaaattttatacatatataaatttatataatttcaatgcctttttctttaaactcatcaatcaattcttctgaacacattgcaatatattctacttgccttaagtttggtaatttttcaaatcccctatacttttaacatcaaattcatcagattcaccatcatactctggcataatcataaagtatatctcttcaccaccatcaaaacaaagctctgtaacaagtgctaaatcttcttttgtaagatttaaattttcaaaaaactcaaccatctctggaatgcactcaaaaccatcaccttcatacacagcaacatatttttcattcatttcttcaagtttgtttgaaaaacttgtttctttttccaatagactattaattacaactagtttgaatccaaagtcttcaaatataccacttttatctttaaacatttttcttccccataaatatttataatttatttaacataaatattataacataatttgtaaatatcacattattcaattttcaaagaaccaatatctatttattacgtcaaatctgcattttgcgcacaaaaaatatcacataattcatttacttctgaataatgtgatattaatctaatatctatcctaaaacactaaaaatccaatcagctatccatgtgtacttttgatacttaatataatcaggatctgttactgctgggtctgaaccatccagtgtattaaaagcatctatttcaaattgataacaaatatctttaagttcttcaatttggtcatcagtagcttcaatatcaatagtacacataatttcttttgaaaagcctaatttatataatggagtatctttaataataagatttacattaatgtctggcattagattcccaataccttttttaacctcaaataagtattaaattcagtttctattctcactgataccactcccaattaaataatttaacttaattatattttttcatatcactatgaaccagattatcctattaggtgtatgaaaataattaacctctcataaatacggtgttttccaattattattctataaaaagaatagtaattatattctaaccacatttctaattcactaattattttcataagaaaaactccttagtttaaaatatacatttcgatttgtctataaccacattataatatatttatatttatcatactttaactttatttgttatcccaattaagaggtatattcttaaccataccgaagcttttaagaataaaatcaccatttacatattgaaaaactacatcaaattctgtattttcattcattccatagtatcttagacttattatatccagaacatcaaagcatatataagcaacctcatacatatatgcaaatttactatctccactgtatttttgagcgatacagtccattgtacaaagacttttagcaataaatacaatatatggtcttaactcctcaaattttgatacttcttcctccaaatcaacagtaacttcattataccttttgtctccaaaatatatcagaacctgtgtttcatcaatcaattttaattcattggcatccacaactaattttaagttgtctgcataacgctcatgtatcaaattatcttcccccttgtataatctagttgtaacattgtatagaaaactatttataattcaaacgaacattacaagtctaattattattaatattcttatttattactctgcctacgcccagaaatggactctgcatttcatacaaaaaataattttttaattaaaaagatgctttgtctattgcaaacataggcaaatttcaaaatattaagttatatttcaaaattataatactgttttttcagaccctacatctattgagattttgaataattataccagtccaaaattaagaatagacactcttaaagaagatgtactcaaaattgccattgaaaagtctaaaaaaggatcaactttgtctgaaaaagtatattcaaaattaattactattgcaaaaaaagctagtattatcaccattctgctaggcggtttatccattaaaatatctagttctttggcattaattaaagcttttaaatcacaaatagataacttattaaacgaaatcaacacattacttgaatcatctgaatttcctaaatctataaaaaaattttgaattaatagattctattcctggtataggacgtctaacagctattcttttaatagcttatccaattatgttacttaaattcaaatttaattaatctactattattggttaattatataatatttactaatacttaaaattatcaaactatttttatattttccatcatgcatatctcttttctttatagctgccactggaataaatcaacgttttttatcttaatggctctccaagatcatatccatcgagttctataatttaatattaaatataaccaatagtcttatttcatttttaattgcactatgaaatttttacgaactatacttttctagagttttataattattaaattttatcttaagaatatttataagtattgtttacatatattccatataattctataatttaaaatagaaaacaatgtcaaaggggtggaaataataatgaataaaaatataattaaaagtttaagtactgcacttattagctgtagtttattttgtatccctgcaaatgcagaatggaaatacgattccacaggctggtggtatacagaaaataatagttattcaactggatggagactaataggtggtgaatggtattattttaaagaagatggttatatggcttcaagtacctattgtgaatttaataatgctactggttcttattcacctggcactcctatagaatgtaatggcaactactattactttgataaagatggtcatatgttacatgattgctttataatagaaggaagtggcagattccaaacttggttagatcataatggaaaatcaacagaaaaacagtacgggaataaatattctggtggatatgatttaagttattccaatttaacatatgtaccatatttaggtggatatactgaagcagaagctctagaattagcaaataaaatgggtttaaaattaaatattaaatatgaaaatatccctgattcaaatcttaataatgtaatcttaggtcaaaataatatttcatcacaaataacaaaaaatgaaacagaatgtacaataatagtaggaaaatattccgattcattaactggattcacaaatactgaaatacgaacttttatgatggagttgcaaaaaaaatataataattcctatagttggttatacttctatggtttatattagtaataatataaaccaagctatcaggcaagaatctaaagtctgcctgttagctcatcttctatcttcttcaattattccctaatccccacaattatttttttactgatataattttaatactcaaaagcataattgtttaaggttacttttataatttaagcagtaaaatataatcattatttctttttcctctttaaactcttatttcaccttagtatttttcaccatttacattaataacaacatattcacttttacatcccgtacggaatacaaacccccactcagaaattcctgaacttacaatacatgtagttctaccagtttcttttatgccatacaccatttcattcttgctaacaagtctgttcatatatgcaagaggaaatatctgaccgccatgagtatgacctgacaaaagaagatctgctccagccttgtcagcttcactatattcaagaggctgatgatctaataatacaatataatgagacttgtctaatgctgcaagcaattcttctgtactttttcgatcatgaaccgtagcatcctgtctccctgttatatagaatttatcacccaccataacagtttcatcctgcagtatatggacattgttctttttaagttcattaacaaactcgtcagttgaataataaggatttcctccatagttatgtaaatcatgatttccaaatatataatatacaccatatttagatattgcttttcctagtgacttacatgcatttaccatatcctcataagaagtgctgccatcaacaaaatcaccagtaaccacaaccacatcaggattctgctgtgaaattttgtctatataatctccaaaactttcaccactgaatgtagttcctatatgtgaatcagtaatctgtataatctttaacttttcatttttctccaatttatcactggtaatattataatctgtttcgactacattatgtgcatttacccatccatatgaaaaataacagcctgtaataattattgcagaaattcctgctacataagcttttatttttagtttaaaacatttctttactatgctccagattatgtcgcatacaaaaaacatcagtgcaagatgaagctcaatcactaacgaatacatgaaataccaaattccaattataataagaataattactggtatagatgctacacaccatgaaagcagtctgcttttcttttcaatatcttttataaactgaaacttgtgaaagctccttgttatgtaaagtccaagaagtgctgctaatactaatattattattaagaatattaccataaaatcctccaatcaatacatatacaccattaaatttgcactaagttaaataatatccccttgttttatcaaaaagaaatacacattagtttttctggtcgattgtttgaaaaaccagcatatagaaaaccaccaatctgatttttcaaattctcatcattaagtaaactttaaactcttatttaaaattttcttcaatatatttaatgtaatcttttttttcaacttcattatagttattcttaaaccatttataagattcctttagaccttcaaacaaatccttttcttccatcaataactctgattgttttgtcacatctaaactatattcataatcatagaaactaaagtaatctctttgattattatgcttagttacatataccttttctaaaggtgttcctacaactttatagcataattcaataaatgtattaatatctattgattcagtgtttccaacattatatatatgattagttggatgcttctccaatattttttcaataactttacataaatcatctacatggaaaaattgcaatttcattttaccatcattaggaatataaaactttctattttttaaagcacattcaaatacaaacggctctctatatacattttgcattggtccatataaataaggtggtcttaatatataagcattaggcactttagaaatcaagtattcttctgcttcaatcttatctgttccatacttaccccatatcttattaactccaatactttggttttctgaaaatggttgcatgttagtttctggataaacagcagatgaactaataaatatgtaatctttaaatcccccaactgcatctaagatatttttaatatcctgttgattgtatccacatacatctattattgaatcaaaataaaaatcctttaaacaatctttcaaattatttctatctgcacaaatcaaattaatattttctatttgttgcttactccccctatttaaaacataaacctcataattatttgattgaaagtattttgctacatatttactaacaaatactgttcctcctgtaactaatatacgcttcataaaatccctcccttaaatccccattatccttgattaaacaataattaaataaaataatctcacctacaaattcctatttatcaattagtttaatagccaattaactcgtacaataaataccattatgaatcaattatagcatattttttcaaaattctattattcaattttcaaagaacattttataatttgctacgcaaaatctgcagattgttcttcaaactctattcgctaaattggagtttatctgttttattttcctctttactttctatagactatataatctacatattattcactaaaaaacagcagataaagcctattatctgctgaaacttctaattatactacaaagtcaaacttgattaatctttttaaatttttgtcctattattaaatatgatgaactgtttctatttcaagatgttctgttcttacaaccttaagtcttatttttatacacatcttttctcttaattttggatattgatatagtggtggatcaaattcacttaattgacttgttttaattatcctatatccacttattgaaaatgggtctggaaccattatttctttttcttctttattgtaaattggttcaggatttaatagatcatcatgtgttccaacaatctctgcactcaaaacttcaaccttatcgctttctttgaatttttctccccttggaagatccatttcaagaaagtctccaaagtttattacttttgtcatatgatatagtggtccatatactgtagggtatccgtccttgtctgttatacctgttccaacaatatttctgctatagtcaggatattgtgggaagaaaccgccttcattattattgttgttatcacctaatccactatccaagcaacattttaatgattgtgctactactttatatgatatattttttgtaatccaagcattgaacataacagctctatctcttgttggataagcctttacttctatcttttcatctatattatttaccataaatattcttgcaccttggtttctcaatttccaaaattctgctggaatagaatcaaaatcaaattctacttccttaaaaaaaagtccttcattttcagctagaataacattagtctgtattctctttgtttctgacatgcctatcgttttctcctctcattttttatagttagaatgatatttattcagttattcatctattcacttttttcatcatttataattaatttttgaagatttaccataattatcaactttataaaaataaaaa
